US011384138B2

(12) United States Patent
Anderson et al.

(10) Patent No.: US 11,384,138 B2
(45) Date of Patent: Jul. 12, 2022

(54) METHODS OF GENERATING ANTIBODIES

(71) Applicant: Rutgers, The State University of New Jersey, New Brunswick, NJ (US)

(72) Inventors: Stephen Anderson, Princeton, NJ (US); Elliot Campbell, Somerset, NJ (US)

(73) Assignee: RUTGERS, THE STATE UNIVERSITY OF NEW JERSEY, New Brunswick, NJ (US)

( * ) Notice: Subject to any disclaimer, the term of this patent is extended or adjusted under 35 U.S.C. 154(b) by 706 days.

(21) Appl. No.: 15/753,321

(22) PCT Filed: Aug. 18, 2016

(86) PCT No.: PCT/US2016/047620
§ 371 (c)(1),
(2) Date: Feb. 18, 2018

(87) PCT Pub. No.: WO2017/031353
PCT Pub. Date: Feb. 23, 2017

(65) Prior Publication Data

US 2018/0244759 A1 Aug. 30, 2018

Related U.S. Application Data

(60) Provisional application No. 62/207,022, filed on Aug. 19, 2015.

(51) Int. Cl.

| | |
|---|---|
| ***C07K 16/10*** | (2006.01) |
| ***C07K 16/20*** | (2006.01) |
| ***C07K 16/38*** | (2006.01) |
| ***C07K 16/00*** | (2006.01) |
| ***A61K 9/00*** | (2006.01) |
| ***C07K 1/04*** | (2006.01) |
| ***C07K 16/06*** | (2006.01) |

(52) U.S. Cl.
CPC ........ *C07K 16/1045* (2013.01); *A61K 9/0019* (2013.01); *C07K 1/047* (2013.01); *C07K 16/00* (2013.01); *C07K 16/065* (2013.01); *C07K 16/205* (2013.01); *C07K 16/38* (2013.01); *C07K 2317/14* (2013.01); *C07K 2317/33* (2013.01); *C07K 2317/92* (2013.01); *Y02A 50/30* (2018.01)

(58) Field of Classification Search
None
See application file for complete search history.

(56) References Cited

U.S. PATENT DOCUMENTS

| | | | | |
|---|---|---|---|---|
| 8,501,193 | B1 | 8/2013 | Drevet et al. | |
| 2002/0183484 | A1 | 12/2002 | Torres | |
| 2011/0301101 | A1* | 12/2011 | Xia .......................... | A61P 31/14 514/21.3 |
| 2015/0037371 | A1 | 2/2015 | Landry | |

FOREIGN PATENT DOCUMENTS

| | | | | |
|---|---|---|---|---|
| JP | 2010-510994 | A | 4/2010 | |
| WO | 2005097179 | A2 | 10/2005 | |
| WO | WO-2006044410 | A2 * | 4/2006 | ........... C07K 14/005 |
| WO | 2008/064488 | A1 | 6/2008 | |

OTHER PUBLICATIONS

Hemmer et al. International Immunology, 12, 3, 2000, 375-383.*
Yang et al. Journal of Biomolecular Structure and Dynamics, 2013 vol. 31, No. 9, 982-992.*
Mohan et al. Biochemistry 2009, 48, 1390-1398.*
Carmicle et al.,"Antigen Three-dimensional Structure Guides the Processing and Presentation of Helper T-cell Epitopes", Molecular Immunology, vol. 44, pp. 1159-1168, (2007).
Creighton, Thomas E., "Proteins: Structures and Molecular Principles." Proteins: Structures and Molecular Principles, W. H. Freeman and Company, 1984, pp. 286-295.
D. Mirano-Bascos et al: "Influence of Disulfide-Stabilized Structure on the Specificity of Helper T-Cell and Antibody Responses to HIV Envelope Glycoprotein gp120", Journal of Virology., vol. 84, No. 7, Jan. 20, 2010 (Jan. 20, 2010), pp. 3303-3311, XP055309173, US ISSN: 0022-538X, DOI: 10.1128/JVI.02242-09; p. 3307-p. 3309.
Delamarre et al., "Differential Lysosomal Proteolysis in Antigen-Presenting Cells Determines Antigen Fate", Science, vol. 307, pp. 1630-1635, (2005).
Delamarre et al., "Enhancing Immunogenicity by Limiting Susceptibility to Lysosomal Proteolysis", The Journal of Experimental Medicine, vol. 203, No. 9, pp. 2049-2055, (2006).
Dill et al., "The Protein-Folding Problem, 50 Years on", Science, vol. 338, pp. 1042-1046, (2012).
Fersht et al., "Protein Folding and Unfolding at Atomic Resolution", Cell, vol. 108, pp. 573-582, (2002).
Hartman et al., "A Reductionist Cell-free Major Histocompatibility Complex Class II Antigen Processing System Identifies Immunodominant Epitopes", Nature Medicine, vol. 16, No. 11, pp. 1333-1341, (2010).
Hastings et al., "GILT: Shaping the MHC Class II-restricted Peptidome and CD4+ T Cell-mediated Immunity", Frontiers in Immunology, vol. 4, Article 429, pp. 1-7, (2013).
Hong et al., "Methods for Measuring the Thermodynamic Stability of Membrane Proteins", Methods in Enzymology, vol. 455, pp. 213-236, (2009).

(Continued)

*Primary Examiner* — Michael L Borin
(74) *Attorney, Agent, or Firm* — McNeill Baur PLLC

(57) ABSTRACT

The invention describes a method of generating antibodies to a mixture of peptidogenic proteins wherein the peptidogenic protein has altered conformational dynamics as compared to a starting protein and wherein the peptidogenic protein has a similar conformation to the starting protein. The peptidogenic proteins can be used to induce an immune response, which can lead to the generation of antibodies and/or can be used to vaccinate a mammal.

18 Claims, No Drawings

Specification includes a Sequence Listing.

(56) References Cited

OTHER PUBLICATIONS

Hutchings et al., "Therapeutic Antibodies Directed at G Protein-coupled Receptors", Landes Bioscience, vol. 2, Issue 6, pp. 594-606, (2010).
Kim et al., "Crevice-forming Mutants of Bovine Pancreatic Trypsin Inhibitor: Stability Changes and New Hydrophobic Surface", Protein Science, vol. 2, pp. 588-596, (1993).
Loladze et al., "Thermodynamic Consequences of Burial of Polar and Non-polar Amino Acid Residues in the Protein Interior". Journal of Molecular Biology, vol. 320, pp. 343-357, (2002).
Lori et al.,"Effect of Single Amino Acid Substitution Observed in Cancer on Pim-1 Kinase Thermodynamic Stability and Structure", Plos One, vol. 8, Issue 6, pp. 1-11, (2013).
Magliery et al., "Protein Stability by Number: High-throughput and Statistical Approaches to One of Protein Science's Most Difficult Problems", Current Opinion in Chemical Biology, vol. 15(3), pp. 443-451, (2011).
Morris et al., "Overview of Protein Folding Mechanisms: Experimental and Theoretical Approaches to Probing Energy Landscapes", Current Protocols in Protein Science, Unit 28.2, pp. 1-22, (2012).
Nguyen Hong-Nam P et al: "Conformational instability governed by disulfide bonds partitions the dominant from subdominant helper T-cell responses specific for HIV-1 envelope glycoprotein gp120," Vaccine, vol. 33, No. 25, May 2, 2015 (May 2, 2015), pp. 2887-2896, XP029241333, ISSN: 0264-410X, DOI: 10.1016/J.VACCINE.2015.04.082; the whole document.
Ohkuri et al., "A Protein's Conformational Stability is an Immunologically Dominant Factor: Evidence That Free-Energy Barriers for Protein Unfolding Limit the Immunogenicity of Foreign Proteins", The Journal of Immunology, vol. 185, pp. 4199-4205, (2010).
Porta et al., "Rational Engineering of Recombinant Picomavirus Capsids to Produce Safe, Protective Vaccine Antigen", PLOS Pathogens, vol. 9, Issue 3, pp. 1-8, (2013).
Robert Thai et al: "Antigen Stability Controls Antigen Presentation", Journal of Biological Chemistry, vol. 279, No. 48, Nov. 26, 2004 (Nov. 26, 2004), pp. 50257-50266, XP055309174, US ISSN: 0021-9258, DOI: 10.1074/jbc.M405738200; p. 50260-p. 50263.
Sahin et al., "mRNA-based Therapeutics—Developing a New Class of Drugs", Nature Reviews, vol. 13, pp. 759-780, (2014).
Schliehe et al., "Stable Antigen is Most Effective for Eliciting CD8+ T-Cell Responses After DNA Vaccination and Infection with Recombinant Vaccinia Virus In Vivo", Journal of Virology, vol. 86, No. 18, pp. 9782-9793, (2012).
So et al., "Contribution of Conformational Stability of Hen Lysozyme to Induction of Type 2 T-helper Immune Responses", Immunology, vol. 104, pp. 259-268, (2001).
Tekalign Deressa et al: "Structural Integrity of the Antigen Is a Determinant for the Induction of T-Helper Type-1 Immunity in Mice by Gene Gun Vaccines against *E.coli* Beta-Galactosidase", Plos One, vol. 9, No. 7, Jul. 15, 2014 (Jul. 15, 2014), page e102280, XP055309170, DOI: 10.1371/journal.pone.0102280 the whole document.
Thomas et al., "Effect of Single-point Mutations on the Stability and Immunogenicity of a Recombinant Ricin A Chain Subunit Vaccine Antigen", Human Vaccines & Immunotherapeutics, vol. 9, Issue 4, pp. 744-752, (2013).
Written Opinion and International Search Report for PCT/US2016/047620 dated Oct. 24, 2016.
Wu et al., "Phase 1 Trial of Malaria Transmission Blocking Vaccine Candidates Pfs25 and Pvs25 Formulated with Montanide ISA 51", Plos One, vol. 3, Issue 7, pp. 1-9, (2008).
Yu et al.,"Vaccination of Malignant Glioma Patients with Peptide-pulsed Dendritic Cells Elicits Systemic Cytotoxicity and Intracranial T-cell Infiltration", Cancer Research, vol. 61, pp. 842-847, (2001).
Transmittal and International Preliminary Report on Patentability dated Mar. 1, 2018 received in PCT/US2016/047620.
Database UniProtKB—P03441 (HEMA_I79A0) Feb. 2, 2018, "Influenza A virus (strain A/Bangkok/1/1979 H3N2)", Database accession No. P03441.
Database UniProtKB—P05961 (POL_HV1 MN) Feb. 2, 2018, "Human Immunodeficiency Virus Type 1 Group M Subtype B (Isolate MN) (HIV-1)", Database Accession No. P05961.
EPO Office Action dated Dec. 10, 2020 received in corresponding EP Application 16757810.3.
Japanese National Phase PCT Laid-Open Publication No. 2007-530647 (translator's note: an English language member of the same patent family: U.S. Pat. No. 8,501,193).
Japanese Office Action for Japanese Patent Application No. 2018-508678 dated Sep. 22, 2020, and English translation.
Scheiblhofer et al., "Influence of Protein Fold Stability Immunogenicity and its Implications for Vaccine Design", Expert Review of Vaccines, vol. 16, No. 5, pp. 479-489, (2017).
Davenport et al., "Isolate-Specific Differences in the Conformational Dynamics and Antigenicity of HIV-1 gp120," J. Virol., 87(19): 10855-10873 (2013).
Macraild et al., "Conformational Dynamics and Antigenicity in the Disordered Malaria Antigen Merozoite Surface Protein 2," PLoS ONE 10(3): e0119899 (18 pages) (2015).
Thai et al., "Antigen Stability Controls Antigen Presentation," J. Biol. Chem., 279(48): 50257-50266 (2004).

* cited by examiner

METHODS OF GENERATING ANTIBODIES

CROSS-REFERENCE TO RELATED APPLICATIONS

This Application claims priority to U.S. Provisional Application 62/207,022, filed Aug. 19, 2015, which is incorporated herein by reference in its entirety.

SEQUENCE LISTING

The instant application contains a Sequence Listing which has been submitted in ASCII format via EFS-Web and is hereby incorporated by reference in its entirety. Said ASCII copy, created on Aug. 16, 2016, is named Combined_SA_01_PCT_ST25_V2.txt and is 10,883,263 bytes in size.

INTRODUCTION

Methods for making antibodies have been around for over 100 years and are routinely used by the skilled artisan. See, for example, Morrison et al., Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985). Improved methods for generating antibodies have extended these initial methods and have been used to generate many of the therapeutic antibodies now being sold commercially. For example, technologies such as phage display and transgenic mice, that is, mice containing the human immunoglobulin genes, have been used to generate fully human antibodies. However, certain antigens continue to challenge a researcher's ability to raise antibodies even when using the most current techniques.

To induce a cell-mediated immune response within the human body, foreign proteins are broken down into smaller peptides, usually between 8-24 amino acids in length, and are bound to MHC molecules, for display on the surface of antigen presenting cells. The MHC-bound peptides are presented to T-cells to trigger a cell mediated immune response.

The three-dimensional (3D) structure of proteins has been implicated as a factor in proteolytic processing and presentation of epitopes (see, Carmicle et al., Molecular Immunology (2007) vol. 44: 1159-1168). Moreover, Ohkuri et al. (see, Okhuri et al., J. Immunol., (2010), vol. 185: 4199-4205) agreed that conformational stability of a protein is an immunologically dominant factor. However, there is no consensus regarding exactly how the 3D structure affects the immune response.

Delamarre et al. (see, Delamarre et al., JEM, (2006), vol 203: 2049-2055) found that less digestible forms of proteins that were less susceptible to digestion via lysosomal proteolysis were more immunogenic, and therefore, concluded that increasing protein stability improved the immune response. For example, Delamarre et al. showed that the immunogenicity of protein antigens can be improved by reducing susceptibility to proteolysis. Similarly, Mirano-Bascos et al. (see, Mirano-Bascos et al., J. of Virology, (2010), vol. 84: 3303-3311) mutated cysteine residues to prevent each of three disulfide bonds from forming, and determined that the CD4+ T-cell response was broadly reduced for all three variants. Mirano-Bascos et al. similarly concluded that global destabilization of the 3-D structure of a protein reduced antigenic presentation and led to a suppressed immune response. In other studies, such as for example, Nguyen et al., Vaccine, (2015), vol. 33: 2887-2896, outer domain disulfide bonds were deleted with the expectation that such deletions would improve antigenic presentation. Instead, a typical pattern of epitope dominance was observed and the authors concluded that it may not be possible to generate a substantially stronger immune response.

Other groups similarly conclude that protein stabilization is needed for an immune response. For example, Deressa et al., (see, Deressa et al., PLOS, (2014), vol. 9: 1-12) concluded that even minor modifications in the amino acid sequence of an antigen caused fundamental quantitative and qualitative changes in the immune response. Likewise, Porta et al. (see, Porta et al., PLOS, (2013), vol. 9: 1-8) reported that stability is needed for inducing an immune response. Other groups such as Thomas (see, Thomas et al., Human Vaccines & Immunotherapeutics, (2013), vol. 9:744-752) similarly concluded that increasing thermal stability for peptides elicited a better immune response.

In contrast, other groups such as So (see, So et al., Immunology, (2001), vol. 104: 259-268) report conflicting results. So et al. investigated the effect of crosslinking (e.g., removing cross-links and adding crosslinks) on the magnitude of in vivo T-cell responses and found that removing such crosslinks led to better antigen processing and an improved immune response. Similarly, Thai et al., J. Biol. Chem. (2004) vol. 279: 50257-50266) reported mutating surface accessible residues to decrease stability and increase conformational dynamics to increase the immunogenicity of the protein antigen. Thai et al. is also directed towards administration of single antigens.

There is no consensus on whether removing or adding crosslinks improves or inhibits antigen processing. Accordingly, it is unclear in the art as to whether increasing or decreasing protein stability would lead to an improved immune response comprising a broad, diverse array of antibodies.

Thus, there continues to be a need to develop new and improved methods of generating antibodies which can provide a different and broader repertoire of antibodies than previously obtained.

SUMMARY OF THE INVENTION

This summary is provided to introduce a selection of concepts in a simplified form that are further described below in the Detailed Description. This summary is not intended to identify key features or essential features of the claimed subject matter, nor is it intended to be used as an aid in determining the scope of the claimed subject.

As described herein, the invention is directed towards a method of triggering an immune response wherein said method comprises designing a mixture of peptidogenic proteins derived from a starting protein, wherein the peptidogenic proteins have altered conformational dynamics as compared to the starting protein and wherein the peptidogenic proteins are similar in conformation to the starting protein, introducing the peptidogenic proteins to an animal and generating an immune response. The peptidogenic proteins can be introduced into the animals directly (by, for instance, inoculation or immunization) or can be expressed in vivo by polynucleotides that have been introduced into the animal and which encode the peptidogenic proteins. Upon expression of these peptidogenic proteins, the immune response is triggered to generate antibodies both to the peptidogenic proteins and to the original starting protein.

In preferred embodiments, the conformational dynamics of a starting protein are preferably altered by altering the thermodynamic stability of the starting protein. In further preferred embodiments, the conformational dynamics of the starting protein are altered by replacing at least one non-surface amino acid residue of a starting protein to modify the peptidogenicity of the protein. Methods of altering conformational dynamics include, but are not limited to, examining a model of the 3-D structure (experimental or predicted based on homology) of the starting protein, identifying non-surface amino acid residues of the starting protein and replacing at least one non-surface amino acid residue in the starting protein to generate the peptidogenic protein, and/or by comparing the pattern of conserved amino acid homology across proteins orthologous to the starting protein from different species to provisionally identify non-surface amino acid residues of the starting protein (e.g., conserved hydrophobic residues) and replacing at least one non-surface amino acid residue in the starting protein to generate the peptidogenic protein. Other methods of predicting or empirically discovering non-surface (i.e., buried) amino acid residues can also be used. These methods also include using bioinformatics tools that predict secondary structures and/or identify disordered regions of a starting protein to identify at least one non-surface amino acid residue within these structures or ordered regions for replacement, and replacing the at least one non-surface amino acid residue to generate the peptidogenic protein (see, e.g., Cheng et al., Nucleic Acids Res (2005) 33:W72-6; Huang et al. (2014), DisMeta: A Meta Server for Construct Design and Optimization In Chen editor, *Structural Genomics*, Humana Press pp. 3-16). In some embodiments, substitutions in disordered regions are avoided. For example, disorder predictors could be used to identify ordered/structured regions in order to select ordered regions in which to make mutations (Id.). Still other methods include using biochemical experiments to identify core residues, such as through alanine scanning of hydrophobic residues or comparable methods, to identify at least one non-surface amino acid residue within these structures or regions for replacement, and replacing the at least one non-surface amino acid residue to generate the peptidogenic protein. Accordingly, in some embodiments, residues for replacement can be identified based on known structures, and in other embodiments, residues for replacement can be identified based on conserved hydrophobic residues.

In preferred embodiments a non-surface amino acid residue is replaced with a smaller amino acid residue. In further preferred embodiments, the smaller amino acid is an alanine or glycine. In other preferred embodiments, at least 2, 3, 4, 5, 6, 7, 8, 9 or 10 amino acids are replaced in the starting protein. In still other preferred embodiments, at least 10 amino acids, at least 20 amino acids, at least 30 amino acids, at least 40 amino acids, or at least 50 amino acids are replaced in the starting protein. In still other preferred embodiments, multiple amino acid replacements are distributed across a mixture of proteins. For example, in one embodiment, to mutate 10 different residues, the starting protein is mutated 10 different times to generate 10 different peptidogenic proteins, each with a single amino acid replacement. Each of the ten proteins are mixed together to inoculate the animal. In some cases, wild type starting protein, i.e. the protein with no mutations, is part of the mixture. In further preferred embodiments, at least one disulfide bond is eliminated in the starting protein, such as, for example, replacing the cysteines with alanines, serines, and/or glycines, etc. In further preferred embodiments, both cysteines involved in the formation of the at least one disulfide bond in the starting protein are replaced with alanines, serines, and/or glycines, or preferably with alanines or glycines, etc. In further preferred embodiments, the conformational dynamics of the starting protein is altered by replacing (a) at least one threonine with a valine, alanine, glycine or serine; or (b) at least one cysteine with alanine, valine, glycine, serine or threonine; or (c) at least one valine with alanine, glycine, leucine or isoleucine; or (d) at least one leucine with alanine, valine, glycine, or isoleucine; or (e) at least one isoleucine with alanine, valine, leucine, or glycine; or (f) at least one proline, methionine, phenylalanine, tyrosine, or tryptophan with alanine, valine, leucine, isoleucine, or glycine; or (g) at least one aspartic acid or asparagine with glycine, serine, threonine, alanine, valine, leucine, or isoleucine; or (h) at least one glutamic acid or glutamine with aspartic acid, asparagine, glycine, serine, threonine, alanine, valine, leucine, or isoleucine; or (i) at least one lysine with arginine, histidine, glycine, serine, threonine, alanine, valine, methionine, leucine, or isoleucine; or (j) at least one arginine with lysine, histidine, glycine, serine, threonine, alanine, valine, methionine, leucine, or isoleucine; or (k) at least one histidine with lysine, arginine, glycine, serine, threonine, alanine, valine, glutamine, asparagine, leucine, or isoleucine; or (l) at least one alanine with a glycine; or (m) at least one residue with a non-natural amino acid; and/or (n) any of the above combinations.

In still further preferred embodiments, the conformational dynamics of the starting protein is altered by replacing: (a) at least one tryptophan with tyrosine, phenylalanine, methionine, histidine, isoleucine, leucine, valine, alanine or glycine; or (b) at least one tyrosine with phenylalanine, methionine, histidine, isoleucine, leucine, valine, alanine or glycine; or (c) at least one phenylalanine with tyrosine, methionine, histidine, isoleucine, leucine, valine, alanine or glycine; or (d) at least one proline with methionine, leucine, isoleucine, valine, alanine, or glycine; or (e) at least one histidine with phenylalanine, tyrosine, methionine, isoleucine, leucine, valine, alanine, glycine, lysine, arginine, serine, threonine, asparagine, or glutamine; or (f) at least one methionine with isoleucine, leucine, valine, alanine or glycine; or (g) at least one isoleucine with leucine, valine, alanine or glycine; or (h) at least one leucine with isoleucine, valine, alanine or glycine; or (i) at least one valine with alanine, glycine, leucine, or isoleucine; or (j) at least one cysteine with alanine, valine, glycine, serine or threonine; or (k) at least one aspartic acid with glutamic acid, glutamine, asparagine, glycine, serine, threonine, alanine, valine, leucine, or isoleucine; or (l) at least one glutamic acid with aspartic acid, glutamine, asparagine, glycine, serine, threonine, alanine, valine, leucine, or isoleucine; or (m) at least one alanine with a glycine or proline; or (n) at least one serine with alanine or glycine; or (o) at least one glycine with alanine or proline; or (p) at least one lysine with arginine, histidine, glycine, serine, threonine, alanine, valine, methionine, leucine or isoleucine; or (q) at least one asparagine with glycine, alanine, serine, threonine, valine, leucine, isoleucine, glutamine, aspartic acid or glutamic acid; or (r) at least one glutamine with glycine, alanine, serine, threonine, valine, leucine, isoleucine, glutamine, aspartic acid, glutamic acid, or histidine; or (s) at least one arginine with lysine, histidine, glycine, serine, threonine, alanine valine, methionine, leucine, or isoleucine; or (t) at least one threonine with valine, alanine, glycine or serine; or (u) a hydrophobic residue with a smaller, similar hydrophobic residue; or (v) at least one residue with a non-natural amino acid; or (w) any of the above combinations. A combinatorial approach may be used to determine optimal substitutions to increase peptidogenicity.

In preferred embodiments, the change in conformational dynamics of the peptidogenic protein is measured by a change in melting temperature as compared to the starting protein and/or by measuring a change in Gibbs free energy of stabilization. Preferred methods of measuring Gibbs free energy include, but are not limited to, denaturant modulated equilibrium unfolding. Preferred denaturants are urea and/or guanidinium hydrochloride. Alternatively, changes in conformational dynamics can be assayed by detecting a change in a proteolytic sensitivity assay, such as, for example, by measuring digestion with cathepsins and/or other proteases and then analyzing the mixture by mass spectrometry (MS) or sodium dodecylsulfate polyacrylamide gel electrophoresis (SDS-PAGE).

In preferred embodiments, determining whether peptidogenic proteins have a similar conformation to the starting protein can be measured by a cross-reacting antibody that binds to a 3D conformational epitope (often a discontinuous epitope) on both the peptidogenic proteins and the starting protein. Methods for measuring antibody binding include, but are not limited to an immunoprecipitation assay, surface plasma resonance, isothermal titration calorimetry, oblique-incidence reflective difference (OI-RD), western blots, radioimmunoassays, ELISA (enzyme linked immunosorbent assay), "sandwich" immunoassays, gel diffusion precipitin reactions, immunodiffusion assays, agglutination assays, complement-fixation assays, immunoradiometric assays, fluorescent immunoassays, and/or protein A immunoassays.

In further preferred embodiments, a test for measuring cross-reactivity is by a binding assay. In further preferred embodiment, the antibody binding (including a cross-reacting antibody) to a peptidogenic protein has a dissociation constant (KD) of less than or equal to $10^{-9}$M, of less than or equal to $10^{-8}$M, less than or equal to $10^{-7}$M, and/or less than or equal to $10^{-6}$M.

In preferred embodiments, the starting protein is selected from an envelope glycoprotein of the human immunodeficiency virus (HIV), HIV gp120, HIV gp41, HIV gp160, an ebola antigen, a hepatitis C virus (HCV) antigen, a hepatitis B virus (HBV) antigen, a Middle Eastern Respiratory Syndrome coronavirus (MERS-CoV) antigen, a Zika virus antigen, an influenza virus antigen, a viral antigen, a malaria antigen, a bacterial antigen, a parasitic antigen, an allergen, a venom, a toxin, or a tumor-associated antigen, a transmembrane domain protein, an ion channel protein, and/or a G-protein coupled receptor.

In further preferred embodiments, the tumor associated antigen is selected from MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, GAGE-I, GAGE-2, GAGE-3, GAGE-4, GAGE-5, GAGE-6, GAGE-7, GAGE-8, BAGE-I, RAGE-1, LB33/MUM-1, PRAME, NAG, MAGE-Xp2 (MAGE-B2), MAGE-Xp3 (MAGE-B3), MAGE-Xp4 (MAGE-B4), MAGE-C1/CT7, MAGE-C2, NY-ESO-I, LAGE-I, SSX-I, SSX-2(HOM-MEL-40), SSX-3, SSX-4, SSX-5, SCP-I and XAGE, melanocyte differentiation antigens, p53, ras, CEA, MUC1, PMSA, PSA, tyrosinase, Melan-A, MART-1, gp100, gp75, alpha-actinin-4, Bcr-Abl fusion protein, Casp-8, beta-catenin, cdc27, cdk4, cdkn2a, coa-1, dek-can fusion protein, EF2, ETV6-AML1 fusion protein, LDLR-fucosyltransferaseAS fusion protein, HLA-A2, HLA-A11, hsp70-2, KIAAO205, Mart2, Mum-2, and 3, neo-PAP, myosin class I, OS-9, pml-RAR alpha fusion protein, PTPRK, K-ras, N-ras, Triosephosphate isomerase, GnTV, Herv-K-mel, NA-88, SP17, and TRP2-Int2, (MART-I), E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, alpha-fetoprotein, 13HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB\170K, NY-CO-1, RCAS1, SDCCAG16, TA-90 (Mac-2 binding protein\cyclophilin C-associated protein), TAAL6, TAG72, TLP, TPS, tyrosinase related proteins, TRP-1, TRP-2, and cytomegalovirus phosphoprotein 65 (pp65).

In another preferred embodiment, the peptidogenic protein is a protein that is part of a complex. For example, buried interfacial residues may be targeted for amino acid substitution, in e.g., proteins such as gp120, which is an envelope glycoprotein that forms a trimeric complex and is involved in HIV infection.

In a preferred embodiment, the mixture of polynucleotides encoding the peptidogenic proteins can be synthesized in vitro. The polynucleotides can also preferably comprise either DNA or mRNA. In preferred embodiments, the polynucleotides are in vitro transcribed (IVT) mRNA. The mRNA, including the IVT mRNA, can further comprise a poly(A) tail and/or a 5' cap. In another preferred embodiment, the mRNA can be translated in vitro to produce the peptidogenic proteins, including by use of coupled in vitro transcription/translation (IVTT).

The mixture of polynucleotides can comprise sequences encoding different peptidogenic proteins derived from either the same starting protein or from multiple starting proteins. In further preferred embodiments, the polynucleotides can be associated with a targeting component that targets the polynucleotides to a cell or organ. Alternatively, the polynucleotides can be unassociated with a targeting component. The polynucleotides encoding the peptidogenic proteins may also comprise a vector sequence.

Mixtures of these polynucleotides as well as animals (genetically modified or not genetically modified) expressing mixtures of polynucleotides are also contemplated. In preferred embodiments, the animal is a mammal and in further preferred embodiments, the mammal is a human, a mouse, a rabbit, a llama, or a cow.

In further preferred embodiments, the method induces an immune response. The immune response can occur in vivo, ex vivo and/or in vitro.

The polynucleotides encoding the peptidogenic proteins, including, but not limited to mixtures of polynucleotides, can be delivered to the animal by injection. In preferred embodiments, the injection occurs in the muscle of the animal. The delivery of the polynucleotides to the animal can be used for vaccination purposes, in research, or antibody development.

In further preferred embodiments, the antibody produced by the described methods is recovered and isolated. In preferred embodiments, the antibody is a fully human antibody, a chimeric antibody, a single-chain antibody, a camelid antibody, a humanized antibody, a polyclonal antibody or a monoclonal antibody. In preferred embodiments, the polyclonal antibody is further fractionated into single, isolated antibody species. In other preferred embodiments, the produced antibody is affinity matured, such as, for example, by phage display, yeast display, ribosome display or by a panning technique.

Also contemplated are polynucleotides that encode the antibodies produced by the methods described herein. These antibody encoding polynucleotides can also comprise a heterologous promoter and/or a vector sequence.

The peptidogenic proteins and/or the mixtures of polynucleotides encoding the peptidogenic proteins can also be used to vaccinate a mammal. In preferred embodiments, the vaccine is a cancer vaccine, an HIV vaccine, an HCV vaccine, an HBV vaccine, an influenza virus vaccine, a MERS-CoV vaccine, a Zika vaccine, a malaria vaccine, and/or an ebola virus vaccine comprising the peptidogenic proteins.

In further preferred embodiments, the invention is a method of processing a peptidogenic protein wherein the method comprises introducing to an antigen presenting cell a peptidogenic protein, wherein the peptidogenic protein has altered conformational dynamics as compared to a starting protein and wherein the peptidogenic protein has a similar conformation to the starting protein; and permitting the antigen presenting cell to process and display T cell epitopes derived from the peptidogenic protein.

In preferred embodiments, the antigen presenting cell is a dendritic cell, a B cell, a monocyte or a macrophage. In further preferred embodiments, the method is carried out in vitro or ex vivo. In further preferred embodiments, the antigen presenting cell is transfected with a polynucleotide encoding the peptidogenic protein(s) and/or placed in contact with the peptidogenic protein(s). In further preferred embodiments the antigen presenting cell undergoes phagocytosis or pinocytosis of the peptidogenic protein(s) or polynucleotide(s).

DETAILED DESCRIPTION OF THE INVENTION

Overview

We describe herein a novel method of generating an immune response, including enhancing the generation of antibodies by using a protein's "peptidogenic potential" via altering the conformational dynamics of a starting protein while maintaining that protein's 3-D conformation. These peptidogenic proteins can then be used to mount an immune response, used as a vaccine and/or to generate antibodies.

Thus, the invention is directed to a method of triggering an immune response wherein said method comprises designing a mixture of peptidogenic proteins derived from a starting protein, wherein the peptidogenic proteins have altered conformational dynamics as compared to the starting protein and wherein the peptidogenic proteins are similar in conformation to the starting protein, introducing the peptidogenic proteins to an animal and generating an immune response. The peptidogenic proteins can be introduced into the animals directly (by, for instance, inoculation or immunization) or can be expressed in vivo by polynucleotides that have been introduced into the animal and which encode the peptidogenic proteins. Upon expression of these peptidogenic proteins, the immune response is triggered to generate antibodies preferably to both the peptidogenic proteins and to the original starting protein.

Introduction of the polynucleotides can occur, for example, by either directly or after first performing ex vivo transfection of dendritic cells. Additionally, polynucleotides encoding the peptidogenic proteins can be generated and introduced into an animal. The peptidogenic proteins can then be produced in the animal to generate antibodies to the peptidogenic proteins. The methods described herein have the potential to profoundly impact the immunogenicity of proteins. Preferred biophysical and biochemical properties that are altered in the protein, include, but are not limited to conformational dynamics of a protein, the thermodynamic stability, MHC-II binding, and/or the protease susceptibility of the starting protein. The methods described herein can also be used to simultaneously produce cross-reacting antibodies to different peptidogenic proteins (either derived from the same or different starting proteins) which has the potential to profoundly change the way in which antibodies are currently being generated as the repertoire of antibodies that can be obtained by a single injection in an animal has the potential to streamline antibody development and vaccination efficacy.

We have recognized that the conformational dynamics of a protein are critical for the ability of the protein to mount an immune response. The propensity of an antigen to efficiently yield peptide fragments in vivo after immunization we have termed "peptidogenicity." Having the ability to alter the conformational dynamics of a starting protein to design a mixture of peptidogenic proteins which can be administered directly as a protein mixture or simultaneously expressed in an animal by a mixture of polynucleotides has the potential to generate a broad repertoire of antibodies with a single injection in a cost effective manner.

Thus, as disclosed herein, immunizing an animal with a mixture of peptidogenic proteins can robustly stimulate the immune system, generating stronger and/or better immune responses when placed in contact with an antigen presenting cell.

The immunization with a mixture (or combinatorial cocktail) of peptidogenic proteins is advantageous due to the complexity of the proteolytic attack on the protein antigen(s) that produces the peptides. For example, providing multiple different peptidogenic proteins having different amino acid sequences creates an environment where the "tuning mutation(s)" optimal for the production of a given peptide (T cell epitope) in the right time frame may be different from the mutations optimal for production of another peptide. For example, some cells, such as dendritic cells, mediate T-cell responses during an activation phase. If these cells are presented with antigens outside of this activation window (e.g., before or after activation) then a T-cell response may not be triggered. Thus, T-cells need to be presented with antigens at the appropriate time, which is governed by rates of protein degradation (e.g., proteolysis) in the antigen presenting cell, to trigger an immune response. By giving the antigens as mixtures, a multiplicity of different peptidogenic proteins can be endocytosed by a single cell, which theoretically maximizes the diversity of the peptides produced and displayed by that cell. Alternatively, by giving the antigens as mixtures, a multiplicity of different peptidogenic proteins can be endocytosed by multiple cells, which theoretically maximizes the diversity of the peptides produced and displayed by these cells. Additionally, the peptidogenic proteins having increased conformational dynamics may lead to an improved MHC class II binding which is expected to maximize the immune response. For example, for proteins that are relatively non-immunogenic and/or are not good vaccine components because of being too stable, and thus protease degradation is inhibited and subsequent peptide presentation is thereby impoverished resulting in attenuation of the immune response in adaptive immunity, such proteins could be altered as described herein to generate a mixture of peptidogenic proteins with altered conformational dynamics while maintaining a similar conformation as compared to the starting protein.

In preferred embodiments, a starting protein, also referred to as a test starting protein, can be systematically mutated to alter the thermodynamic stability of the starting protein, without significantly altering the three-dimensional structure of the corresponding folded protein, to generate peptidogenic proteins having increased peptidogenicity while displaying essentially the same 3D (conformational) surface epitopes as the starting protein.

Thus, increasing the immunogenicity of a starting protein by altering its conformational dynamics to produce numerous peptidogenic proteins which can then be simultaneously introduced into an animal will generate a robust immune response and has the potential to raise a broader repertoire of polyclonal antibodies which can be further fractionated (for example, by molecularly cloning via their respective encoding mRNAs) into single isolated species.

Definitions

Unless defined otherwise, all technical and scientific terms used herein have the same meaning as commonly understood by those of ordinary skill in the art, such as in the arts of peptide chemistry, cell culture and phage display, nucleic acid chemistry and biochemistry. Standard techniques are used for molecular biology, genetic and biochemical methods (see Sambrook et al., Molecular Cloning: A Laboratory Manual, 3rd ed., 2001, Cold Spring Harbor Laboratory Press, Cold Spring Harbor, N.Y.; Ausubel et al., Short Protocols in Molecular Biology (1999) $4^{th}$ ed., John Wiley & Sons, Inc.), which are incorporated herein by reference.

As used herein, "peptidogenicity" refers to the propensity of a protein to efficiently yield a robust set of diverse peptides which can be used to yield an immune response. Various assays exist for measuring peptidogenicity (see, for example, So et al., FIGS. 2c-d; Thai et al., FIG. 7c-f; and Delamarre et al., FIGS. 1b-c, 4b-c and 5a-b).

As used herein, a "peptidogenic protein" refers to a mutated protein that has been modified in its amino acid sequence to alter its conformational dynamics as compared to the starting protein sequence while maintaining a similar conformation to the starting protein.

As used herein, "non-surface residues" are residues that are not surface accessible with regard to the 3D structure of a protein, e.g., residues that are buried within the interior of the 3D structure of the native protein. In preferred embodiments, "non-surface" residues are defined by the method of Lee and Richards (see, e.g., Lee B et al., J. Mol. Biol. (1971); 55(3):379-IN4. doi:http://dx.doi.org/10.1016/0022-2836(71)90324-X.), where the relative solvent accessibility of the residue in the native protein is less than 50%, less than 40%, less than 30%, less than 25%, less than 20%, less than 10%, less than 5%, or 0%, or by the same method where the difference between the absolute solvent accessible surface area and the surface area in the fully extended Ala-X-Ala tripeptide (see, e.g., Gready J E et al., Protein Science. (1997); 6(5):983-98. doi: 10.1002/pro.5560060504.) is greater than 40 $Å^2$, greater than 50 $Å^2$, greater than 60 $Å^2$, greater than 70 $Å^2$, greater than 80 $Å^2$, greater than 90 $Å^2$, greater than 100 $Å^2$, greater than 110 $Å^2$, or greater than 120 $Å^2$. In further preferred embodiments, "non-surface" residues are defined as residues with a solvent accessible surface area of less than 10 $Å^2$, less than 5 $Å^2$, less than 2.5 $Å^2$, or less than 1 $Å^2$, as calculated by a structural analysis software package familiar to those skilled in the art (e.g. UCSF Chimera (see, e.g., Pettersen E F et al., J. Comput. Chem. (2004); 25(13):1605-12. Epub 2004 Jul. 21.), PyMol (see, e.g., Schrodinger, LLC. The PyMOL Molecular Graphics System, Version 1.8. 2015.), etc.

As used herein, a "starting protein" or "test starting protein" refers to the amino acid sequence of the "original" or "reference" protein that is used to derive the peptidogenic protein. In some examples, the "starting protein" can be a peptidogenic protein that has been further modified.

As used herein, an "immune response" refers to the humoral immune response and/or the cell-mediated immune response that is triggered by an antigen presenting cell after processing a protein. In the humoral immune response, B lymphocytes produce antibodies that react with native, unprocessed antigens. These antigen-antibody reactions may in some cases involve cell-surface antigens that activate the complement cascade, which causes the lysis of cells bearing those antigens. In the cell-mediated immune response, T lymphocytes mobilize macrophages in the presence of processed peptide antigens recognized as foreign. Activated T lymphocytes can also attack cells bearing foreign antigens directly.

As used herein, an "antigen presenting cell" refers to a cell that can break down ("process") a protein into peptides and present the peptides, in conjunction with the MHC allele, preferably major HLA complex class I or class II molecules, on the cell surface. Examples of antigen presenting cells include, but are not limited to dendritic cells, macrophages, B cells, and monocytes.

As used herein, "conformational dynamics" is defined as the phenomena related conformational changes and flexibility of a protein structure in the spatial arrangement of atoms or groups of atoms with respect to each other in a protein molecule. Conformational dynamics include "breathing" motions and involve the vibration, bending, twisting, rotation, and other allowed modes of movement of the atoms joined by the covalent bonds in the protein molecule, governed by intrinsic restoring forces but modulated by non-covalent interactions such as hydrogen bonds, van der Waals forces, and electrostatic interactions. These motions can subtly change the geometry of the protein on a subpicosecond timescale and can result in a vast diversity of conformational states on a time-scale of microseconds to milliseconds. Conformational molecular dynamics of proteins is often studied using computer simulations. See, for example, Shaw et al (2010) *Science* 330, 341. Also as used herein, the conformational dynamics of a starting protein can be altered by chemical modifications, amino acid substitutions, and other mutations such as deletions, insertion, truncations, or any combination thereof, etc. By stating that the conformational dynamics of the peptidogenic protein is varied with regard to the wild type protein, it is meant that the one or more amino acid substitutions of the peptidogenic protein results in altered conformational dynamics as compared to the wild type protein.

As used herein, "thermodynamic stability" is defined in terms of a chemical system where no or minimal energy is either released or consumed, and thus no or minimal changes in thermal energy are present and the system is in its lowest energy state under a given set of experimental conditions. Also as used herein, a "decrease in thermodynamic stability" or "decreased thermodynamic stability" means that the parameters pertaining to thermodynamic stability of the peptidogenic protein are attenuated as compared to those of the starting protein measured under the same conditions, and this decrease can be achieved in the peptidogenic protein by, but not limited to, alterations to the molecular structure of the starting protein via chemical modifications, amino acid substitutions, and other genetic mutations. Methods of measuring a decrease in thermodynamic stability are known in the art and described herein, and include protocols incorporating the measurement of parameters such as melting temperature and urea- or guanidinium hydrochloride-induced equilibrium unfolding (denaturation). These parameters are typically arrived at by monitoring the protein unfolding reaction as a function temperature or denaturant concentration under conditions of equilibrium or quasi-equilibrium. Methods for monitoring the unfolding reaction by measuring the concentration of the unfolded state relative to that of the folded state include, but are not limited to, UV absorption, fluorescence, and circular dichroism. This approach allows the calculation of a stabilization free energy (Gibbs free energy) of the mutant protein relative to the stabilization free energy of the starting protein measured under the same conditions. The difference in free energy is typically denoted by $\Delta\Delta G=\Delta G_{mutant}-\Delta G_{standard(e.g.,\ wt)}$, where $\Delta G_{mutant}$ and $\Delta G_{standard(e.g.,\ wt)}$ are the stabilization free energies of the mutant and "standard" (e.g., wt or wild type) proteins, respectively, and MG is the difference. $\Delta\Delta G>0$ indicates a mutant protein that is less stable than the standard protein, and $\Delta\Delta G<0$ indicates a mutant protein that is more stable than the standard protein.

As used herein, a peptidogenic protein has a "similar conformation" to a starting protein if the 3-D structure is sufficiently maintained after mutating non-surface residues of the protein (and, consequently, potentially modifying its overall conformational dynamics) to allow for an antibody to cross react with both the peptidogenic protein and the starting protein. "Cross-reactivity" can be measured by a binding assay as described herein or as is well known in the art and is measured as a "binding affinity" which is based on dissociation constants ($K_D$), off rates ($k_{off}$), and/or on rates ($k_{on}$). The peptidogenic protein does not need to have an identical 3-D structure as the starting protein; just a sufficiently similar structure displaying similar 3D conformational epitopes (including discontinuous epitopes), that will allow for an antibody to recognize both proteins, even though the binding affinities may be nonidentical.

In the present invention, the term "antibody," refers to immunoglobulin molecules and immunologically active portions of immunoglobulin molecules, i.e., molecules that contain an antigen binding site that immunospecifically binds the peptidogenic protein and/or the starting protein. As such, the term antibody encompasses not only whole antibody molecules, but also antibody fragments as well as variants (including derivatives such as fusion proteins) of antibodies and antibody fragments. Examples of molecules which are described by the term "antibody" in this application include, but are not limited to: single chain Fvs (scFvs), Fab fragments, Fab' fragments, $F(ab')_2$, disulfide linked Fvs (sdFvs), Fvs, and fragments comprising or alternatively consisting of, either a VL or a VH domain. The term "single chain Fv" or "scFv" as used herein refers to a polypeptide comprising a VL domain of an antibody linked to a VH domain of an antibody. See Carter (2006) Nature Rev. Immunol. 6:243.

Additionally, antibodies of the invention include, but are not limited to, monoclonal, multi-specific, bi-specific, human, humanized, mouse, or chimeric antibodies, single chain antibodies, camelid antibodies, Fab fragments, F(ab') fragments, anti-idiotypic (anti-Id) antibodies (including, e.g., anti-Id antibodies to antibodies of the invention), domain antibodies and epitope-binding fragments of any of the above. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule.

Most preferably, the antibodies are human antibodies. As used herein, "human" antibodies include antibodies having the amino acid sequence of a human immunoglobulin and include antibodies isolated from human immunoglobulin libraries and xenomice or other organisms that have been genetically engineered to produce human antibodies. For a detailed discussion of a few of the technologies for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598; and Lonberg and Huszar, Int. Rev. Immunol. 13:65-93 (1995).

Human antibodies or "humanized" chimeric monoclonal antibodies can be produced using techniques described herein or otherwise known in the art. For example, methods for producing chimeric antibodies are known in the art. See, for review the following references: Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).

The antibodies of the present invention may be monovalent, bivalent, trivalent or multivalent. For example, monovalent scFvs can be multimerized either chemically or by association with another protein or substance. A scFv that is fused to a hexahistidine tag or a Flag tag can be multimerized using Ni-NTA agarose (Qiagen) or using anti-Flag antibodies (Stratagene, Inc.).

The antibodies of the present invention may be monospecific, bispecific, trispecific or of greater multispecificity. Multispecific antibodies may be specific for the peptidogenic protein, for more than one peptidogenic protein, for the starting protein, or they may be specific for both the peptidogenic protein and/or the starting protein and a heterologous epitope, such as a heterologous polypeptide or solid support material. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et. al., J. Immunol. 148:1547-1553 (1992).

The term "fragment" as used herein refers to a polypeptide comprising an amino acid sequence of at least 5 amino acid residues, at least 10 amino acid residues, at least 15 amino acid residues, at least 20 amino acid residues, at least 25 amino acid residues, at least 30 amino acid residues, at least 35 amino acid residues, at least 40 amino acid residues, at least 45 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, at least 150 amino acid residues, at least 175 amino acid residues, at least 200 amino acid residues, or at least 250 amino acid residues, of the amino acid sequence of the peptidogenic protein or starting protein. In some embodiments, a fragment may also refer to a polypeptide comprising an amino acid sequence of about 8 to 24 amino acid residues, or about 5 to 30 amino acid residues.

The term "fusion protein" as used herein refers to a polypeptide that comprises, or alternatively consists of, an amino acid sequence of the peptidogenic protein, the starting protein, and/or the antibody raised against the peptidogenic protein and an amino acid sequence of one or more heterologous peptides and/or polypeptides. For vaccine applications, the heterologous polypeptide sequence fused to the peptidogenic protein is preferably from a viral protein.

The term "host cell" as used herein refers to the particular subject cell transfected with a nucleic acid molecule and the progeny or potential progeny of such a cell. Progeny may not be identical to the parent cell transfected with the nucleic acid molecule due to mutations or environmental influences or developmental steps that may occur in succeeding generations or integration of the nucleic acid molecule into the host cell genome.

A "conservative amino acid substitution" is one in which the amino acid residue is replaced with an amino acid residue having a side chain with a similar chemical nature (e.g., size, charge, steric features [e.g., beta-branched vs. non-beta-branched], polarity [hydrophilic vs. hydrophobic], aromatic vs. non-aromatic, etc.). Whether or not a particular substitution is deemed "conservative" may also depend on the structural context in the folded protein in which a substitution occurs. Amino acid side chains may be chemically similar in one respect but chemically dissimilar in another, and the context may determine which of these properties dominates in terms of how "conservative" (i.e., least disruptive) that particular substitution is. Families of amino acid residues having chemically similar side chains have been defined in the art. These families include amino acids with basic side chains (e.g., lysine, arginine), acidic side chains (e.g., aspartic acid, glutamic acid), uncharged polar side chains (e.g., asparagine, glutamine, serine, threonine), nonpolar side chains (e.g., glycine, alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Some side chains have a hybrid character that is pH-dependent in physiologically relevant pH ranges. For example, histidine (pKa~6) becomes more positively-charged (basic) below pH 6, and polar but substantially uncharged at pH 7.5 and above. Cysteine (pKa~8.5) is substantially uncharged (and not particularly polar) below pH 8, but negatively charged (and acidic) at pH 9. The tyrosine phenolic side chain is also partially ionized and negatively charged at higher pH. Moreover, the local electrostatic environment (context) of the rest of the protein can shift these effective pH values substantially. Moreover, an acidic protein cysteine thiolate side chain can react, via thiol-disulfide exchange involving an intermediary disulfide-containing compound such as oxidized glutathione, with another protein cysteine thiol to form an intramolecular disulfide bond; such bonds are highly hydrophobic (non-polar). Additionally, both naturally occurring and/or non-naturally occurring amino acids can be used in the peptidogenic proteins.

Mutations can be introduced in a site-directed fashion or randomly along all or part of the coding sequence. Libraries of mutants can be designed to introduce a single amino acid substitution, two amino acid substitutions, three amino acid substitutions, four amino acid substitutions, and so forth, up to nineteen amino acid substitutions at a given residue site. In still other embodiments, libraries of mutants can be designed to introduce more than nineteen amino acid substitutions (including natural and non-natural amino acids) at a given residue site. In addition, libraries can be combinatorially designed to simultaneously produce multiple mutations at two sites, three sites, four sites, and so on. Following mutagenesis, the encoded protein may routinely be expressed and the conformational dynamics of the encoded protein and/or peptidogenicity can be determined using techniques described herein or by routinely modifying techniques known in the art. The resultant mutant proteins can be screened and evaluated for altered thermodynamic stability or for peptidogenicity or for similar conformation to the starting protein. Alternatively, the expressed protein "output" from the designed library can be used to immunize an animal without prior screening for protein properties.

As used herein, the "patient" or "subject suitable for treatment" may be a mammal, such as a rodent (e.g. a guinea pig, a hamster, a rat, a mouse), murine (e.g. a mouse), canine (e.g. a dog), feline (e.g. a cat), equine (e.g. a horse), a primate, simian (e.g. a monkey or ape), a monkey (e.g. marmoset, baboon, rhesus macaque), an ape (e.g. gorilla, chimpanzee, orangutan, gibbon), or a human. In other embodiments, non-human mammals, especially mammals that are conventionally used as models for demonstrating therapeutic efficacy in humans (e.g. murine, primate, porcine, canine, camels, llamas, or rabbits) may be employed.

Other aspects and embodiments of the invention provide the aspects and embodiments described herein with the term "comprising" replaced by the term "consisting of" and the aspects and embodiments described above with the term "comprising" replaced by the term "consisting essentially of".

As used herein, "and/or" is to be taken as specific disclosure of each of the two or more specified features or components with or without the others. For example "A, B and/or C" is to be taken as specific disclosure of each (i) A, (ii) B, (iii) C, (iv) A and B, (v) A and C, (vi) B and C and (vii) A and B and C, just as if each is set out individually.

Methods of Altering the Conformational Dynamics of a Protein

A peptidogenic protein can be generated using standard molecular biology mutagenesis techniques well known in the art. For example, the peptidogenic protein can be generated by random mutagenesis as is well known in the art, such as, for example, by error-prone PCR, random nucleotide insertion or deletion or other methods prior to recombination.

To generate the peptidogenic protein, protein engineering may be employed. Recombinant DNA technology known to those skilled in the art can be used to create peptidogenic proteins including single or multiple amino acid substitutions, deletions, insertions, or fusion proteins. Such peptidogenic proteins may be screened for those that have altered conformational dynamics while maintaining a similar conformation to the starting protein as described herein.

For example, to increase the conformational dynamics of the peptidogenic protein, the following table, Table 1, shows the average change in Gibbs free energy for exemplary amino acid substitutions in a range of proteins, derived from Tables 1 and 2 of Loladze et al., J. Mol. Biol. 320, 343-357 (2002) [note: this paper uses a non-standard convention when expressing Gibbs free energies between mutant and wild type proteins, namely using negative values to indicate destabilization ($\Delta\Delta G=\Delta G(\text{mutant})-\Delta G(\text{WT})$); the standard convention is that positive changes indicate destabilization ($\Delta\Delta G=\Delta G(\text{WT})-\Delta G(\text{mutant})$, see paragraph 0040 above)]. For example, Val and Leu (and the other larger non-polar amino acid residues) can be substituted with smaller ones such as Ala, Thr, Asn, and/or Gly. In addition, the buried site of Glu in the native protein structure, can be substituted with Leu, Val, Asn, Thr, Ser, Ala, and/or Gly. The types of single site amino acid substitutions shown generally have little impact on the overall conformation of the starting protein.

TABLE 1

| Amino Acid Substitution (multiple positions in various proteins) | Average Gibbs Free Energy difference between mutant and wild type at core residues within a protein ΔΔG (kJ/mol) |
|---|---|
| Val -> Ala | −12.1(±3.3) |
| Val -> Thr | −11.3(±3.7) |
| Val -> Asn | −21.5(±1.0) |
| Leu -> Ala | −14.2(±4.2) |

Another illustrative paper describing destabilizing mutations in the core of a protein that increase conformational dynamics is Kim et al (1993) Protein Sci. 2:588-596. In this work, the authors show that the mutations Phe22→Ala (2.1 kcal/mol), Tyr23→Ala (7.0 kcal/mol), Tyr35→Gly (5.7 kcal/mol), Asn43→Gly (6.0 kcal/mol), and Phe45→Ala (7.2 kcal/mol) destabilize bovine pancreatic trypsin inhibitor (BPTI) at pH 3.5 by the respective amounts shown in parentheses, without seriously disrupting the overall 3D structure of BPTI.

In addition, genetic deletions, insertions, inversions, repeats, and type substitutions selected according to general rules known in the art should have little effect on activity. For example, guidance concerning how to make phenotypically silent amino acid substitutions is provided in Bowie, J. U. et at., "Deciphering the Message in Protein Sequences: Tolerance to Amino Acid Substitutions," Science 247:1306-1310 (1990), wherein the authors indicate that there are two main approaches for studying the tolerance of an amino acid sequence to change. The first method relies on the process of evolution, in which mutations are either accepted or rejected by natural selection. The second approach uses genetic engineering to introduce amino acid changes at specific positions of a cloned gene and selections or screens to identify sequences that maintain functionality.

As the authors state, these studies have revealed that proteins are surprisingly tolerant of amino acid substitutions. The authors further indicate which amino acid changes are likely to be permissive at a certain position of the protein. For example, most buried amino acid residues require non-polar side chains, whereas few features of surface side chains are generally conserved. Other such phenotypically silent substitutions are described in Bowie, J. U. et al., supra, and the references cited therein. Typically seen as conservative substitutions are the replacements, one for another, among the aliphatic amino acids Ala, Val, Leu and Ile; interchange of the hydroxyl-bearing residues, Ser and Thr; exchange of the acidic residues, Asp and Glu; substitution between the sidechain amide-bearing residues, Asn and Gln; exchange of the basic amino acids, Lys and Arg; and replacements among the aromatic residues, Phe and Tyr.

In preferred embodiments, the conformational dynamics of the starting protein is altered by replacing: (a) at least one threonine with a valine, alanine, glycine or serine; or (b) at least one cysteine with alanine, valine, glycine, serine or threonine; or (c) at least one valine with alanine, glycine, leucine or isoleucine; or (d) at least one leucine with alanine, valine, glycine, or isoleucine; or (e) at least one isoleucine with alanine, valine, isoleucine, or glycine; or (f) at least one proline, methionine, phenylalanine, tyrosine, or tryptophan with alanine, valine, leucine, isoleucine, or glycine; or (g) at least one aspartic acid with glutamic acid, glutamine, asparagine, glycine, serine, threonine, alanine, valine, leucine, isoleucine; or (h) at least one glutamic acid with aspartic acid, glutamine, asparagine, glycine, serine, threonine, alanine, valine, leucine, or isoleucine; or (i) at least one lysine with arginine, histidine, glycine, serine, threonine, alanine, valine, leucine, or isoleucine; or (j) at least one arginine with lysine, histidine, glycine, serine, threonine, alanine, valine, leucine, or isoleucine; or (k) at least one histidine with lysine, arginine, glycine, serine, threonine, alanine, valine, leucine, isoleucine, or glutamine; or (l) at least one alanine with a glycine or proline; or (m) at least one asparagine with a glycine, alanine, serine, threonine, glutamine, aspartic acid, or glutamic acid; or (n) at least one glutamine with a glycine, alanine, serine, threonine, asparagine, aspartic acid, glutamic acid, or histidine; or (o) at least one glycine with an alanine or proline; or (p) at least one residue with a non-natural amino acid; or (q) any combination of (a)-(p). In still further preferred embodiments, the conformational dynamics of the starting protein is altered by replacing: (a) at least one tryptophan with tyrosine, phenylalanine, methionine, histidine, isoleucine, leucine, valine, alanine or glycine; or (b) at least one tyrosine with phenylalanine, methionine, histidine, isoleucine, leucine, valine, alanine or glycine; or (c) at least one phenylalanine with tyrosine, methionine, histidine, isoleucine, leucine, valine, alanine or glycine; or (d) at least one proline with methionine, leucine, isoleucine, valine, alanine, or glycine; or (e) at least one histidine with phenylalanine, tyrosine, methionine, isoleucine, leucine, valine, alanine, glycine, lysine, arginine, serine, threonine, asparagine, or glutamine; or (f) at least one methionine with isoleucine, leucine, valine, alanine or glycine; or (g) at least one isoleucine with leucine, valine, alanine or glycine; or (h) at least one leucine with isoleucine, valine, alanine or glycine; or (i) at least one valine with alanine, glycine, leucine, or isoleucine; or (j) at least one cysteine with alanine, valine, glycine, serine or threonine; or (k) at least one aspartic acid with glutamic acid, glutamine, asparagine, glycine, serine, threonine, alanine, valine, leucine, or isoleucine; or (l) at least one glutamic acid with aspartic acid, glutamine, asparagine, glycine, serine, threonine, alanine, valine, leucine, or isoleucine; or (m) at least one alanine with a glycine or proline; or (n) at least one serine with alanine or glycine; or (o) at least one glycine with alanine or proline; or (p) at least one lysine with arginine, histidine, glycine, serine, threonine, alanine, valine, methionine, leucine or isoleucine; or (q) at least one asparagine with glycine, alanine, serine, threonine, valine, leucine, isoleucine, glutamine, aspartic acid or glutamic acid; or (r) at least one glutamine with glycine, alanine, serine, threonine, valine, leucine, isoleucine, glutamine, aspartic acid, glutamic acid, or histidine; or (s) at least one arginine with lysine, histidine, glycine, serine, threonine, alanine valine, methionine, leucine, or isoleucine; or (t) at least one threonine with valine, alanine, glycine or serine; or (u) a hydrophobic residue with a smaller, similar hydrophobic residue; or (v) at least one residue with a non-natural amino acid; or (w) any of the above combinations. In some embodiments, hydrophobic resides are targeted for replacement.

Amino acids in the starting protein that are essential for function, conformation, and/or structure and positioned on the protein surface vs. internal can be identified by methods known in the art, such as site-directed mutagenesis or alanine-scanning mutagenesis (Cunningham and Wells, Science 244: 1081-1085 (1989)). The latter procedure introduces single alanine mutations at every residue in the molecule. The resulting mutant molecules are then tested for those having altered conformational dynamics while maintaining a similar conformation to the starting protein.

In an additional embodiment, the amino acid sequence of the starting protein has one or more amino acids (for example, 1, 2, 3, 4, 5, 6, 7, 8, 9, 10, 15, 20, 30 or 50 amino acids) replaced with the substituted amino acids as described above (either conservative or non-conservative substitutions) to produce the peptidogenic protein. For example, substitutions in positions not involving a starting protein's activity and/or internal to the protein structure can be readily made. Sites that are critical for ligand-receptor binding can also be determined by structural analysis such as crystallization, nuclear magnetic resonance or photoaffinity labeling (Smith et al., J. Mol. Biol. 224:899-904 (1992); and de Vos et al. Science 255:306-312 (1992)).

Recombinant DNA technology that employs combinatorial mutagenesis and synthetic DNA synthesis approaches known to those skilled in the art can also be used to create a peptidogenic protein including single or multiple amino acid substitutions, deletions, additions or fusion proteins. Such modified polypeptides may be then screened for altered conformational dynamics while maintaining a similar conformation as the starting protein.

Thus, a peptidogenic protein can be made where one or more amino acid residues are deleted, added, or substituted to generate peptidogenic proteins having altered conformation dynamics. For example, residues in the hydrophobic "core" of the protein can be substituted with non-polar residues having smaller side chains (supra) in order to create cavities in the core and disrupt the packing, and cysteine residues can be deleted or substituted with other amino acid residues in order to eliminate disulfide bridges (which are often found in protein cores). In some embodiments, at least one disulfide bond is eliminated in the starting protein, such as, for example, replacing the cysteines with alanines, serines, and/or glycines, etc. In further preferred embodiments, both cysteines involved in the formation of the at least one disulfide bond are replaced with alanines, serines, and/or glycines, or preferably with alanines or glycines, etc.

The peptidogenic proteins are preferably provided in an isolated form, and preferably are substantially purified. Additionally, the peptidogenic proteins would display a stable 3D conformational epitope for B-cell activation while synthesized peptides (such as by chemical synthesis) can be co-administered, which could optimize the epitopes for MHC-II presentation. Alternatively, the peptidogenic proteins and peptides can be expressed by a mixture of polynucleotides. In still other embodiments, peptidogenic proteins can be combined with a wild type starting protein and synthetic peptide(s) to elicit an immune response.

In some embodiments, the rate of polypeptide degradation may be adjusted in order to produce an optimal mix of peptides, and in the right time frame, to allow maximal diversity of the displayed peptides on the antigen presenting cells.

Immunization with mixtures (such as combinatorial cocktails) of antigens is advantageous due to the complexity of the proteolytic attack on the protein antigen(s) that produce the peptides for display. Thus, the "tuning mutation(s)" optimal for the production of a given peptide (T cell epitope) in the right time frame may be different from the mutations optimal for production of another peptide. By giving the antigens as mixtures, a multiplicity of different mutant proteins may be endocytosed by a single cell or multiple cells, which maximizes the diversity of the peptides produced and displayed by that cell.

Combinatorial immunization, in which subjects are immunized with two or more distinct antigens that have the same overall surface features (i.e. cross-reacting B-cell epitopes) but with different conformational dynamics, enriches the diversity of T-cell epitopes. This combinatorial approach, which includes hundreds or even thousands of different immunogens in a single inoculation (both protein-based and nucleotide-based) may vastly increase the B-cell epitope repertoire, since every molecule in the mix can contribute to one or more unique T-cell epitopes while maintaining a wild type-like conformation. In some aspects, because the wild-type configuration is maintained, the B-cell epitope repertoire is biased towards the most stable (and presumably wild type-like) molecules in the ensemble.

Peptidogenic Protein has a Similar Conformation as a Starting Protein

The operational test of whether the peptidogenic protein has a "similar conformation to the starting protein" is whether or not a cross-reacting antibody, especially an antibody that recognizes a conformational (3D) epitope, specifically binds to both the peptidogenic protein and the starting protein. In the present invention "cross-reactivity" or a "cross-reacting antibody" is defined in terms of "binding affinity" which can be measured based on dissociation constant ($K_D$), off rate ($k_{off}$), and/or on rate ($k_{on}$).

For example, a cross-reacting antibody binds to both the peptidogenic protein and the starting protein at a dissociation constant or $K_D$ less than or equal to $5\times10^{-6}$ M, $10^{-6}$ M, $5\times10^{-7}$ M, $10^{-7}$ M, $5\times10^{-8}$ M, or $10^{-8}$ M. Even more preferably, a cross-reacting antibody binds to both the peptidogenic protein and the starting protein at a dissociation constant $K_D$ less than or equal to $5\times10^{-9}$M, $10^{-9}$M, $5\times10^{-10}$M, $10^{-10}$ M, $5\times10^{-11}$M, $10^{-11}$ M, $5\times10^{-12}$M, $10^{-12}$M, $5\times10^{-13}$ M, $10^{-13}$ M, $5\times10^{-14}$M, or $10^{-14}$ M. The invention encompasses a dissociation constant or $K_D$ for the peptidogenic protein and/or the starting protein that is within any one of the ranges that are between each of the individual recited values. Additionally, it is specifically contemplated that the $K_D$ for the antibody that binds to a peptidogenic protein may not be identical to its $K_D$ with respect to the starting protein, and in preferred embodiments, the $K_D$ for the antibody that hinds to the peptidogenic protein is less than the $K_D$ for its binding to the starting protein. It is understood that, operationally, $K_D$ in this case refers to the functional affinity of the antibody for the antigen. Functional or "apparent" affinity may be enhanced in multivalent antibodies that contain multiple interacting sites (e.g., Fab arms) that can bind to the antigen ("avidity effect").

Additionally, a cross-reacting antibody binds to both the peptidogenic protein and the starting protein with an off rate ($k_{off}$) of less than or equal to $5\times10^{-2}$ $sec^{-1}$, $10^{-2}$ $sec^{-1}$, $5\times10^{-3}$ $sec^{-1}$ or $10^{-3}$ $sec^{-1}$. More preferably, a cross-reacting antibody binds to both the peptidogenic protein and the starting protein at off rate ($k_{off}$) of less than or equal to $5\times10^{-4}$ $sec^{-1}$, $10^{-1}$ $sec^{-1}$, $5\times10^{-5}$ $sec^{-1}$, or $10^{-5}$ $sec^{-1}$, $5\times10^{-1}$ $sec^{-1}$, $10^{-6}$ $sec^{-1}$, $5\times10^{-7}$ $sec^{-1}$ or $10^{-7}$ $sec^{-1}$. The invention encompasses an off rate ($k_{off}$) for the peptidogenic protein and/or the starting protein that is within any one of the ranges that are between each of the individual recited values. Additionally, it is specifically contemplated that the $k_{off}$ of the antibody for the peptiflogenic protein may not be identical to the $k_{off}$ of the starting protein, and in preferred embodiments, the ($k_{off}$) for the binding of the antibody to the peptidogenic protein is greater than the ($k_{off}$) for the binding of the antibody to the starting protein.

Assays to test for the cross-reactivity are described herein or are known in the art. For example, binding assays may be performed in solution (e.g., Houghten, Bio/Techniques 13:412-421(1992)), on beads (e.g., Lam, Nature 354:82-84 (1991)), on chips (e.g., Fodor, Nature 364:555-556 (1993)), on bacteria (e.g., U.S. Pat. No. 5,223,409), on spores (e.g., U.S. Pat. Nos. 5,571,698; 5,403,484; and 5,223,409), on plasmids (e.g., Cull et al., Proc. Natl. Acad. Sci. USA 89:1865-1869 (1992)) or on phage (e.g., Scott and Smith, Science 249:386-390 (1990); Devlin, Science 249:404-406 (1990); Cwirla et al., Proc. Natl. Acad. Sci. USA 87:6378-6382 (1990); and Felici, J. Mol. Biol. 222:301-310 (1991)). Examples of such assays are described further below in the Examples.

Use of the Peptidogenic Protein to Generate Antibodies

The peptidogenic protein can be used to generate antibodies by methods well known by the skilled artisan, such as, for example, methods described in the art. See, for instance, Sutcliffe et al., supra; Wilson et al., supra; Chow et al., Proc. Natl. Acad. Sci. USA 82:910-914 (1985); and Bittle et al., J. Gen. Virol. 66:2347-2354 (1985). If in vivo immunization is used, animals may be immunized with a peptidogenic protein and/or a polynucleotide encoding the peptidogenic protein described herein.

Animals such as rabbits, rats, mice, llamas, camels, and/or cows can be immunized with the peptidogenic protein and/or a polynucleotide encoding the peptidogenic protein. For instance, intraperitoneal and/or intradermal injection of emulsions containing about 100 micrograms of a peptidogenic protein or carrier protein and Freund's adjuvant or any other adjuvant known for stimulating an immune response may be used. Several booster injections may be needed, for instance, at intervals of about two weeks, to provide a useful titer of anti-peptidogenic protein antibody which can be detected, for example, by ELISA assay using free peptidogenic protein adsorbed, directly or indirectly (e.g., via a biotinylated AviTag), to a solid surface. The titer of anti-peptidogenic protein antibodies in serum from an immunized animal may be increased by selection of anti-peptidogenic protein antibodies, for instance, by adsorption to the peptidogenic protein on a solid support and elution of the selected antibodies according to methods well known in the art. Such selections could also be done using the starting protein.

Additionally, antibodies generated by the disclosed methods can be affinity matured using display technology, such as for example, phage display, yeast display or ribosome display. In one example, single chain antibody molecules ("scFvs") displayed on the surface of phage particles are screened to identify those scFvs that immunospecifically bind to the peptidogenic protein and/or the starting protein. The present invention encompasses both scFvs and portions thereof that are identified to immunospecifically bind to the peptidogenic protein and/or the starting protein. Such scFvs can routinely be "converted" to immunoglobulin molecules by inserting, for example, the nucleotide sequences encoding the VH and/or VL domains of the scFv into an expression vector containing the constant domain sequences and engineered to direct the expression of the immunoglobulin molecule.

Recombinant expression of an antibody raised using the peptidogenic protein and/or a polynucleotide encoding the peptidogenic protein of the invention (including scFvs and other molecules comprising, or alternatively consisting of, antibody fragments or variants thereof (e.g., a heavy or light chain of an antibody of the invention or a portion thereof or a single chain antibody of the invention)), requires construction of an expression vector(s) containing a polynucleotide that encodes the antibody or fragment or variant thereof. Once a polynucleotide encoding an antibody molecule (e.g., a whole antibody, a heavy or light chain of an antibody, or variant or portion thereof (preferably, but not necessarily, containing the heavy or light chain variable domain)), of the invention has been obtained, the vector(s) for the production of the antibody molecule may be produced by recombinant DNA technology using techniques well known in the art. Thus, methods for preparing an antibody by expressing a polynucleotide containing an antibody encoding nucleotide sequence are described herein. Methods which are well known to those skilled in the art can be used to construct expression vectors containing antibody coding sequences (as well as the coding sequences for the peptidogenic protein) and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding either the peptidogenic protein or an antibody raised to the peptidogenic protein (e.g., a whole antibody, a heavy or light chain of an antibody, a heavy or light chain variable domain of an antibody, or a portion thereof, or a heavy or light chain CDR, a single chain Fv, or fragments or variants thereof), operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy chain, the entire light chain, or both the entire heavy and light chains.

The expression vector(s) can be transferred to a host cell by conventional techniques and the transfected cells are then cultured by conventional techniques to produce either the peptidogenic protein or the antibody that has been raised against a peptidogenic protein. Thus, the invention includes host cells containing polynucleotide(s) encoding the peptidogenic protein or an antibody raised against the peptidogenic protein (e.g., whole antibody, a heavy or light chain thereof, or portion thereof, or a single chain antibody of the invention, or a fragment or variant thereof), operably linked to a heterologous promoter. In preferred embodiments, for the expression of entire antibody molecules, vectors encoding both the heavy and light chains may be co-expressed in the host cell for expression of the entire immunoglobulin molecule, as detailed below.

A variety of host-expression vector systems may be utilized to express the peptidogenic protein or the antibody raised to the peptidogenic protein. Such host-expression systems represent vehicles by which the coding sequences of interest may be produced and subsequently purified, but also represent cells which may, when transformed or transfected, with the appropriate nucleotide coding sequences, express the peptidogenic protein or the antibody raised to the peptidogenic protein. These include, but are not limited to, microorganisms such as bacteria (e.g., *E. coli, B. subtilis*) transformed with recombinant bacteriophage DNA, plasmid DNA or cosmid DNA expression vectors containing sequences; yeast (e.g., *Saccharomyces, Pichia*) transformed with recombinant yeast expression vectors containing coding sequences; insect cell systems infected with recombinant virus expression vectors (e.g., baculovirus) containing coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, are used for the expression of either the peptidogenic protein or a recombinant antibody molecule. For example, mammalian cells such as Chinese hamster ovary cells (CHO), in conjunction with a vector such as the major intermediate early gene promoter element from human cytomegalovirus is an effective expression system (Foecking et al., Gene 45:101 (1986); Cockett et al., Bio/Technology 8:2 (1990)).

In bacterial systems, a number of expression vectors may be advantageously selected depending upon the intended use. For example, when a large quantity of a protein (whether a peptidogenic protein or an antibody raised against the peptidogenic protein) is to be produced, vectors which direct the expression of high levels of fusion protein products that are readily purified may be desirable. Such vectors include, but are not limited to, the *E. coli* expression vector pUR278 (Ruther et al., EMBO 1. 2:1791 (1983)), in which the coding sequence may be ligated individually into the vector in frame with the lac Z coding region so that a fusion protein is produced; pIN vectors (Inouye & Inouye, Nucleic Acids Res. 13:3101-3109 (1985); Van Heeke & Schuster, J. Biol. Chem. 24:5503-5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or Factor Xa protease cleavage sites so that the cloned target gene product can be released from the GST moiety.

In an insect system, *Autographa californica* nuclear polyhedrosis virus (AcNPV) may be used as a vector to express a peptidogenic protein or an antibody raised against the peptidogenic protein. The virus grows in *Spodoptera frugiperda* cells. Coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be utilized. In cases where an adenovirus is used as an expression vector, the coding sequence of interest may be ligated to an adenovirus transcription/translation control complex, e.g., the late promoter and tripartite leader sequence. This chimeric gene may then be inserted in the adenovirus genome by in vitro or in vivo recombination.

Insertion in a non-essential region of the viral genome (e.g., region E1 or E3) will result in a recombinant virus that is viable and capable of expressing the peptidogenic protein or an antibody raised against the peptidogenic protein in infected hosts (e.g., see Logan & Shenk, Proc. Natl. Acad. Sci. USA 8 1:355-359 (1984)).

Specific initiation signals may also be required for efficient translation of inserted coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed, to this end, eukaryotic host cells which possess the cellular machinery for proper processing of the primary transcript, glycosylation, and phosphorylation of the gene product may be used. Such mammalian host cells include, but are not limited to, CHO, VERY, BHK, Hela, COS, NSO, MDCK, 293, 3T3, W138, and in particular, breast cancer cell lines such as, for example, BT483, Hs578T, HTB2, BT2O and T47D, and normal mammary gland cell line such as, for example, CRL7O3O and HsS78Bst.

For long-term, high-yield production of recombinant proteins, stable expression is preferred. For example, cell lines which stably express the peptidogenic protein or an antibody raised against the peptidogenic protein may be engineered. Rather than using expression vectors which contain viral origins of replication, host cells can be transformed with a polynucleotide controlled by appropriate expression control elements (e.g., promoter, enhancer, sequences, transcription terminators, polyadenylation sites, etc.), and a selectable marker. Following the introduction of the foreign polynucleotide, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the peptidogenic protein or an antibody raised against the peptidogenic protein.

A number of selection systems may be used, including but not limited to, the herpes simplex virus thymidine kinase (Wigler et al., Cell 11:223 (1977)), hypoxanthineguanine phosphoribosyltransferase (Szybalska & Szybalski, Proc. Natl. Acad. Sci. USA 48:202 (1992)), and adenine phosphoribosyltransferase (Lowy et al., Cell 22:8 17 (1980)) genes can be employed in tk-, hgprt- or aprt-cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Goldspiel et al., Clinical Pharmacy, 12: 488-505 (1993); Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62: 191-217 (1993); TIB TECH 11(5):155-2 15 (May; 1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example; in Ausubel et al. (eds.), Current Protocols in Molecular Biology, John Wiley & Sons, N.Y. (1993); Kriegler, Gene Transfer and Expression, A Laboratory Manual, Stockton Press, N Y (1990); and in Chapters 12 and 13, Dracopoli et al. (eds), Current Protocols in Human Genetics, John Wiley & Sons, N.Y. (1994); Colberre-Garapin et al., J. Mol. Biol. 150:1 (1981).

The expression levels of a peptidogenic protein or an antibody raised against the peptidogenic protein can be increased by vector amplification (for a review, see Bebbington and Hentschel, *The use of vectors based on gene amplification for the expression of cloned genes in mammalian cells in DNA cloning*, Vol. 3. (Academic Press, New York, 1987)). When a marker in the vector system expressing a peptidogenic protein or an antibody raised against the peptidogenic protein is amplifiable, an increase in the level of inhibitor present in the host cell culture will increase the number of copies of the marker gene. Since the amplified region is associated with the coding sequence, production of the peptidogenic protein or an antibody raised against the peptidogenic protein will also increase (Crouse et al., Mol. Cell. Biol. 3:257 (1983)).

Other elements that can be included in vector sequences include heterologous signal peptides (secretion signals), membrane anchoring sequences, introns, alternative splice sites, translation start and stop signals, inteins, biotinylation sites and other sites promoting post-translational modifications, purification tags, sequences encoding fusions to other proteins or peptides, separate coding regions separated by internal ribosome reentry sites, sequences encoding "marker" proteins that, for example, confer selectability (e.g., antibiotic resistance) or sortability (e.g., fluorescence), modified nucleotides, and other known polynucleotide cis-acting features not limited to these examples.

In the case of antibodies, the host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain is preferably placed before the heavy chain to avoid an excess of toxic free heavy chain (Proudfoot, Nature 322:52 (1986); Kohler, Proc. Natl. Acad. Sci. USA 77:2 197 (1980)). The coding sequences for the heavy and light chains may comprise cDNA or genomic DNA or synthetic DNA sequences.

Once a peptidogenic protein or an antibody raised against the peptidogenic protein has been produced by recombinant expression, it may be purified by any method known in the art for purification of a protein, for example, by chromatography (e.g., ion exchange, affinity (particularly by Protein A affinity and immunoaffinity for the specific antigen), and sizing column chromatography), centrifugation, differential solubility, or by any other standard technique for the purification of proteins. Further, a peptidogenic protein or an antibody raised against the peptidogenic protein may be fused to heterologous polypeptide sequences described herein or otherwise known in the art to facilitate purification.

In one example, the peptidogenic protein or the antibody raised to the peptidogenic protein described herein may be fused with the constant domain of immunoglobulins (IgA, IgE, IgG, IgM), or portions thereof (CH1, CH2, CH3, or any combination thereof and portions thereof), or albumin (including but not limited to recombinant human albumin or fragments or variants thereof (see, e.g., U.S. Pat. No. 5,876,969, issued Mar. 2, 1999, EP Patent 0 413 622, and U.S. Pat. No. 5,766,883, issued Jun. 16, 1998), resulting in chimeric polypeptides. Such fusion proteins may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84-86 (1988). Enhanced delivery of an antigen across the epithelial barrier to the immune system has been demonstrated for antigens (e.g., insulin) conjugated to an FcRn binding partner such as IgG or Fe fragments (see, e.g., PCT Publications WO 96/22024 and WO 99/04813). IgG Fusion proteins that have a disulfide-linked dimeric structure due to the IgG portion disulfide bonds have also been found to be more efficient in binding and neutralizing other molecules than monomeric polypeptides or fragments thereof alone. See, e.g., Fountoulakis et al., J. Biochem., 270:3958-3964 (1995). Nucleic acids encoding the peptidogenic protein or antibodies described herein can also be recombined with a gene of interest as an epitope tag (e.g., the hemagglutinin ("HA") tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972-897). In this system, the gene of interest is subcloned into a vaccinia recombination plasmid such that the open reading frame of the gene is translationally fused to an amino-terminal tag consisting of six histidine residues. The tag serves as a matrix-binding domain for the fusion protein. Extracts from cells infected with the recombinant vaccinia virus are loaded onto Ni2+ nitriloacetic acid-agarose column and histidine-tagged proteins can be selectively eluted with imidazole-containing buffers.

Vaccination

A mixture of peptidogenic proteins and/or polynucleotides encoding the peptidogenic proteins can be used to vaccinate an animal. This vaccination may lead to the raising of antibodies to the peptidogenic proteins. A subject suitable for treatment as described above may be a mammal, such as a rodent (e.g. a guinea pig, a hamster, a rat, a mouse), murine (e.g. a mouse), canine (e.g. a dog), feline (e.g. a cat), equine (e.g. a horse), a primate, simian (e.g. a monkey or ape), a monkey (e.g. marmoset, baboon, rhesus macaque), an ape (e.g. gorilla, chimpanzee, orangutan, gibbon), or a human. In some preferred embodiments, the subject is a human. In other embodiments, non-human mammals, especially mammals that are conventionally used as models for demonstrating therapeutic efficacy in humans (e.g. murine, primate, porcine, canine, or rabbit animals) may be employed.

In some embodiments, the peptidogenic proteins are chimeric fusion proteins, e.g., a viral protein that has been fused to another protein, that are used for vaccines.

A vaccination strategy can be based on repetitive administration of the peptidogenic proteins and/or polynucleotides encoding the peptidogenic proteins to the subject as described herein to enable the development of memory B cells and memory T cells against the peptidogenic protein. Vaccination can be conducted either prophylactically or therapeutically. The peptidogenic proteins can be derived from either the same starting protein or from multiple starting proteins. While prophylactic vaccination strategies aim to stimulate the subject's immune system in developing preventive adaptive immunity to a pathogen, the goal of therapeutic vaccination strategy is conducted after the disease has been already established or to improve a clinical situation, present in the subject.

Proteolytic processing involves antigens such as peptidogenic proteins being processed in Antigen Presenting Cells after endocytosis and fusion of the endosome with a lysosome. The endosome then merges with an exocytic vesicle from the Golgi apparatus containing class II MHC molecules, to which the resultant peptides bind. The MHC-peptide complex then trafficks to the plasma membrane where the antigen is available for display to $CD4^+$ T cells. Any limitation of the proteolytic processing of the peptidogenic proteins could promote a narrowing of the diversity of the peptide products, which would give the class II MHC molecules fewer options among which to select stable binding partners, and this could exacerbate the phenomenon of immunodominant determinants Heightened immunodominance would in turn increase the proportion of non-responders in the population, because immune responsiveness is governed by the genetics of class II MHC alleles. Hence, vaccines using a mixture of peptidogenic proteins and/or polynucleotides encoding the peptidogenic proteins described herein should increase the variety of antigen peptides resulting from intra-endosomal proteolytic processing and therefore would be expected to increase the effectiveness of the vaccine.

Introduction into Animals Polynucleotides Encoding Peptidogenic Proteins

Polynucleotides encoding the peptidogenic proteins can also be directly introduced into animals. See, for example, U.S. Pat. Nos. 5,676,954; 6,875,748; 5,661,133; Sahin et al., Nat Rev Drug Discov, 2014 October; 13(10):759-80; Kariko et al., Mol Ther, 2008 November; 16(11):1833-40; Kariko et al., Nucleic Acid Res, 2011, November; 39(21):e142; U.S. Pat. No. 6,511,832. In one example, polynucleotides, such as a DNA sequences encoding a mixture of peptidogenic proteins are directly injected into a host animal and the polynucleotides enter into the nucleus to be transcribed to mRNA in order to produce the peptidogenic proteins.

Similarly, the polynucleotides can also be mRNA sequences, such as an in vitro transcribed mRNA (IVT mRNA). Essentially, synthetic mRNAs can be engineered to express peptidogenic proteins, and ideally, the mRNA is translated in the cell's cytoplasm without entering the nucleus. In the cytoplasm, the mRNA is decoded by ribosomes and is translated into the peptidogenic proteins.

In either method, the peptidogenic proteins are then processed and used to generate antibodies, much like immunization with a protein. The polynucleotides encoding the peptidogenic proteins can be synthesized using the genetic codon degeneracy and standard DNA synthesis techniques. Mixtures of different polynucleotides encoding the same peptidogenic protein, different peptidogenic proteins derived from the same starting protein, and/or different peptidogenic proteins derived from different starting proteins can be used.

Mammals that can be used to raise antibodies, include but are not limited to rabbits, rats, mice, llamas, and/or cows. The polynucleotides disclosed herein can be injected into the animals via intramuscular, intradermal, intranasal, subcutaneous, intravenous, intratracheal, and intrathecal deliveries. This method of raising antibodies allows for the concurrent production of many species of antibodies as compared to conventional methodology, substantially increasing the repertoire of antibodies produced.

Formulations

A pharmaceutical composition may comprise the peptidogenic proteins described herein, polynucleotides encoding the peptidogenic proteins, or an antibody raised to the peptidogenic protein along with one or more pharmaceutically acceptable carriers, adjuvants, excipients, diluents, fillers, buffers, stabilizers, preservatives, lubricants, or other materials well known to those skilled in the art. Suitable materials will be sterile and pyrogen-free, with a suitable isotonicity and stability. Examples include sterile saline (e.g. 0.9% NaCl), water, dextrose, glycerol, ethanol or the like or combinations thereof. Such materials should be non-toxic and should not interfere with the efficacy of the active compound. The precise nature of the carrier or other material will depend on the route of administration, which may be by bolus, infusion, injection or any other suitable route, as discussed below. The composition may further contain auxiliary substances such as wetting agents, emulsifying agents, pH buffering agents or the like. Suitable carriers, excipients, etc. can be found in standard pharmaceutical texts, for example, Remington's Pharmaceutical Sciences, 18th edition, Mack Publishing Company, Easton, Pa., 1990.

The term "pharmaceutically acceptable" as used herein pertains to compounds, materials, compositions, and/or dosage forms which are, within the scope of sound medical judgment, suitable for use in contact with the tissues of a subject (e.g., human) without excessive toxicity, irritation, allergic response, or other problem or complication, commensurate with a reasonable benefit/risk ratio. Each carrier, excipient, etc. must also be "acceptable" in the sense of being compatible with the other ingredients of the formulation.

In some embodiments, the peptidogenic proteins, the polynucleotides encoding the peptidogenic proteins or an antibody raised to the peptidogenic protein may be provided in a lyophilized form for reconstitution prior to administration. For example, lyophilized reagents may be re-constituted in sterile water and mixed with saline prior to administration to a subject.

Additionally, "cocktails" of the peptidogenic proteins, the polynucleotides encoding the peptidogenic proteins, or an antibody raised to the peptidogenic protein are specifically contemplated. For example, a mixture of different peptidogenic proteins or polynucleotides encoding different peptidogenic proteins derived from the same starting protein can be used to mount an immune response. Alternatively, a mixture of different peptidogenic proteins or polynucleotides encoding different peptidogenic proteins derived from different starting materials may also be used to mount an immune response.

The formulations may conveniently be presented in unit dosage form and may be prepared by any methods well known in the art of pharmacy. Such methods include the step of bringing into association the active compound with the carrier which constitutes one or more accessory ingredients. In general, the formulations are prepared by uniformly and intimately bringing into association the active compound with liquid carriers or finely divided solid carriers or both, and then if necessary shaping the product.

Formulations may be in the form of liquids, solutions, suspensions, emulsions, elixirs, syrups, tablets, lozenges, granules, powders, capsules, cachets, pills, ampoules, suppositories, pessaries, ointments, gels, pastes, creams, sprays, mists, foams, lotions, oils, boluses, electuaries, or aerosols.

Optionally, other therapeutic or prophylactic agents may be included in a pharmaceutical composition or formulation.

Treatment may be any treatment and therapy, whether of a human or an animal (e.g. in veterinary applications), in which some desired therapeutic effect is achieved, for example, the inhibition or delay of the progress of the condition, and includes a reduction in the rate of progress, a halt in the rate of progress, amelioration of the condition, cure or remission (whether partial or total) of the condition, preventing, delaying, abating or arresting one or more symptoms and/or signs of the condition or prolonging survival of a subject or patient beyond that expected in the absence of treatment.

Treatment as a prophylactic measure (i.e. prophylaxis) is also included. For example, a subject susceptible to or at risk of the occurrence or re-occurrence of the disease may be treated as described herein. Such treatment may prevent or delay the occurrence or re-occurrence of the disease in the subject.

The term "therapeutically-effective amount" as used herein, pertains to that amount of the peptidogenic protein or an antibody raised to the peptidogenic protein which is effective for producing some desired therapeutic effect, commensurate with a reasonable benefit/risk ratio.

It will be appreciated that appropriate dosages of the peptidogenic protein or an antibody raised to the peptidogenic protein can vary from patient to patient. Determining the optimal dosage will generally involve the balancing of the level of therapeutic benefit against any risk or deleterious side effects of the administration. The selected dosage level will depend on a variety of factors including, but not limited to, the route of administration, the time of administration, the rate of excretion of the active compound, other drugs, compounds, and/or materials used in combination, and the age, sex, weight, condition, general health, and prior medical history of the patient. The amount of peptidogenic protein, polynucleotide encoding the peptidogenic protein, or an antibody raised to the peptidogenic protein and route of administration will ultimately be at the discretion of the physician, although generally the dosage will be to achieve concentrations of the active compound at a site of therapy without causing substantial harmful or deleterious side-effects.

In general, a suitable dose of the peptidogenic protein or an antibody raised to the peptidogenic protein is in the range of about 100 μg to about 250 mg per kilogram body weight of the subject per day. Where the peptidogenic protein or an antibody raised to the peptidogenic protein is a salt, an ester, prodrug, or the like, the amount administered is calculated on the basis of the parent compound and so the actual weight to be used is increased proportionately.

Administration in vivo can be effected in one dose, continuously or intermittently (e.g., in divided doses at appropriate intervals). Methods of determining the most effective means and dosage of administration are well known to those of skill in the art and will vary with the formulation used for therapy, the purpose of the therapy, the target cell being treated, and the subject being treated. Single or multiple administrations can be carried out with the dose level and pattern being selected by the physician.

By "simultaneous" administration, it is meant that the peptidogenic proteins, the polynucleotides encoding the peptidogenic proteins, or an antibody raised to the peptidogenic protein are administered to the subject in a single dose by the same route of administration.

By "separate" administration, it is meant that the peptidogenic proteins, the polynucleotides encoding the peptidogenic proteins, or an antibody raised to the peptidogenic protein are administered to the subject by two different routes of administration which occur at the same time. This may occur for example where one agent is administered by infusion or parenterally and the other is given orally during the course of the infusion or parenteral administration.

By "sequential" it is meant that the peptidogenic proteins, the polynucleotides encoding the peptidogenic proteins, or an antibody raised to the peptidogenic protein are administered at different points in time, provided that the activity of the first administered agent is present and ongoing in the subject at the time the second agent is administered. Preferably, a sequential dose will occur such that the second of the two agents is administered within 48 hours, preferably within 24 hours, such as within 12, 6, 4, 2 or 1 hour(s) of the first agent.

Multiple doses of the peptidogenic proteins, the polynucleotides encoding the peptidogenic proteins and/or an antibody raised to the peptidogenic protein may be administered. For example 2, 3, 4, 5 or more than 5 doses may be administered after administration of the peptidogenic proteins, the polynucleotides encoding the peptidogenic proteins, and/or an antibody raised to the peptidogenic protein. The administration of the peptidogenic proteins, the polynucleotides encoding the peptidogenic proteins, and/or an antibody raised to the peptidogenic protein may continue for sustained periods of time after initial administration. For example treatment with the peptidogenic proteins, the polynucleotides encoding the peptidogenic proteins, or an antibody raised to the peptidogenic protein may be continued for at least 1 week, at least 2 weeks, at least 3 weeks, at least 1 month or at least 2 months. Treatment with the peptidogenic proteins, the polynucleotides encoding the peptidogenic proteins, or an antibody raised to the peptidogenic protein may be continued for as long as is necessary to achieve a therapeutic response.

The peptidogenic proteins, the polynucleotides encoding the peptidogenic proteins, or an antibody raised to the peptidogenic protein and compositions comprising these molecules may be administered to a subject by any convenient route of administration, whether systemically/peripherally or at the site of desired action, including but not limited to, oral (e.g. by ingestion); and parenteral, for example, by injection, including subcutaneous, intradermal, intramuscular, intravenous, intraarterial, intracardiac, intrathecal, intraspinal, intracapsular, subcapsular, intraorbital, intraperitoneal, intratracheal, subcuticular, intraarticular, subarachnoid, and intrasternal; by implant of a depot, for example, subcutaneously or intramuscularly. Usually administration will be by the intravenous route, although other routes such as intraperitoneal, subcutaneous, transdermal, oral, nasal, intramuscular or other convenient routes are not excluded.

The pharmaceutical compositions comprising the peptidogenic protein, the polynucleotides encoding the peptidogenic proteins or an antibody raised to the peptidogenic protein may be formulated in suitable dosage unit formulations appropriate for the intended route of administration.

Formulations suitable for oral administration (e.g. by ingestion) may be presented as discrete units such as capsules, cachets or tablets, each containing a predetermined amount of the active compound; as a powder or granules; as a solution or suspension in an aqueous or non-aqueous liquid; or as an oil-in-water liquid emulsion or a water-in-oil liquid emulsion; as a bolus; as an electuary; or as a paste.

A tablet may be made by conventional means, e.g., compression or molding, optionally with one or more accessory ingredients. Compressed tablets may be prepared by compressing in a suitable machine the active compound in a free-flowing form such as a powder or granules, optionally mixed with one or more binders (e.g. povidone, gelatin, acacia, sorbitol, tragacanth, hydroxypropylmethyl cellulose); fillers or diluents (e.g. lactose, microcrystalline cellulose, calcium hydrogen phosphate); lubricants (e.g. magnesium stearate, talc, silica); disintegrants (e.g. sodium starch glycolate, cross-linked povidone, cross-linked sodium carboxymethyl cellulose); surface-active or dispersing or wetting agents (e.g. sodium lauryl sulfate); and preservatives (e.g. methyl p-hydroxybenzoate, propyl p-hydroxybenzoate, sorbic acid). Molded tablets may be made by molding in a suitable machine a mixture of the powdered compound moistened with an inert liquid diluent. The tablets may optionally be coated or scored and may be formulated so as to provide slow or controlled release of the active compound therein using, for example, hydroxypropylmethyl cellulose in varying proportions to provide the desired release profile. Tablets may optionally be provided with an enteric coating, to provide release in parts of the gut other than the stomach.

Formulations suitable for parenteral administration (e.g. by injection, including cutaneous, subcutaneous, intramuscular, intravenous and intradermal), include aqueous and non-aqueous isotonic, pyrogen-free, sterile injection solutions which may contain anti-oxidants, buffers, preservatives, stabilizers, bacteriostats, and solutes which render the formulation isotonic with the blood of the intended recipient; and aqueous and non-aqueous sterile suspensions which may include suspending agents and thickening agents, and liposomes or other microparticulate systems which are designed to target the compound to blood components or one or more organs. Examples of suitable isotonic vehicles for use in such formulations include Sodium Chloride Injection, Ringer's Solution, or Lactated Ringer's Injection. Typically, the concentration of the active compound in the solution is from about 1 ng/ml to about 10 μg/ml, for example from about 10 ng/ml to about 1 μg/ml, from about 1 μg/ml to about 10 mg/ml, from about 10 μg/ml to about 1 mg/ml, from about 1 mg/ml to about 20 mg/ml, from about 10 mg/ml to about 120 mg/ml, or any other concentration suitable for administration of biological drugs (e.g., proteins, antibodies, etc.). The formulations may be presented in unit-dose or multi-dose sealed containers, for example, ampoules and vials, and may be stored in a freeze-dried (lyophilized) condition requiring only the addition of the sterile liquid carrier, for example water for injections, immediately prior to use. Extemporaneous injection solutions and suspensions may be prepared from sterile powders, granules, and tablets. Formulations may be in the form of liposomes or other microparticulate systems which are designed to target the active compound to blood components or one or more organs.

Compositions comprising the peptidogenic proteins, the polynucleotides encoding the peptidogenic proteins and/or an antibody raised to the peptidogenic protein may be prepared in the form of a concentrate for subsequent dilution, or may be in the form of divided doses ready for administration. Alternatively, the reagents may be provided separately within a kit, for mixing prior to administration to a human or animal subject.

The peptidogenic proteins, the polynucleotides encoding the peptidogenic proteins, and/or an antibody raised to the peptidogenic protein may be administered alone or in combination with other treatments, either simultaneously or sequentially dependent upon the individual circumstances. For example, peptidogenic proteins, the polynucleotides encoding the peptidogenic proteins, or an antibody raised to the peptidogenic protein as described herein may be administered in combination with one or more additional active compounds.

Various further aspects and embodiments of the present invention will be apparent to those skilled in the art in view of the present disclosure.

It is to be understood that the application discloses all combinations of any of the above aspects and embodiments described above with each other, unless the context demands otherwise. Similarly, the application discloses all combinations of the preferred and/or optional features either singly or together with any of the other aspects, unless the context demands otherwise.

Modifications of the above embodiments, further embodiments and modifications thereof will be apparent to the skilled person on reading this disclosure, and as such these are within the scope of the present invention. All documents and sequence database entries mentioned in this specification are incorporated herein by reference in their entirety for all purposes. The invention is further described below, with reference to the following examples.

EXAMPLES

Example 1: Generating Peptidogenic Antigens

To generate peptidogenic proteins, a starting protein can be modified at its core residues (e.g., one or more mutations) to alter its conformational dynamics. Multiple different peptidogenic proteins can be designed and expressed to immunize animals, such as rabbits, to generate a polyclonal antibody response. Alternatively, polynucleotides encoding the peptidogenic proteins can be directly administered to the animals to generate the peptidogenic proteins in vivo. The response will be monitored by two complementary and mutually reinforcing methods (Georgiou et al, 2014; FIG. 2): (a) purifying B cells from the blood, spleen, and bone marrow of immunized animals, isolating cDNA from mRNA encoding the variable regions of the heavy and light chains, and analyzing this repertoire via deep DNA sequencing; and (b) immunoaffinity purifying from immune sera polyclonal Fab or (Fab')2 fragments using antigen attached to a solid support, digesting the eluted Fab/(Fab')2s with proteases, and sequencing the resultant peptides using LC/MS/MS.

Specifically, challenging test animals (rabbits) with a variety of peptidogenic proteins (or polynucleotides encoding the peptidogenic proteins) where the conformation is similar to the starting protein, but the conformational dynamics of the peptidogenic protein is varied, can be performed. Using next-generation DNA sequencing technology, the humoral response in the animal can be comprehensively characterized Immunoglobulin V-regions from B lymphocytes can be cloned and subjected to massively parallel deep sequencing (5-8). In conjunction with this, polyclonal antibodies from the same test animal can be purified by immunoaffinity chromatography, then protease-digested and subjected to LC-MS/MS to determine the peptide sequences (9, 10). Comparisons of these two datasets illuminate the repertoire of individual antibodies comprising the polyclonal response (9).

For example, small mammalian proteins that have been extremely well-characterized biophysically can be used as test antigens. Preferred examples, include, but are not limited to bovine pancreatic trypsin inhibitor and/or Alzheimer's amyloid precursor protein Kunitz domain. Alternatively, antigens relevant to unmet vaccine needs, such as for example, *P. falciparum* sporozoite antigens can also be generated and tested in this method. Additionally, optimization (or re-optimization) of synthetic vaccines with respect to conformational dynamics of the component proteins (perhaps replacing a single component with a combinatory cocktail of several versions of the same antigen with different core destabilizing mutations) can also be generated. Testing these new vaccines in clinical trials could involve monitoring of the vaccinated individuals using similar DNA sequence analyses of blood-derived B-cell V-region repertoires and proteomic characterization of immunoaffinity-purified polyclonal antibody peptides, similar to the procedures described above.

Other preferred examples of antigens that can be used according to embodiments of the invention described herein, include, but are not limited to antigens or antigens derived from, malarial polypeptides such as thrombospondin-related adhesive protein (TRAP) and/or apical membrane antigen 1 (AMA1), human immunodeficiency virus (HIV) gp120 and gp41, hepatitis C (HCV) envelope glycoproteins E1 and E2, Middle East respiratory syndrome coronavirus (MERS-CoV) Spike glycoprotein, human influenza virus hemagglutinin (HA) and neuraminidase, hepatitis B virus (HBV) capsid core, as well as antigens from related viruses that infect apes, monkeys, birds, pigs, camels, and other animals.

In preferred embodiments, any one of the *P. falciparum* protein antigens listed in the following Table 2 can be used as a starting protein to derive the peptidogenic protein. Additionally, multiple antigens listed in Table 2 can be used as the starting proteins to derive multiple different peptidogenic proteins to be used as a vaccine, generate an immune response, including the raising of antibodies.

TABLE 2

| Gene | Predicted Size | Paralogs | Predicted SP Cleavage Site | Gene | Predicted Size | Paralogs | Predicted SP Cleavage Site |
|---|---|---|---|---|---|---|---|
| MAL13P1.225 | 157 | | 23/24 | PFI0880C | 396 | | 25/26 |
| PF13_0203 | 158 | | 22/23 | PF11_0251 | 421 | | 22/23 |
| PF11_0164 | 195 | PFC0795C | 21/22 | PFC0065C | 437 | PF08_0022, PF14_0015 | 31/32 |
| PFL0375W | 209 | | 16/17 | PFC0925W | 492 | | 30/31 |
| PFI1270W | 217 | | 20/21 | MAL13P1.121 | 565 | | 34/35 |
| PF10_0104 | 223 | | 22/23 | PF13_0133 | 590 | | 33/34 |
| PF13_0128 | 230 | | 18/19 | PFL2015W | 676 | | 27/28 |
| PF11_0058 | 233 | | 35/36 | PFD0440W | 693 | | 25/26 |
| PFA0490W | 234 | | 29/30 | PFC0330W | 699 | | 26/27 |
| PF07_0087 | 244 | | 26/27 | PFD0430C | 840 | | 24/25 |
| PFB0570W | 250 | | 21/22 | PF14_0462 | 851 | PFC0550W | 28/29 |
| PF13_0180 | 258 | PFL0740C | 19/20 | PF07_0100 | 1032 | | 35/36 |
| PF11_0065 | 282 | | 23/24 | MAL7P1.23 | 1183 | | 30/31 |
| PF14_0678 | 287 | | 21/22 | PFL1835W | 1188 | | 26/27 |
| PF13_0125 | 292 | | 19/20 | PF07_0047 | 1229 | PFF0940C | 35/36 |
| PF13_0141 | 316 | PFF0895W | 20/21 | PF14_0250 | 1320 | | 28/29 |
| PF14_0117 | 327 | PFI1775W, PFL2530W | 22/23 | PFE0905W | 1379 | | 24/25 |
| PF11_0098 | 343 | | 26/27 | PFA0180W | 1472 | | 31/32 |
| PF14_0660 | 358 | | 23/24 | PFL1210W | 1696 | | 25/26 |
| PFD0240C | 378 | | 20/21 | PF14_0363 | 1922 | | 26/27 |
| PFE0080C | 398 | | 21/22 | PFB0400W | 2508 | | 34/35 |
| PFA0660W | 402 | PFB0090C, PFB0595W, PFE0055C | 34/35 | PFI0920C | 577 | | 26/27 |
| PF11_0352 | 423 | | 23/24 | PF14_0094 | 768 | | 22/23 |
| PF11_0055 | 424 | | 21/22 | PFA0125C | 1567 | | 26/27 |
| PFB0475C | 446 | | 22/23 | PF10_0372 | 120 | | 25/26 |
| PF11_0302 | 452 | | 21/22 | PFL2315C | 137 | | 28/29 |
| PFA0210C | 466 | | 23/24 | MAL13P1.271 | 181 | | 36/37 |
| PF07_0089 | 467 | | 16/17 | MAL7P1.31 | 236 | | 20/21 |
| PF14_0060 | 475 | | 16/17 | PF10_0317 | 263 | PF14_0653 | 35/36 |
| MAL8P1.17 | 483 | | 24/25 | PF07_0070 | 322 | | 19/20 |
| MAL7P1.77 | 522 | | 23/24 | MAL7P1.64 | 357 | | 28/29 |
| PF11_0099 | 540 | | 33/34 | PFI0935W | 370 | | 21/22 |
| PF07_0068 | 546 | | 22/23 | PFA0160C | 434 | | 22/23 |
| PF13_0201 | 574 | | 25/26 | PFB0465C | 457 | | 27/28 |
| PF07_0094 | 579 | | 17/18 | PF10_0208 | 627 | | 23/24 |
| PF07_0006 | 594 | MAL8P1.143 | 22/23 | PFB0760W | 686 | | 25/26 |
| PFL0770W | 618 | PF07_0073 | 20/21 | MAL13P1.206 | 687 | | 26/27 |
| PFI1645C | 642 | PF13_0262 | 18/19 | PF14_0541 | 717 | | 15/16 |
| PF14_0166 | 674 | | 25/26 | PFL0790W | 870 | | 21/22 |
| PFE0815W | 681 | | 24/25 | PFL2410W | 1039 | | 24/25 |
| PF11_0174 | 700 | | 27/28 | PF14_0440 | 1191 | | 23/24 |
| PFE0475W | 722 | PFB0525W | 21/22 | PF11_0333 | 1503 | | 25/26 |
| PF11_0074 | 743 | | 17/18 | PF10_0242 | 1541 | | 20/21 |
| PFL1385C | 743 | | 23/24 | PFC0590C | 1816 | | 20/21 |
| PF14_0102 | 782 | | 22/23 | PF14_0342 | 1898 | | 27/28 |
| PF11_0212 | 791 | | 20/21 | MAL7P1.92 | 2543 | PFI0550W | 22/23 |
| PF07_0129 | 811 | | 21/22 | PF14_0593 | 1357 | | 18/19 |
| PFL2570W | 816 | | 22/23 | MAL13P1.49 | 144 | | 24/25 |
| PFL1070C | 821 | | 28/29 | MAL13P1.172 | 260 | | 26/27 |
| PFB0695C | 888 | | 32/33 | PF08_0006 | 272 | | 19/20 |
| PF11_0175 | 906 | PF08_0063 | 26/27 | PFD1035W | 328 | | 37/38 |
| MAL13P1.22 | 912 | | 15/16 | PF11_0052 | 336 | | 24/25 |
| PFL0035C | 926 | | 27/28 | MAL13P1.79 | 383 | | 19/20 |
| PFI0685W | 955 | | 18/19 | PF10_0295 | 426 | | 23/24 |
| PFD0425W | 984 | | 21/22 | PFL1745C | 459 | | 22/23 |
| PF14_0293 | 992 | | 24/25 | PF14_0677 | 467 | | 24/25 |

TABLE 2-continued

| Gene | Predicted Size | Paralogs | Predicted SP Cleavage Site | Gene | Predicted Size | Paralogs | Predicted SP Cleavage Site |
|---|---|---|---|---|---|---|---|
| PF14_0344 | 993 | | 20/21 | PFL0600W | 558 | | 23/24 |
| PFL0560C | 1024 | | 20/21 | PF08_0108 | 573 | PF14_0281 | 26/27 |
| PF07_0035 | 1248 | | 20/21 | PF08_0081 | 577 | | 18/19 |
| PFL1675C | 1256 | | 21/22 | PF14_0620 | 858 | | 25/26 |
| PFC0435W | 1294 | | 19/20 | PFE0710W | 867 | | 21/22 |
| PFI1445W | 1364 | | 19/20 | PF11_0270 | 1013 | | 20/21 |
| PF13_0354 | 1408 | | 23/24 | MAL7P1.149 | 1051 | | 19/20 |
| PFC0110W | 1416 | MAL7P1.229, PFA0125C, PFD1155W | 24/25 | PFC0810C | 1119 | | 22/23 |
| PFC0120W | 1417 | | 24/25 | PF14_0249 | 1169 | | 25/26 |
| PF08_0078 | 1419 | | 20/21 | PF13_0116 | 1258 | | 19/20 |
| PF14_0614 | 1502 | | 16/17 | MAL13P1.60 | 1260 | | 25/26 |
| PF14_0051 | 1515 | | 26/27 | PF11_0246 | 1336 | | 23/24 |
| PF11_0076 | 1988 | | 22/23 | PFL2505C | 2215 | | 21/22 |
| MAL13P1.262 | 2006 | | 21/22 | PFB0405W | 3135 | | 20/21 |
| PFC0640W | 2114 | | 26/27 | PF11_0256 | 608 | | 17/18 |
| PFL2520W | 2792 | MAL13P1.176, PF13_0198 | 24/25 | PF08_0047 | 613 | | 28/29 |
| PFC0282W | 116 | | 23/24 | PFC0835C | 440 | | 22/23 |
| PF08_0004 | 137 | | 25/26 | PFI0605C | 446 | | 20/21 |
| PF11_0224 | 162 | | 22/23 | PF10_0127 | 499 | | 16/17 |
| PF13_0272 | 208 | | 22/23 | PF11_0344 | 622 | | 24/25 |
| MAL13P1.171 | 211 | | 20/21 | PF10_0130 | 628 | | 25/26 |
| PFE1340W | 214 | | 27/28 | PFL2395C | 639 | PF14_0428 | 28/29 |
| PF14_0369 | 235 | | 20/21 | PF08_0008 | 738 | | 21/22 |
| PF14_0178 | 259 | | 22/23 | PF14_0201 | 966 | | 22/23 |
| PFL0870W | 352 | | 24/25 | PFI1475W | 1720 | | 19/20 |
| PFC0210C | 397 | | 18/19 | PF13_0182 | 1838 | | 26/27 |
| PFI0500W | 432 | | 28/29 | PF14_0495 | 2189 | | 20/21 |
| PF11_0069 | 276 | | 25/26 | PF13_0277 | 2068 | | 22/23 |
| PFD0355C | 286 | | 32/33 | | | | |

To alter the conformational dynamics of a starting protein, the following changes in Gibbs Free Energy, shown in Table 3 below, can be considered:

TABLE 3

| Amino Acid Substitution (multiple positions in various proteins) | Average Gibbs Free Energy difference between mutant and wild type at core residues within a protein ΔΔG (kJ/mol) |
|---|---|
| Val -> Ala | −12.1(±3.3) |
| Val -> Thr | −11.3(±3.7) |
| Val -> Asn | −21.5(±1.0) |
| Leu -> Ala | −14.2(±4.2) |

As discussed in Loladze et al (J. Mol. Biol. 320, 343-357 (2002)), the following amino acid substitutions can decrease the thermodynamic stability (e.g., reflected in the Gibbs free energy) and alter the conformational dynamics of a starting protein. For example, Val and Leu (and other larger non-polar amino acid residues) can be substituted with smaller ones such as Ala, Thr, Asn, and/or Gly. In addition, the buried site of Glu in the starting protein, can be substituted with Leu, Val, Asn, Thr, Ser, Ala, and/or Gly. These single site amino acid substitutions are expected to generate peptidogenic proteins with lower stability but a similar conformation to the starting protein.

Alternatively, the conformational dynamics of the starting protein is altered by replacing (a) at least one threonine with a valine, alanine, glycine or serine; or (b) at least one cysteine with alanine, valine, glycine, serine or threonine; or (c) at least one valine with alanine, glycine, leucine or isoleucine; or (d) at least one leucine with alanine, valine, glycine, or isoleucine; or (e) at least one isoleucine with alanine, valine, leucine, or glycine; or (f) at least one proline, methionine, phenylalanine, tyrosine, or tryptophan with alanine, valine, leucine, isoleucine, or glycine; or (g) at least one aspartic acid or asparagine with glycine, serine, threonine, alanine, valine, leucine, isoleucine; or (h) at least one glutamic acid or glutamine with aspartic acid, asparagine, glycine, serine, threonine, alanine, valine, leucine, or isoleucine; or (i) at least one lysine with arginine, histidine, glycine, serine, threonine, alanine, valine, methionine, leucine, or isoleucine; or (j) at least one arginine with lysine, histidine, glycine, serine, threonine, alanine, valine, methionine, leucine, or isoleucine; or (k) at least one histidine with lysine, arginine, glycine, serine, threonine, alanine, valine, glutamine, asparagine, leucine, or isoleucine; or (l) at least one alanine with a glycine; or (m) at least one residue with a non-natural amino acid; and/or (n) any of the above combinations.

In still further preferred embodiments, the conformational dynamics of the starting protein is altered by replacing: (a) at least one tryptophan with tyrosine, phenylalanine, methionine, histidine, isoleucine, leucine, valine, alanine or glycine; or (b) at least one tyrosine with phenylalanine, methionine, histidine, isoleucine, leucine, valine, alanine or glycine; or (c) at least one phenylalanine with tyrosine, methionine, histidine, isoleucine, leucine, valine, alanine or glycine; or (d) at least one proline with methionine, leucine, isoleucine, valine, alanine, or glycine; or (e) at least one histidine with phenylalanine, tyrosine, methionine, isoleucine, leucine, valine, alanine, glycine, lysine, arginine, serine, threonine, asparagine, or glutamine; or (f) at least one methionine with isoleucine, leucine, valine, alanine or glycine; or (g) at least one isoleucine with leucine, valine, alanine or glycine; or (h) at least one leucine with isoleucine, valine, alanine or glycine; or (i) at least one valine with alanine, glycine, leucine, or isoleucine; or (j) at least one cysteine with alanine, valine, glycine, serine or threonine; or (k) at least one aspartic acid with glutamic acid, glutamine, asparagine, glycine, serine, threonine, alanine, valine, leucine, or isoleucine; or (l) at least one glutamic acid with aspartic acid, glutamine, asparagine, glycine, serine, threonine, alanine, valine, leucine, or isoleucine; or (m) at least one alanine with a glycine or proline; or (n) at least one serine with alanine or glycine; or (o) at least one glycine with alanine or proline; or (p) at least one lysine with arginine, histidine, glycine, serine, threonine, alanine, valine, methionine, leucine or isoleucine; or (q) at least one asparagine with glycine, alanine, serine, threonine, valine, leucine, isoleucine, glutamine, aspartic acid or glutamic acid; or (r) at least one glutamine with glycine, alanine, serine, threonine, valine, leucine, isoleucine, glutamine, aspartic acid, glutamic acid, or histidine; or (s) at least one arginine with lysine, histidine, glycine, serine, threonine, alanine valine, methionine, leucine, or isoleucine; or (t) at least one threonine with valine, alanine, glycine or serine; or (u) a hydrophobic residue with a smaller, similar hydrophobic residue; or (v) at least one residue with a non-natural amino acid; or (w) any of the above combinations. A combinatorial approach may be used to determine optimal substitutions to increase immunogenicity.

Example 2: Peptidogenic Proteins of Bovine Pancreatic Trypsin Inhibitor

Bovine pancreatic trypsin inhibitor (BPTI) is an extremely well-characterized small protein, on which there is a substantial body of literature describing its folding, structure, activity, thermodynamic properties, expression properties, and protease specificities (15). Our own lab was the first to express recombinant BPTI and engineer its properties using site-directed mutagenesis (16, 17). Wild type BPTI has three disulfide bonds, cross-linking disulfides 14-38, 30-51, and 5-55; the 14-38 disulfide is on the surface, and the other two disulfides are deeply buried in the hydrophobic core of the protein. Mutations of any one of these disulfides by replacing the two disulfide cysteines with alanine residues destabilizes the BPTI molecule (18). All possible combinations of disulfide bond mutants of BPTI have been made by ourselves and by others, and all are markedly destabilizing. Importantly, where it has been examined, for all combinations of mutants of BPTI that knock out one or two native disulfide bonds, the protein nevertheless maintains a similar three-dimensional structure and trypsin inhibitor activity comparable to wild type BPTI (19-22) Therefore, despite stability differences manifested by Tms ranging from >100° C. to <40° C., the wild type molecule and its disulfide mutants all display similar, if not virtually identical 3D conformational epitopes. For example, at 40° C. the mutant protein would be almost 50% unfolded at body temperature, and at >100° C. (higher than the boiling point of water) the wild type protein is among the most thermostable proteins known.

TABLE 4

Mutants of BPTI that knock out one or more of the native disulfide bonds or core residues while preserving 3D structure

| BPTI variant | Sequence |
|---|---|
| wild type | RPDFC LEPPY TGPCK ARIIR YFYNA KAGLC QTFVY GGCRA KRNNF KSAED CMRTC GGA (SEQ ID NO.: 919) |
| [C14A C38A] | RPDFC LEPPY TGPAK ARIIR YFYNA KAGLC QTFVY GGARA KRNNF KSAED CMRTC GGA (SEQ ID NO.: 920) |
| [C14A, C38A], K15A | RPDFC LEPPY TGPAA ARIIR YFYNA KAGLC QTFVY GGARA KRNNF KSAED CMRTC GGA (SEQ ID NO.: 921) |
| [C14A, C38A], K15A, F22A | RPDFC LEPPY TGPAA ARIIR YAYNA KAGLC QTFVY GGARA KRNNF KSAED CMRTC GGA (SEQ ID NO.: 922) |
| [C14A, C38A], K15A, Y23A | RPDFC LEPPY TGPAA ARIIR YFANA KAGLC QTFVY GGARA KRNNF KSAED CMRTC GGA (SEQ ID NO.: 923) |
| [C14A, C38A], K15A, N43G | RPDFC LEPPY TGPAA ARIIR YFYNA KAGLC QTFVY GGARA KRGNF KSAED CMRTC GGA (SEQ ID NO.: 924) |
| [C14A, C38A], K15A, F45A | RPDFC LEPPY TGPAA ARIIR YFYNA KAGLC QTFVY GGARA KRNNA KSAED CMRTC GGA (SEQ ID NO.: 925) |

For our immunological experiments with BPTI, since we are interested in protease digestion and peptide generation in vivo from the antigen, we will make the BPTI mutants described in Table 4. Mutated residues are underlined, cysteine residues are shown in bold. These consist of wild type BPTI with the surface disulfides 14-38 mutated to alanine, which has been shown to confer increased stability to reducing agents. The BPTI mutants will also be made in the [Lys15→Ala] background. The Lys15-Ala mutation ablates the P1 residue side chain and reduces BPTI's affinity towards trypsin and other proteases by as much as 107-fold, rendering it essentially inactive as a protease inhibitor (23). Additional mutations within the core of the protein (e.g. F22A, Y23A, N43G, F45A) serve to destabilize the protein and alter conformational dynamics to varying degrees while still maintaining a 3D structure comparable to wild type BPTI. This table is intended to be non-limiting with respect to present invention embodiments.

Analogous mutations can be made in the Alzheimer's amyloid precursor protein Kunitz inhibitor (APP-KI), which is a human protease inhibitor homologous to BPTI. APP-KI has a relatively low isoelectric point (pI) and so, unlike BPTI, it should be electrostatically nearly neutral in charge at lysosomal pH. Like BPTI, APP-KI has previously been expressed and characterized in terms of folding, activity, and 3D structure, and it has three disulfide bonds precisely homologous to those found in BPTI.

We will express the mutants both with and without flanking tag sequences. Tags we have used to vary solubility include the calmodulin binding peptide (CBP) tag, which is highly soluble, to the TrpLE tag, which is highly insoluble (24). In a particularly favored construct, however, we use a tripartite tag: AviTag-hexaHis-TEV protease cleavage site. This tag confers intermediate solubility, can by biotinylated using the BirA biotin ligase (25), allows binding to a HisTrap column for purification and/or on-column refolding (Campbell and Anderson, in preparation), and can be cleaved off the antigen if necessary. The antigen can be used to immunize animals either without the tag (i.e., after TEV cleavage) or with the tag intact followed by subtractive depletion of anti-tag antibodies (S. Blackshaw and D. Eichinger, personal communication).

Example 3: Preferred Targets of the Present Invention

As used herein a “Target” is a specifically selected protein disclosed in Table 5 that can be modified to have an improved peptidogenicity as described herein. Column 1 lists the SEQ ID NO. corresponding to the sequence provided in the Sequence Listing. Column 2 lists the “Protein Name” of each Target and Column 3 provides the “UniProt Reference Number” which is a unique “cataloging” number (UniProt Reference Numbers provide a mapping of a proteome to a reference genome assembly, e.g., as produced by the Genome Reference Consortium (GRC)) used in the art that provides publicly known and established descriptions of both the function, expression and sequence information for each Target listed in Column 2. This public information (retrieved from the UniProt database (http://www.uniprot.org) on Aug. 10, 2016) including the sequence information corresponding to each Target, is herein incorporated by reference in its entirety. The Sequence Listing and Table 5 describes the positions of the specific residues in each target protein where mutations can be made to generate the corresponding peptidogenic proteins along with the specific amino acids that can be substituted at each position. In preferred embodiments, multiple substitutions can be made in each target protein at the recited positions in the Sequence Listing and as shown in Table 5. In further preferred embodiments, at least 1, 2, 3, 4, 5, 6, 7, 8, 9, 10 or more of the residues listed in the Sequence Listing and/or Table 5 for each target protein, in any combination, can be changed in the respective starting Target proteins listed in Column 2 using the amino acid specified in the Sequence Listing and/or as described in the last two paragraphs of Example 1. By spreading the mutations over multiple positions and/or target proteins, and by mixing these mutated molecules together, an immunization cocktail can be created.

TABLE 5

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 1 | Hemagglutinin [Cleaved into: Hemagglutinin HA1 chain; Hemagglutinin HA2 chain]/strain A/USA: Phila/1935 H1N1 | A4GCL9 | V7, I20, C21, I22, A26, V33, V36, V43, L49, L50, L58, C59, L61, L67, L69, C72, I74, A75, W77, L78, L79, C84, L87, W93, Y95, I96, V97, Y108, L118, L122, V125, F128, F134, A151, A152, C153, H155, L165, L166, W167, L168, L178, V190, L191, V192, L193, W194, V196, H197, H198, Y209, Y215, V216, V218, V219, Y223, M244, Y246, Y247, L250, L251, I257, F259, A261, L265, I266, A267, Y270, A271, F272, A273, L274, F278, I282, I283, C292, C296, A302, I303, H313, I317, V324, L329, M331, V332, A349, M361, Y366, A388, I389, A440, L452, V459, L462, V466, L470, C481, H486, C488, C492, M493 |
| 2 | Proprotein convertase subtilisin/kexin type 9 (EC 3.4.21.—) | A8T655 | V80, A95, L98, A102, F122, V124, A134, I143 |
| 3 | Plasminogen (EC 3.4.21.7) | B2R7F8 | Y193, W209, C234, W244, C245, F246, C257, I259 |
| 4 | cDNA FLJ60453, highly similar to Proprotein convertase subtilisin/kexin type 9 (EC 3.4.21.—) | B4DEZ9 | V80, L98, A102, F122, V124, A134, I143 |
| 5 | Receptor protein-tyrosine kinase (EC 2.7.10.1) | B4DTR1 | V474, I476, A495, I512, C513, V521, L530, V534, L546, L547, W549, C550, I553, A554, M557, L560, L565, V566, H567, L570, A571, A572, V575, V577, V583, I585, A591, A614, F623, V629, W630, Y632, V634, V636, L639, M640, I655, L659, I670, V675, M679, C682, W683, F693, F700, M703, V711 |
| 6 | Interleukin-4 | D4HNR6 | L31, I34, L38, C48, C70, A72, A73, L76, C89, H100, L107, L110, L114, A118, L133, F136, L140, M144 |
| 7 | Cell wall-binding repeat protein/NAP07 | D5RWT1 | F32, F51, F53, F73, A74, F104, F124, A129, A132, F143, F164, A165, F195, F215, A220, A223, F237 |
| 8 | Insulin, isoform 2 | F8WCM5 | L35, A38, L39 |
| 9 | Fusion glycoprotein F0 | G8EJ09 | L204, I206, I214, S215, I233, V247, M251, L257, I261, M274, I280, V281, Y299, V301, L303, C313, C333, C343, V349, F352, V365, F366, C367, C382, A412, I413, V414, C416, C422, A424, V442, V450 |
| 10 | TcdA | I6YE93 | F2585, A2593, F2604, F2625, A2626, F2656, F2676, A2681, A2684, F2698 |
| 11 | Spike glycoprotein/isolate United Kingdom/H123990006/2012 (HCoV-EMC) | K9N5Q8 | C30, F40, W44, I48, A53, Y58, Y64, I67, L74, Y85, F101, Y105, F112, V117, I120, A123, A124, I132, Y144, V153, L169, V170, L172, C176, A182, Y184, C185, C195, F232, C237, F239, Y243, W253, F254, I256, V263, L265, M278, F279, A282, I290, Y292, Y293, I300, A309, A312, F313, Y314, Y316, L318, V329, A336, C339, L347, C349, Y351, F354, V360, Y361, F366, A368, C383, F404, C407, Y409, L411, L414, L415, L417, V420, F423, C425, A434, C437, Y438, F446, A461, I464, F467, Y469, C478, A482, Y497, C503, I573, Y577, V584, C585, C603, Y606, V616, F617, C620, V631, Y632, Y648, Y649, C650, C654, V655, V657, V659, V661, I662, Y663, A671, L673, V677, C679, L697, L707, V711, C713, V724, C727, L729, L731, L735, C736, A737, V770, I782, F786, I795, V802, C806, V810, C811, C817, L821, Y824, F827, C828, L835, L893, L894, F895, V898, Y909, C912, L923, C925, V934, L935, Y947, W960, A968, F972, Y978, V989, L990, I997, F1001, A1004, A1007, F1012, A1018, V1026, A1030, A1032, L1033, L1036, L1040, F1044, A1046, I1047, A1049, I1054, L1058, A1065, I1067, L1070, I1071, L1075, L1078, A1080, L1086, V1103, C1106, V1107, F1116, C1117, I1123, V1127, A1130, L1134, F1136, Y1141, L1155, C1156, A1166, Y1171, F1172, W1184, Y1192, I1197, V1209, Y1211, L1223, L1260, L1262, M1266, L1276, Y1280, I1281, C1320, C1323, C1327 |
| 12 | Serine/threonine-protein kinase Sgk1 (EC 2.7.11.1) | O00141 | A115, V126, F158, F166, L172, F174, V175, L184, A199, Y202, A203, A204, I206, A207, A209, L210, L223, I228, L230, I236, L238, A265, V278, W280, W281, C282, L283, A285, V286, L287, M290, A324, L327, L328, L331, I349, F355, L363 |
| 13 | AP-4 complex subunit mu-1 | O00189 | V187, L189, V191, L195, I199, V210, I214, L216, M226, I228, L230, F234, V250, L270, V281, M282, Y284, L286, F296, L311, V313, L315, L317, C319, A327, V330, L332, L334, L347, W363, L365, V368, M380, A405, L407, F409, L411, L419, Y449 |
| 14 | Toll-like receptor 4 | O00206 | Y38, C40, L59, L61, L69, F74, F77, L80, L83, L85, C88, I90, I93, A97, Y98, L101, L104, L107, L109, I114, A121, F122, L125, L128, L131, A133, L141, I146, L149, L152, L155, V157, A158, I162, F165, L167, F171, L174, L177, L180, L182, I187, I190, L195, V197, L198, L203, L206, L208, L210, M215, I218, A222, F223, I226, L228, L231, L233, M243, C246, I247, L253, V255, L258, L260, F272, A276, L277, L280, F288, L290, Y296, L297, I300, L303, F304, L307, V310, F313, L315, V318, I320, V323, F326, F330, W332, L335, L337, C340, F342, L348, L350, L353, L356, F358, G363, L372, L375, L378, L380, L385, F387, C390, C391, F396, L401, L404, L406, I412, M414, F418, L421, L424, L427, F429, M437, V442, F443, L446, L449, I450, L452, I454, V461, I466, F467, L470, L473, L476, M478, F483, L488, F492, L495, L498, L501, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | L503, C506, L508, A515, F516, L519, L522, V524, L525, M527, F532, F533, L535, Y540, L543, L546, L549, Y551, I556, L571, L574, L576, F581, F590, L591, I594, L600, M607, V620 |
| 15 | Tumor necrosis factor receptor superfamily member 10A | O00220 | C132 |
| 16 | Agouti-related protein | O00253 | C94, C119 |
| 17 | Tubby-related protein 1 | O00294 | V295, C307, L309, L326, L337, I352, I367, L370, V381, F382, L403, A404, A405, V406, V423, I424, I425, I437, L446, L461, I493, V503, L504, F506, F514, L516, Y518, L522, C523, A524, L525, A527, F528, A529, I530, A531, L532, L539 |
| 18 | Tumor necrosis factor receptor superfamily member 11B | O00300 | C41, C44, C65, C124 |
| 19 | Krev interaction trapped protein 1 | O00522 | A10, V12, A13, V14, I15, Y28, Y33, I35, L36, L37, L54, I68, V72, A108, L110, I112, V113, L135, L152, M156, L157, L160, L164, I174, L292, H293, A296, L304, A323, I325, H326, A328, C329, A336, L340, C346, A362, A363, I370, V371, L374, C396, A407, I424, V434, V444, I447, I463, I465, W487, L491, L508, I522, A527, I528, I530, L531, A535, L539, A546, L551, I552, L554, A555, L557, L558, L559, H571, I584, V585, L590, A594, I601, Y605, L621, F625, L626, C629, I632, V658, V660, V662, L667, H668, L669, L670, F697, I699, V710, A715, V718, L722, L725 |
| 20 | C-C motif chemokine 21 | O00585 | L63, F64, C75, A76, V83 |
| 21 | Lysosomal alpha-mannosidase | O00754 | A241, Y306 |
| 22 | Receptor-type tyrosine-protein phosphatase T | O14522 | F74, M75, V77, A88, L90, L92, H101, F105, L120, V122, V124, V135, A149, L151, A152, I153, Y161, V163, F165, I177, A178, V179, V184, F211, C213, L227, A250, V252, Y265, C267, V268, I269, V277, A281, L305, I307, V325, I358, L362, L403, L405, C417, V424, L449, I458, L460, L462, L464, I502, I504, Y519, I521, F553, Y562, F564, I566, A568, V578 |
| 23 | Tumor necrosis factor receptor superfamily member 10B | O14763 | C81, C139 |
| 24 | Tripeptidyl-peptidase 1 | O14773 | L49, F51, A52, L61, V65, L80, L82, V85, A86, V89, V99, A105, F119, C122, L124, I126, A129, L133, F138, V150, Y157, L159, V167, F169, V170, L173, V200, Y209, A226, C227, A228, F230, L240, F243, V277, Y279, L280, M281, A283, A285, I287, F304, L305, W307, L308, V320, H321, V323, Y336, I337, V340, L344, A347, A348, A349, L355, F356, A363, F378, A380, V385, V388, F397, V404, V426, A448, V452, A453, A454, L455, Y459, V461, V462, V471, A476, V480, F481, I484, L485, L487, I488, V518, H523, C526, F536, V545, L556, L560 |
| 25 | Tumor necrosis factor ligand superfamily member 11 | O14788 | L168, I170, L184, L206, V208, Y214, L216, A218, I220, F222, L238, V240, V242, L283, I289, I291, V293, A310 |
| 26 | Growth/differentiation factor 8 | O14793 | C281, C282, C372, C374 |
| 27 | Ras-related protein M-Ras | O14807 | L11, Y14, L16, V17, V18, V19, V24, L29, F33, V39, I56, A61, I62, L63, V65, L66, A69, M77, M82, F88, L89, I90, V91, Y92, V94, V103, F106, I110, V113, F119, M121, I122, L123, V124, A125, I136, A145, A157, V164, A167, F168, L171, V172 |
| 28 | Tumor necrosis factor receptor superfamily member 13B | O14836 | C89, C100, A101 |
| 29 | Interferon regulatory factor 6 | O14896 | W449 |
| 30 | Natural cytotoxicity triggering receptor 3 | O14931 | A35, L37, C39, A49, F56, H89, A91, I95, V98, I105, Y106, C108, V110, V112, L125 |
| 31 | Peripheral plasma membrane protein CASK | O14936 | F8, C15, V26, C29, V40, V45, F48, L59, L69, I74, L77, L87, M89, V90, F91, L99, C100, I103, Y113, A118, M122, I125, L126, A128, L129, C132, I137, I138, H139, V142, C146, V147, L148, L149, V158, L160, A166, A187, V191, V202, W203, C205, V207, I208, L209, F210, I211, L212, L213, F227, I230, W242, A249, L252, V253, M256, V267, A270, W275, L276, L295, A310, V312 |
| 32 | Cyclin-G-associated kinase (EC 2.7.11.1) | O14976 | L40, V42, A57, L68, L71, I82, L92, I98, I107, L122, L130, C145, V148, L149, I151, F152, C156, A158, V159, M162, H171, L179, L181, I187, L189, F192, I198, I246, L249, L253, L256, F288, I292, M295, V309, L313, A317, I328, F525, V640 |
| 33 | Synapsin-3 | O14994 | L94, L95, V96, I97, W104, F126, C139, V141, I162, L163, V164, V181, V192, L211, F223, V226, V246, V247, V261, F267, V273, V274, A281, I295, A304, Y305, W335, V336, C339, I348, C349, A350, V351, A353, I363, M371, M385, A386, V389 |
| 34 | Spectrin beta chain, non-erythrocytic 2 | 015020 | F63, W66, V67, L71, L81, L85, L91, L92, L94, L95, V119, A122, L123, L126, L133, I141, V142, L152, V153, I156, I157, I162, I165, L182, C186, V198, F201, W205, A210, F211, A213, I214, V215, L228, H234, L237, A240, F241, A244, L253, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | L254, V259, I269, I270, Y272, V273, A274, Y276, Y277, L2225, A2238, V2246, C2248, L2250, L2255, F2257, L2278, V2295, F2296, L2298, F2308, A2310, W2319, V2323, A2326 |
| 35 | Niemann-Pick C1 protein | O15118 | W27, V59, C63, L73, C74, C75, L80, L94, C97, C100, L104, L107, C113, L121, V141, L144, Y146, V148, F152, A153, M156, A159, C160, V163, A172, L173, C177, W189, I190, F194, C227, C243, L408, I410, F431, L435, V443, L444, L446, I450, V462, L464, I467, C479, I481, V484, L485, Y487, F488, L495, A507, H510, H512, C516, C533, V541, L545, V546, L547, A558, L561, I563, F565, V567, A580, W583, F587, L649, L656, A659, L720, L724, V727, F763, A1035, F1100, A1124, M1138, M1228 |
| 36 | Laminin subunit alpha-5 | O15230 | L273 |
| 37 | Phosphomannomutase 2 | O15305 | L8, C9, L10, F11, L17, M28, F31, L32, L35, I41, V43, V44, V52, L56, V60, Y64, V67, F68, L73, A75, I87, L99, C103, M126, L127, V129, I132, F144, F157, L161, I178, F180, V182, C192, L193, V196, F206, F207, I220, C241 |
| 38 | Phosphatidylinositol 3,4,5-trisphosphate 5-phosphatase 2 (EC 3.1.3.86) | O15357 | A31, L34, L35, F44, L45, V46, A55, L58, C59, V60, I71, V81, V87, L98, I99, Y102, L113, V117, I424, V426, F427, I428, W431, I466, V468, F469, L489, I508, V510, A511, V512, L513, V514, A543, V544, V546, F548, F550, F555, F557, C560, H601, F603, F605, L608, Y610, I619, L631, L637, V646, F657, W688, C689, I692, L693, Y707, C709, I713, V721, F722, V727, M1201, L1205, L1217, L1228, L1236, V1241, L1250 |
| 39 | Eukaryotic translation initiation factor 3 subunit H | O15372 | V36, V39, V45, L67, I78 |
| 40 | Neural cell adhesion molecule 2 | O15394 | L32, F40, C42, A44, W53, L78, I80, A83, C93, A95, V107, A132, V134, C136, I173, I176, Y184, C186, V190, I201, V203, V205, A220, A222, F230, C232, W244, L266, V268, I271, Y279, C281, A283, A294, L296, I304, L320, C322, W334, F343, I354, L365, I367, V370, Y378, C380, A382, M393, I418, I420, C422, V424, W434, L460, I462, Y473, C475, A477, Y488, A493, A512, V514, F516, Y530, V532, L556, I567, V569, A570, A571, L611, I613, A621, V628, L653, L656, V664, I666, A668 |
| 41 | Toll-like receptor 3 | O15455 | A35, C37, I53, L56, L58, L63, L66, F71, Y74, L77, L80, V82, I87, L98, L101, V103, L104, L106, L111, F119, L125, L128, L130, I135, F143, L149, L152, L154, L164, L170, L173, L176, L178, I183, L186, L191, I193, F194, L199, L202, L204, I209, C216, F217, L223, L226, L228, V231, L241, C242, L245, I250, L253, L255, L260, F268, L269, L271, L276, L279, L281, L286, V289, F294, L297, L300, F303, L305, I310, L313, L318, L321, V324, L327, L329, F351, L354, L357, L360, M362, F375, L378, L381, L384, L386, L396, F401, L404, L409, H410, L412, L414, I419, I422, A426, F427, L430, L433, L436, L438, L440, I443, L447, W452, L455, I458, I461, L463, L469, L471, F476, V479, L482, L485, L487, V490, L492, V495, F502, L505, L508, L511, L513, I521, M525, L526, L529, L532, L535, L537, L542, L545, W546, F557, L558, L561, L564, L567, L569, F574, F582, L585, L588, I591, L593, L595, L598, L601, F606, L612, L615, L617, I622, V625, A633, F634, L640, M642, F647, I654, F657, Y675, V688 |
| 42 | Fibroblast growth factor 10 | O15520 | L82, L90, I92, L111, I113, V123, A125, L132, A133, M134, C150, L152, Y164, M176, V178, A179, L180, A199, F201 |
| 43 | Leucine-rich repeat transmembrane protein FLRT2 | O43155 | I75, L100, I121, L129, L132, L135, L138, L140, I159, L161, L163, L164, L166, L185, A193, L203, L206, L209, V211, L215, L216, F235, I237, L254, L257, L259, L278, L281, L288, L291, F296, L299, L305, I318, L325 |
| 44 | Kunitz-type protease inhibitor 2 | O43291 | C84, C133, C179 |
| 45 | Desert hedgehog protein | O43323 | A59, V67, A95, M99, C103, V107, L110, A111, V114, L123, V125, W129, L140, H141, A146, L147, I149, Y159, L161, L162, A163, A166, V174, V182, V184, V186, A188, V194 |
| 46 | Glutamate receptor ionotropic, delta-2 | O43424 | V445, V446, F453, V454, F470, V474, L475, L478, A491, L508, V509, A517, I519, I521, L524, V534, V547, L548, L549, L562, L671, Y679, M708, I712, V732, A738, F739, V740, V745, L746, F758, Y770, I772, A773, L774, F784, I788, M797 |
| 47 | Tumor necrosis factor ligand superfamily member 14 | O43557 | A96, L98, L112, A132, L133, V135, Y141, I143, V147, L149, I162, H164, L166, L180, V215, V216, V217, L224, F235 |
| 48 | Carbonic anhydrase 12 (EC 4.2.1.1) | O43570 | W43, I58, L60, Y79, L89, V96, L98, M104, I106, L118, L120, H121, W122, H133, A142, L144, H145, I146, H148, A160, A168, L170, A171, V172, L173, I174, Y183, I186, L190, V193, V202, I207, L210, C230, V234, W236, V238, F239, I245, L250, L251, L253, A256, L257, M270, V285 |
| 49 | Alpha-actinin-4 | O43707 | F56, W59, C60, L64, F78, L82, L84, L87, L88, V112, A115, L116, I119, L126, A131, I134, V135, L143, M145, I146, I149, I150, A154, I155, I158, L169, C173, V185, F188, W192, A197, F198, A200, L201, I202, L215, V221, L224, A227, F228, A231, M240, A243, I246, A256, I257, M258, Y260, V261, F264, Y265, A274, A415, F418, A422, L436, I449, I473, L480, V491, I498, L505, L516, H530, Y533, A537, M544, I563, L577, I587, A594, L605, I619, V626, L637, M679, I719, I743, M815, I880 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 50 | EGF-like repeat and discoidin I-like domain-containing protein 3 | O43854 | C59, C116, C154, M325, W351, A356, A366, W367, L378, V380, V388, I391, A396, V405, Y408, L410, A411, Y422, A453, I456, I458, I467, L469, L473 |
| 51 | Tolloid-like protein 1 (EC 3.4.24.—) | O43897 | A148, A149, W157, I162, F178, A181, W185, V191, I203, F205, I226, V238, V239, L242, V245, I246, F248, H250, H252, V261, I268, F276, I296, M297, H298, I313, A340 |
| 52 | Peroxisome biogenesis factor 1 | O43933 | V19, V108, I155 |
| 53 | Kalirin (EC 2.7.11.1) | O60229 | L2148 |
| 54 | Cubilin (460 kDa receptor) | O60494 | Y952, I962, I970, L1020, F1024, I1037, Y1068, C1074, Y1076, I1086, L1095, L1107, I1109, F1143, F1154, A1156, C1191, W1193, L1195, A1202, F1203, M1255, F1270, A1272, V1281, L1291, C1306, W1308, V1318, V1368, L1370, F1382 |
| 55 | Gremlin-1 | O60565 | C178 |
| 56 | Toll-like receptor 5 | O60602 | L72, L75, L94, L97, A114, L121, L124, L144, L147, I157, L169, I175, F177, I182, L190, L314, L317, L338, L341, L359, V362, I365, A425, V447, L450, L475, V497, L507, L531, L553, I555 |
| 57 | ATP-binding cassette sub-family C member 9 | O60706 | M702, I703, V704, C709, L714, L715, A717, I718 |
| 58 | Voltage-dependent L-type calcium channel subunit alpha-1F | O60840 | A252, A700, I707, A1015, V1082, A1095, Y1120, A1372, M1389 |
| 59 | Matrix metalloproteinase-20 | O60882 | L45, Y49, L75, L81, L122, I126, V138, A141, V142, A145, L146, A148, W149, V153, L155, A165, I167, I169, F171, A190, F193, F205, W211, L220, F221, V223, A224, A225, F228, A231, L232, L234, A242, L243, M244, Y245, Y250, L258, V263, I266, L269 |
| 60 | Low-density lipoprotein receptor-related protein 5 | O75197 | L35, L36, F37, A38, V43, L62, A65, A67, V68, V77, Y78, W79, V82, A86, I87, L113, L122, Y123, W124, I132, V134, M165, Y166, W167, I176, A179, M181, V190, A212, I219, A242, L250, W252, I260, H261, I284, V286, L309, L311, L312, C321, C323, L344, L345, L346, A347, I355, L357, A375, Y388, W389, A396, I397, L430, Y431, W432, I440, V442, M473, Y474, W475, I484, A487, L489, L517, W519, I530, L545, I568, L588, M589, C605, L615, C616, F617, C627, I1274, C1323 |
| 61 | Core histone macro-H2A.1 | O75367 | A19, F23, V25, M28, I32, H36, V43, A45, V47, Y48, M49, A50, A51, V52, L53, L56, I60, L61, A64, A67, A68, V76, H80, I81, L83, V85, L91, V98, A101, L197, L199, I200, I204, L207, A208, F210, A214, I215, I216, I223, L233, F241, V245, L255, A258, A270, V273, I274, H275, C276, L290, V294, C297, L298, A301, I309, A310, F311, I314, A326, A327, I330, L331, A333, I334, F338, I346, V349, F351, Y362, M366 |
| 62 | Filamin-B | O75369 | F22, C26, L30, I37, L40, L44, L50, I51, L53, L54, V80, V82, A83, L84, F86, L87, I92, I102, I110, L111, L113, V114, L117, I118, I123, L145, W148, I149, I153, F161, W165, A170, L171, A173, L174, V175, A179, C183, A198, A201, M202, A205, L209, V211, V214, I215, I220, V230, M231, Y233, L234, F237, A257, A275, V279, A284, V291, V317, H327, V329, V331, F333, I338, V345, V1043, F1061, I1063, A1068, V1097, Y1099, Y1107, V1109, I1111, I1118, A1125, I1127, V1136, A1138, V1156, A1161, A1170, V1192, Y1194, Y1202, L1204, M1206, Y1208, V1220, I1231, V1243, F1251, V1253, I1270, Y1290, V1292, Y1294, H1302, V1304, V1306, V1320, V1331, A1341, F1349, V1351, A1356, A1385, Y1387, Y1395, V1397, I1399, I1406, V1413, V1424, V1435, V1445, A1450, V1459, V1481, V1493, V1495, Y1497, I1502, V1509, V1511, V1520, V1532, A1534, F1540, I1542, A1544, A1547, I1556, V1578, Y1580, Y1588, I1590, V1592, Y1594, I1599, I1606, A1608, A1614, C1617, F1636, V1638, A1643, V1648, V1652, I1674, A1678, Y1684, I1686, V1688, I1695, V1702, A1704, V1755, V1764, V1784, V1786, H1796, M1798, I1800, I1807, V1824, F1842, I1844, V1878, Y1880, Y1888, I1890, V1892, A1906, I1908, I1964, F1966, H1974, V1976, I1978, V1994, A2002, A2005, F2023, V2025, V2059, Y2061, Y2069, V2071, F2075, V2087, I2089, V2133, H2153, V2155, H2165, V2167, V2169, V2185, V2196, F2214, I2216, V2250, Y2252, A2254, Y2260, V2262, I2264, I2271, V2278, V2280, I2281, A2287, L2290, L2300, I2310, L2312, A2315, I2319, V2323, V2345, H2355, I2357, V2359, F2361, V2373, V2387, L2394, F2405, I2407, A2412, V2440, Y2442, Y2450, I2452, V2454, Y2456, I2462, A2469, A2512, V2515, A2525, V2535, C2537, V2571, V2575, V2585, W2587, I2592, V2599 |
| 63 | Vacuolar protein sorting-associated protein 26A | O75436 | F42, V48, V52, H65, I68, I70, F72, V73, I76, L101, F111, V114, V126, L128, Y130, F131, L132, V134, V151, M166, L174, I176, F178, Y180, Y185, I191, I195, M207, L209, L211, A231, I246, I248, L250, L252, F268, V270, Y272, L274, L276, L278, I292 |
| 64 | Low-density lipoprotein receptor-related protein 6 | O75581 | L23, L24, Y25, A26, L31, V34, V47, L50, A53, A55, V56, F58, V59, I65, Y66, W67, V70, A74, I75, V90, V91, L94, L100, C102, L109, Y110, W111, I119, V121, L128, M152, Y153, W154, I163, A166, M168, I177, L189, L196, Y197, W198, A199, I206, A218, V219, L224, A229, L232, L237, Y238, W239, I247, L248, A249, C250, I271, A273, L296, C297, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | L298, M299, C308, C310, L317, L331, L332, L333, A334, L339, I342, L344, A362, Y375, W376, A383, I384, A414, L417, Y418, W419, I427, V429, L453, M460, Y461, W462, I471, A474, A475, L476, V485, A496, I504, W506, M517, I532, W547, I555, L575, M576, C592, L602, C603, L604, C614, L634, L635, F636, I642, I645, A664, A666, I676, Y677, I686, A689, V700, V712, L719, Y720, W721, A722, I729, V731, L755, M762, W764, I773, A776, A777, M778, V787, A793, I798, L805, W807, I815, A829, L832, I845, W847, I855, A858, I869, V876, V881, C893, L903, C904, A906, L936, L937, F938, I944, L959, V967, A969, L979, Y980, W981, I982, I989, A992, Y1027, I1028, Y1029, C1032, I1038, V1040, V1051, L1052, A1061, V1062, M1071, Y1072, F1073, I1083, A1086, A1087, L1088, L1116, F1117, W1118, A1119, I1126, L1157, W1159, I1160, I1167, L1188, C1207, I1217, C1218, L1219, C1313 |
| 65 | Oral-facial-digital syndrome 1 protein | O75665 | M834, H851, V852, A854, A858 |
| 66 | Protein XRP2 | O75695 | V57, F62, I64, C67, C70, I72, I74, F75, V81, I83, C86, C89, I91, F92, L93, V96, V100, F102, C105, C108, C110, L112, A113, C114, F117, V119, C122, L125, V127, L129, C131, I137, I143, F145, F148, W150, Y152, L155, F157, F159, A162, F167, W171, L189, V195, V199, L207, V221, C236, L237, V238, V239, A248, A250, L253, M257, V270, A277, V280, A285, V297, A299, L300, F302, A307, V308, C311, A333, F340, A344 |
| 67 | Gap junction beta-3 protein | O75712 | L25, A39, W44, F51, C60, C64, W77, V84, I92, L135, L149, C164, V167, C176, M191, C198 |
| 68 | Isocitrate dehydrogenase [NADP] cytoplasmic | O75874 | V10, V11, M13, M18, I21, I22, W23, L25, I26, L30, I31, V35, L39, L44, I46, A60, A61, A63, I64, V69, V71, C73, A74, I76, I99, I102, V107, F108, I112, I113, C114, I117, W124, I128, I129, I130, H133, A134, A179, I189, F192, A193, F197, M199, A200, L207, L209, F223, I226, F227, F239, I244, M254, A258, F265, I266, W267, A268, C269, V281, A282, Y285, M290, M291, L295, V296, C297, V303, A305, A307, A308, I330, A331, I333, F334, A335, W336, L340, A344, L352, A353, F355, A356, A358, L359, V362, I367, F371, M372, L376, A377, A378, F397, M398, L401, L405 |
| 69 | Tumor necrosis factor ligand superfamily member 13 | O75888 | L219, L225 |
| 70 | Dysferlin | O75923 | L2, V86 |
| 71 | Multiple PDZ domain protein | O75970 | M129, A130, F138, L140, I165, V167, A176, I188, L189, A190, I191, L196, A205, V216, L218, V219, I220, A221, I258, L260, V279, A290, I302, L303, I305, L310, V318, V329, L331, I333, A334, V378, L380, I405, V407, A415, V416, I422, I428, V431, L436, A444, V455, L457, L459, L703, I728, I730, I738, A739, L745, L751, V754, L759, A767, A774, V779, I781, V783, V1152, L1154, L1162, I1185, I1187, A1196, L1202, I1208, V1209, V1211, L1216, A1219, A1224, V1235, F1237, V1239, I1337, L1353, A1365, V1375, F1376, I1377, A1386, L1398, L1399, I1401, L1406, A1414, A1421, V1425, I1427, I1428, F1429, I1430, A1435, I1630, I1632, I1654, I1656, A1664, A1665, I1677, V1680, L1685, A1693, V1704, L1706, L1708, I1726, L1728, V1749, A1760, I1772, V1788, V1799, V1803, I1890, I1892, A1901, I1916, A1929, I1940, M1942, V1944, I1988, L1990, L1997, I2014, V2016, A2025, I2037, V2040, L2045, A2053, L2057, V2064, L2066, V2068 |
| 72 | Nebulette | O76041 | A961, F975, I981, V996, L1005 |
| 73 | Bestrophin-1 | O76090 | V90, V158, F248 |
| 74 | Serine/threonine-protein kinase 10 (EC 2.7.11.1) | O94804 | A53, A62, A64, I82, I84, A86, C88, I93, V94, L106, I108, M109, V118, I121, M122, L125, L129, I134, V136, V137, C138, M141, L142, A144, L145, L148, H155, L158, A160, V163, L164, M165, L167, I171, L173, F176, V178, A180, A200, A218, I220, L223, L227, I228, M230, V245, L246, I249, F267, F270, A274, L275, A285, L288, F293, V294, L303, L306, V307 |
| 75 | Tumor necrosis factor ligand superfamily member 15 | O95150 | A97, L99, L117, M132, L139, I141, Y147, I149, V153, F155, A168, I177, V179, V180, I181, I212, L220, L226, V228, V230, V236, F245, F246, A248 |
| 76 | Interleukin-18 receptor accessory protein | O95256 | L165, I173, C175, W191, C221, A236, V238, C273, A275, F277, W289, V326, F335, C337, V339, V350, L352 |
| 77 | Bile salt export pump (ATP- binding cassette sub-family B member 11) | O95342 | A452, L453, V454, A464, L467, I468 |
| 78 | Tumor necrosis factor receptor superfamily member 6B | O95407 | C49, C52, C91, C132 |
| 79 | Apolipoprotein M | O95445 | F49, I50, A51, A53, A54, I69, V70, L145, L146 |
| 80 | Gap junction beta-6 protein | O95452 | I25, A39, W44, F51, C60, C64, H73, W77, V84, A92, I140, F154, C169, I171, C180, M195, C202 |
| 81 | Follistatin-related protein 3 | O95633 | V37, W39, A70, V134, C135, C146, L148, L159, C195, C211 |
| 82 | Interleukin-33 | O95760 | A124, L126, I134, V159, L160, L161, M183, V184, L186, L194, A196, V203, A216, F217, F218, V219, C227, F230, C232, I240, L247, A248, F265 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 83 | EGF-containing fibulin-like extracellular matrix protein 2 | O95967 | C71, C109, C162, C241, C281 |
| 84 | Cytochrome b5 | P00167 | I17, L28, I29, L30, V34, L41, L51, A55, L84 |
| 85 | L-lactate dehydrogenase A chain | P00338 | I23, V25, V26, V28, A34, C35, A36, I39, L40, M41, A45, L48, A49, L50, V51, L58, L91, V92, I93, I94, L109, V110, V114, F117, F119, I120, I121, V124, C131, L133, L134, I135, V136, V140, I142, L143, V146, A147, V158, I159, C163, F170, M174, C185, V189, L190, V198, V200, M204, V206, L218, V230, V234, V256, A257, L259, A260, I263, V273, I277, I283, V287, F288, L289, V291, C293, L295, L316, A320, L323 |
| 86 | NADH-cytochrome b5 reductase 3 | P00387 | L45, L47, F60, F62, L71, L73, I79, L81, V106, L108, V109, I110, M127, L131, F142, L149, F157, V175, M177, I178, A179, I184, M187, L188, V190, I191, I194, C204, L206, L207, F208, I216, L217, L218, L222, F233, Y237, L239, I258, L270, V271, L272, M273, C284, L288 |
| 87 | Cytochrome c oxidase subunit 2 | P00403 | I83, I97, W106, Y108, V142, L144, I150, M152, I154, H161, W163, A164, V165, L168, A174, F184, M207, I209, V210, L211 |
| 88 | Phenylalanine-4-hydroxylase | P00439 | A34, I35, L37, F39, V51, F55, F79, F80, L83, L91, I94, L98, A104, L109, W120, I125, L128, F131, A132, A165, W187, V190, F191, L194, A202, C203, Y206, L213, F219, I224, L227, V230, F233, L234, F240, L255, L258, A259, F260, V262, F263, C265, Y268, I269, I283, C284, L287, L288, H290, V291, L293, F294, F299, A300, F302, I306, A309, L311, A313, I318, L321, A322, I324, F327, V329, L333, I340, A342, Y343, A345, L347, L348, L354, C357, A373, L385, Y386, Y387, A389, A395, V399, F402, A403, I406, F410, I421, L424, I432, A434 |
| 89 | Superoxide dismutase [Cu—Zn] (EC 1.15.1.1) | P00441 | A5, C7, L9, V15, I18, I19, F21, V30, V32, I36, L39, H44, F46, H47, V48, H49, A61, H64, H72, H81, V82, L85, V88, A90, A96, V98, V104, I105, L107, I113, I114, L118, V119, V120, H121, A141, A146, C147, I150 |
| 90 | Coagulation factor VIII | P00451 | L26, A28, L90, L91, I95, I105, L107, V115, L117, A119, A131, V147, Y155, W157, Y177, L191, I192, A194, L196, V197, C198, L217, F218, A219, F221, H251, V253, Y256, V272, W274, V276, I277, I288, F295, I307, A315, L319, C329, M339, A341, V343, V345, I405, A406, A407, Y414, A415, L431, Y442, V445, F447, I467, L472, L480, I482, F484, Y492, I494, L517, Y530, W532, Y552, L566, I567, L570, L571, I572, C573, L594, F595, F598, Y605, M633, I636, V640, V648, W656, I658, V670, F677, L689, V697, M699, M701, L709, C711, M721, A723, L725, I1719, A1720, A1721, V1752, V1753, F1754, H1774, L1775, L1777, L1778, I1782, A1784, I1790, V1792, F1794, Y1802, F1804, V1826, W1836, V1838, M1842, C1851, A1853, Y1856, H1867, L1870, I1871, L1874, L1875, V1876, C1877, V1892, F1895, A1896, L1897, F1899, F1902, F1937, H1938, A1939, I1940, L1948, L1951, M1953, A1954, I1959, W1961, Y1962, L1963, L1964, H1973, I1975, F1977, F1982, L1997, V2005, V2017, C2019, M2029, F2033, V2035, M2046, A2066, A2070, A2080, W2081, I2099, I2100, H2101, A2108, I2117, F2120, I2122, Y2124, Y2134, F2145, I2163, I2164, A2165, L2181, L2185, M2186, C2188, C2193, M2199, I2209, A2220, W2222, A2227, A2237, W2238, L2249, V2251, F2253, V2259, V2262, V2267, M2274, V2276, F2279, I2281, F2302, L2316, L2325, I2327, I2336, A2337, L2338, M2340, V2342, A2347 |
| 91 | Coagulation factor XIII A chain | P00488 | L46, H65, Y70, L75, I76, V77, F83, V85, I87, F89, F100, V102, Y104, V105, I106, V120, A133, V136, V143, L145, I147, V155, F158, Y161, V162, A163, Y182, I183, L184, F185, V194, L196, Y205, V206, I213, F214, W226, I235, C239, V242, M243, L250, V259, M266, V275, L276, A292, W293, I299, Y303, V310, C315, W316, V317, F318, A319, V321, F322, L326, C328, L329, I331, A333, V336, Y339, A342, L349, I353, L355, Y373, H374, C375, W376, A379, M381, F390, A395, V396, C410, A413, A417, I418, H420, H422, A429, V432, F433, A434, V436, L440, I441, Y442, I461, I465, V466, Y482, L493, A498, V519, M521, F523, F534, L536, I538, F540, I550, A552, Y553, L554, A556, I558, Y561, V576, L578, I590, Y595, L605, H606, F607, F608, V609, A611, I613, V619, L620, L628, V642, M647, V649, V651, F653, L661, V664, V666, L668, I684, C696, L706, I707, A708, M710, L715, H717, V718, V724 |
| 92 | Hypoxanthine-guanine phosphoribosyltransferase | P00492 | V35, I37, I42, L49, A50, V53, M57, I62, V63, A64, L65, C66, L68, F74, F75, L78, L79, I82, I93, I100, L125, V130, L131, I132, V133, I137, M143, L146, L149, V150, V160, A161, L163, L164, F181, I183, V188, V189, Y191, A192, F199, L202, V205, C206, V207 |
| 93 | Tyrosine-protein kinase ABLI (EC 2.7.10.2) | P00519 | L88, C100, A102, V111, W127, A137, L141, F149, L150, V151, I163, L165, A179, L198, V199, H202, L213, A217, I242, V268, V270, F283, L284, A287, V289, M290, I293, L298, L301, V304, C305, Y312, I313, I314, L323, L327, V335, V339, L340, M343, A344, I347, A350, M351, L354, I360, H361, L364, A365, A366, C369, V371, V377, V379, F382, L384, F401, A407, L411, V422, W423, F425, V427, L428, L429, Y440, V448, L452, M458, C464, M472, C475, W476, F486, I489, F493 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 94 | Epidermal growth factor receptor (EC 2.7.10.1) | P00533 | L41, F55, C58, V61, L65, I67, V70, L79, I82, V85, Y88, V89, L90, I91, A92, V96, I99, L101, L104, I106, I107, A118, L119, A120, V121, L132, L135, M137, L140, I143, A147, V148, F150, L156, V159, I167, V168, C199, W200, C223, C236, A237, A238, C240, C260, V300, V301, C326, C337, I340, F345, I351, I356, F359, C362, I365, L369, I371, V374, A375, L392, L395, V398, I401, L405, L406, I407, L417, A419, F420, L423, I426, L438, A439, V440, V441, L443, I445, L448, L450, L453, I456, V461, I463, L469, C470, Y471, A472, I475, L480, C499, C510, C515, W516, C571, C624 |
| 95 | Adenylate kinase isoenzyme 1 | P00568 | L5, I10, F12, V13, V14, C25, I28, I60, L73, L76, M80, F90, L91, I92, Y95, F105, I109, L114, L115, L116, V118, M125, I146, V160, Y164, V173, V186 |
| 96 | Prothrombin (EC 3.4.21.5) | P00734 | Y87, C90, A93, L100, C103, A109, Y116, C129, C157, W168, C169, Y170, C181, I183, A242, C262, V272, W273, C274, Y285, C286, V295, F324, F329, C336, L355, I364, V365, A370, M374, W377, V379, M380, L381, F382, L390, C391, A393, L395, I396, W400, V401, L402, A404, A405, H406, C407, L408, L409, L422, L423, V424, I426, L444, H450, I463, A464, L465, M466, L468, V472, I478, H479, V481, C482, L483, A489, L492, L493, A495, V501, W504, L507, L523, V525, V526, L528, I530, V531, C536, I544, M548, F549, C550, A551, A563, C564, F572, V573, M574, W582, M585, I587, V588, C594, Y600, F602, Y603, H605, V606, F607, L609, W612, I613, V616, I617 |
| 97 | Coagulation factor IX (EC 3.4.21.22) | P00740 | C128, V132, V227, A233, V242, V243, L244, I256, V257, I262, V263, A265, A266, I275, V277, V278, A279, I316, A317, L318, L319, L321, V331, V353, W356, L369, V374, C382, F395, C396, A397, H415, V416, L425, I428, I443, Y444, V447, Y450, V451, I454 |
| 98 | Coagulation factor X (EC 3.4.21.6) | P00742 | C121, C136, I235, V236, C241, C246, A250, L251, L252, I253, C261, I265, L266, I271, L272, A274, A275, C277, V286, V288, V302, I309, H311, I323, A324, V325, L326, L328, V338, A341, C342, A349, L353, G359, V361, F364, L377, M379, L380, V382, C390, L392, M402, C404, A405, H423, V424, F432, V433, I436, A444, I451, Y452, V455, F458, W461, I462 |
| 99 | Complement factor D (EC 3.4.21.46) | P00746 | I26, L27, M40, A41, V43, C51, V54, L55, V61, L62, A64, C67, V78, L80, L115, L116, L117, L118, L120, L126, L133, C148, V150, A151, W153, V169, L171, C179, I189, L193, C195, A196, C204, L212, L218, V221, V222, C229, Y238, V241, I248 |
| 100 | Plasminogen (EC 3.4.21.7) [Cleaved into: Plasmin heavy chain A; Activation peptide; Angiostatin; Plasmin heavy chain A, short form; Plasmin light chain B] | P00747 | A31, C49, C53, C61, A63, F64, C73, M76, Y111, W127, C152, W163, C164, Y165, C176, I178, M186, Y193, W209, H217, Y219, C234, W244, C245, F246, C257, I259, Y283, C296, W299, L319, C324, W334, C335, H336, C347, I349, Y385, C398, W401, H407, H409, L421, C426, W436, C437, F438, C449, L451, Y489, C502, W505, H513, C531, W542, C543, Y544, C555, V557, C577, V581, W594, V596, L598, C607, L611, V617, L618, A620, C623, Y633, V635, I636, L637, V654, I666, A667, L668, L669, L671, V681, I682, A684, C685, C699, I701, W704, L716, A719, L721, V723, C729, L735, L744, C745, A746, H748, L764, V765, C766, Y772, L774, V777, A785, V792, Y793, V794, V796, F799, V800, I803 |
| 101 | Coagulation factor XII (EC 3.4.21.38) | P00748 | C135, V158, C161, C163, C209, A388, A389, A398, L401, L408, A410, A411, L414, V425, L427, L462, A463, L464, L465, L467, V482, C500, A503, W505, C532, C548, A549, L567, V568, C569, L580, I583, V598, V602, I609 |
| 102 | Complement factor B (EC 3.4.21.47) | P00751 | L58, A96, C103, Y121, I127, C145, C158, C165, V177, V187, C205, M223, V230, A231, F234, L235, I242, M269, I271, Y272, L273, V274, L275, I281, F286, A289, C292, L293, I297, V300, Y309, L311, V312, Y314, A315, V322, V324, V335, L339, I342, A358, L359, V362, V383, I384, I385, L386, M387, L391, V401, I405, L409, I411, Y426, V427, F428, V430, I439, A443, H451, F453, V455, M458, L461, V464, F465, M468, V481, W495, A497, I499, V501, C511, M512, A514, V515, V516, F520, V521, L522, A524, A525, C527, F528, V530, V539, V541, I569, V577, A578, L579, I580, L582, C596, C599, A606, L607, L622, I628, A630, L631, F632, V633, V645, I647, C656, A660, A663, V669, V675, V676, F680, L681, C682, C695, L703, I704, V705, F711, I712, V714, V716, V721, A738, F741, H742, I743, L745, V748, L752, L756, L761, L764 |
| 103 | Renin (EC 3.4.23.15) | P00797 | I90, I92, F99, V101, V102, F103, V110, W111, V112, C117, A123, C124, F130, V154, I162, I163, V165, V170, M173, F174, M180, V193, V194, M196, F198, I209, F210, I213, V218, V223, F224, F226, Y227, Y228, I242, I262, V266, W267, I269, M271, V274, L288, A289, V291, I298, I305, L308, M309, V322, V323, C325, L331, I334, F336, L338, Y343, L345, Y350, F352, C362, L364, A365, I366, A380, L381, A383, F385, I386, Y390, F393, I400, F402, A403 |
| 104 | Carbonic anhydrase 2 (EC 4.2.1.1) | P00918 | W16, V31, I33, Y51, I59, A65, F66, V68, F70, A77, V78, L79, Y88, L90, F93, H94, F95, H96, W97, H107, A115, A116, L118, H119, L120, V121, H122, W123, A133, V134, L140, A141, V142, L143, I145, F146, L147, V149, L156, V159, V160, V162, L163, I166, F175, F178, L183, L184, L188, Y190, W191, Y193, L197, L202, L203, C205, V206, W208, I209, V210, L211, I215, V217, V222, F225, L228, F230, M240, L250, I255, A257 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 105 | Argininosuccinate synthase (EC 6.3.4.5) | P00966 | V7, V8, L9, C19, I20, L21, W23, L24, V31, I32, A33, Y34, L35, A51, V64, F68, V69, F72, I73, I77, L89, L93, A94, C97, A99, I105, A106, Y113, C132, A143, F150, Y163, A164, L185, M186, H187, Y190, L195, L206, L223, I225, F227, V235, V238, L250, F251, L254, V257, A258, H261, V263, V269, I281, A286, I289, L290, A293, H294, I297, F317, A318, V321, Y322, C331, I338, V345, V349, V351, V353 |
| 106 | Serine protease inhibitor Kazal-type 1 | P00995 | V46, C47, L60, C61, I71, I73 |
| 107 | Antithrombin-III | P01008 | M49, A75, V80, L83, A86, F90, A91, F94, Y95, L98, I108, F109, L110, L113, I115, A118, F119, A120, M121, A126, C127, L131, L134, M135, V137, F138, F140, I143, I151, H152, F153, F154, F155, A156, L158, L162, A166, A175, L178, F179, V197, A200, F207, I218, V222, I230, I234, A238, L242, V244, L245, V246, L247, V248, I251, F253, W257, F261, F271, A281, M283, M284, V301, L302, L304, F306, I311, M313, V314, L315, I316, L317, V327, L331, L343, L348, V349, V350, M352, I357, L363, L367, L372, L375, L383, I386, A388, L394, V396, A399, H401, A403, L405, V407, A414, A415, A416, A419, V420, V421, I422, A423, F434, A436, F440, L441, V442, F443, I444, V447, I453, F454, M455, V458, A459 |
| 108 | Alpha-1-antitrypsin | P01009 | F47, I50, L54, F57, A58, F59, L61, Y62, L65, I74, F75, F76, V79, I81, A82, A84, F85, A86, M87, L88, I100, L101, L104, F106, I111, I116, F120, L123, L124, L127, L134, L142, F143, L144, F154, V158, L161, Y162, V169, F171, A177, I181, V185, I193, V197, V205, F206, A207, L208, V209, I212, F213, F214, W218, F222, V224, F232, V234, V242, M244, M245, F251, I253, L259, V263, L264, M266, Y268, A272, A274, I275, F276, F277, L278, L284, L287, L291, I295, F299, L300, A308, L310, H311, L312, I317, L323, L327, L330, I332, V335, A340, L342, V345, L351, L353, A356, V357, H358, A360, V361, L362, I364, A371, A372, A374, M375, F376, L377, A379, I380, V388, F390, F394, V395, F396, L397, M398, L407, F408, M409, V412, V413 |
| 109 | Angiotensinogen | P01019 | V44, A103, V106, L109, A110, L113, F115, I117, Y118, V133, L134, A138, V139, F140, L143, A144, L146, L158, L162, V164, L175, V180, L181, A183, L184, A186, V187, L191, V192, L203, L205, V208, V209, V211, F212, L217, L219, F223, L227, Y230, F241, A247, M255, V258, L276, A277, F278, Y281, V282, F284, M288, F291, F300, V310, L313, V331, V334, A340, C341, L342, L343, L344, I345, V356, F361, I377, L379, M381, L384, L392, L395, L396, I404, L405, L409, L411, L414, V424, I428, F430, L432, L456, F460, L461, A463, V464, A469, A471, L472, H473, F474, L475, V478 |
| 110 | Complement C3 | P01024 | M25, I28, I29, L34, M42, L44, A46, H47, V55, V57, V59, L76, V86, F88, I90, V106, V108, A110, F112, V117, V121, L122, V123, Y129, I138, Y139, V145, Y147, I149, F150, V152, V163, V165, I167, V188, L189, W204, I206, A208, Y210, F222, V224, F232, Y243, I245, L251, V253, I255, A257, V265, A269, V271, F273, I275, L284, I293, V300, L302, L319, L324, V326, A328, V330, I346, I348, I355, F364, M368, F370, L372, V374, V376, A384, V387, V389, L400, A407, L409, I422, V424, A443, Y446, Y455, L456, L465, V473, F475, I487, Y490, L493, I494, I521, I526, F529, L531, V532, A533, Y534, Y535, L537, V546, V547, A548, V555, I585, A591, V593, V596, A597, V602, I616, W617, V620, V638, F639, A642, L644, F646, C693, C694, M698, M703, V723, F724, C727, C728, I731, W802, A806, V825, F829, L833, V839, V840, V845, I847, A849, L851, L860, V862, V864, L866, A871, C873, A876, I888, V896, Y898, V899, I900, V901, V910, V912, A914, A915, V916, V925, L929, V931, L947, I962, V971, I980, L982, V987, M990, A994, V995, A997, L1000, L1003, C1010, M1015, I1016, M1018, V1022, I1023, A1024, V1025, Y1027, L1028, A1045, I1049, L1057, A1058, F1059, A1065, F1066, A1067, A1068, F1069, A1073, L1078, A1080, Y1081, V1082, V1083, V1085, F1086, L1088, A1089, V1090, L1100, C1101, A1103, V1104, L1107, V1117, F1118, V1124, H1126, M1129, M1141, A1142, A1145, F1146, V1147, L1148, I1149, L1151, A1154, C1158, V1162, L1165, A1172, L1176, Y1180, L1183, Y1187, V1189, A1190, I1191, A1192, A1195, L1196, A1197, L1202, F1210, W1220, L1227, Y1228, V1230, A1232, Y1235, A1236, L1237, L1238, A1239, L1240, L1241, V1249, V1252, V1253, L1256, Y1266, A1271, F1273, M1274, V1275, F1276, A1278, L1279, A1280, Y1282, L1292, L1294, V1296, L1298, I1311, F1330, V1332, A1334, L1342, V1344, Y1348, A1350, F1361, L1386, I1388, C1389, I1402, L1403, I1405, M1407, M1408, F1411, A1412, L1418, L1421, I1429, L1444, I1446, Y1447, V1451, A1460, F1461, V1463, L1471, A1476, V1477, V1479, A1481, Y1482, Y1483, C1489, Y1493, C1518, A1536, Y1543, V1544, Y1545, L1549, F1558, Y1561, M1563, I1565, F1584, C1590, Y1602, L1603, M1604, W1605, Y1620, L1649, F1652 |
| 111 | Complement C5 | P01031 | V24, I25, A27, F31, V33, A35, I39, V40, I41, F50, A52, I54, I56, V71, L73, L85, I87, V102, V106, M117, L126, Y135, V141, V143, V145, Y146, L148, L161, F163, I183, I190, W199, I201, A203, Y205, F217, V219, I238, F246, I248, I250, A252, V260, A263, V265, I267, F269, I271, M283, L292, F301, V307, L310, L323, I325, V327, V329, Y347, L363, I371, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | V373, V375, V388, L390, A418, V428, L431, F433, V435, A448, A454, Y457, L465, I484, V486, Y499, L502, I503, I526, M534, L540, L541, V542, Y543, Y544, L554, V555, L561, I563, V573, V588, L590, M592, V600, A601, L602, A603, A604, V605, A608, V609, L620, A643, V645, F646, A649, L651, F653, I683, A687, V695, C698, C699, C711, C724, I725, A727, F728, C731, C732, V734, A735, V780, W797, I799, V802, I804, C810, V819, V823, V833, I839, L841, V845, Y846, C856, V888, V896, V900, L901, I910, F912, L914, L927, L944, V968, L977, V979, V984, I987, L988, A1008, A1010, L1012, V1015, F1019, Y1020, V1021, Y1024, L1025, L1049, V1068, W1077, L1078, A1080, F1081, A1082, L1083, V1089, L1104, L1107, I1127, L1142, Y1143, A1146, F1147, V1149, I1150, I1152, A1155, C1159, I1164, A1167, L1168, A1171, L1175, F1186, L1188, A1189, I1190, A1192, Y1193, A1194, F1205, I1208, F1227, W1228, A1245, V1248, A1252, Y1253, A1254, L1255, L1256, L1259, V1267, V1270, I1271, W1273, L1274, F1284, I1291, A1293, I1294, L1297, L1303, L1309, M1311, I1313, V1315, M1328, F1333, V1340, L1346, V1348, A1357, V1359, V1361, V1365, I1402, A1404, A1406, Y1408, H1421, A1422, V1423, M1424, I1426, L1439, L1442, F1450, V1460, L1462, I1467, V1475, F1477, I1479, A1491, F1493, V1495, Y1498, H1499, C1505, V1519, A1545, A1552, I1557, Y1559, A1560, Y1561, V1563, Y1577, A1579, L1581, A1590, I1598, F1600, A1609, Y1617, L1618, I1619, M1620, A1624, Y1637, I1645, C1657, F1660, L1664, F1667 |
| 112 | Complement C5a anaphylatoxin | P01032 | C22, C47, A50, C55 |
| 113 | Cystatin-C | P01034 | V49, A52, A56, L90, V92, L94, G95, C109, C123, F125, I127 |
| 114 | GTPase NRas | P01111 | Y4, L6, V7, V8, V9, A11, V14, L19, L23, V29, V44, I46, C51, L52, L53, I55, L56, A59, M67, M72, F78, L79, C80, V81, F82, A83, I84, F90, I93, L95, Y96, I100, V103, V109, M111, V112, L113, V114, L120, V125, A130, A134, A146, V152, A155, F156, L159, V160, I163, M168 |
| 115 | Platelet-derived growth factor subunit B | P01127 | V127, V153, V170, L172 |
| 116 | Low-density lipoprotein receptor | P01130 | I40, V45, C52, I83, C95, C116, I122, C134, C155, I161, A166, C173, C204, C222, C318, C338, C352, C377, Y400, L401, F402, F403, V409, M412, L414, I423, A431, L432, V436, I441, W443, I451, A480, V481, I488, Y489, W490, V498, V500, A501, M531, Y532, W533, I542, L547, V556, L575, W577, V578, I585, L605, L611, A612, V618, F619, W620, A627, I628, A631, A643, L646, C667, C677, C681, L682, C698 |
| 117 | Transforming growth factor beta-1 | P01137 | L258, C293, C294, V295, F302, C326, L340, A341, L364, I366, C387, C389 |
| 118 | Beta-nerve growth factor | P01138 | C136, V157, V159, V163, C189, A210, A218, A219, I223, I225 |
| 119 | Vasopressin-neurophysin 2-copeptin | P01185 | C44, C52, I57, C58, C59, C65, A72, C75, C92, C98, A99, A100, C104, C105, C110 |
| 120 | Somatotropin | P01241 | F36, A39, A43, L46, L49, A50, Y54, F70, C79, I84, L99, L101, L102, I104, L106, L107, L108, I109, W112, V116, L119, F123, A131, V136, L140, L143, I147, L150, Y186, L189, F192, M196, V199, F202, L203, V206 |
| 121 | Insulin [Cleaved into: Insulin B chain; Insulin A chain] | P01308 | L35, A38, L39, I91, C95, L105, C109 |
| 122 | Insulin-like growth factor II | P01344 | L37, L41, F52, I66, C70, C75, L80, Y83, C84, A85 |
| 123 | Lymphotoxin-alpha | P01374 | A65, L67, I68, L94, L99, V101, Y107, V109, V113, F115, L131, H133, V135, L181, V198, F200, A202 |
| 124 | Tumor necrosis factor | P01375 | A90, V92, A94, A98, L105, V117, L124, V125, V126, L131, Y132, L133, I134, V138, F140, C145, V150, L152, H154, I156, A160, L202, L208, A210, V226, F228, I230 |
| 125 | Interferon gamma | P01579 | Y6, I7, F10, C13, I14, A31, L34, A40, F52, L56, I67, M68, I72, V73, Y76, F77, L79, F80, I89, V93, I96, M100, F104, F105, F115, A132, I133, L136, M140, L158 |
| 126 | Interleukin-1 alpha | P01583 | I135, L136, A163, F166, A170, Y171, A178, V182, I183, Y192, I214, L221, F223, F234, I244, A245, V252, L254, F264 |
| 127 | Interleukin-1 beta | P01584 | C124, L126, L134, V135, L142, A144, V156, F158, M160, V163, V174, A175, L176, L178, L185, C187, M211, F215, V216, F217, L226, F228, I238, F262 |
| 128 | Erythropoietin | P01588 | L39, A46, A49, C56, C60, L62, V68, A87, V90, L94, L97, A100, L118, V122, A125, L129, L132, L136, A141, A145, A162, L168, F169, F175, L176, L180, Y183 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 129 | Interleukin-2 receptor subunit alpha | P01589 | A38, L47, C67, C80, C125, V143, V148, Y150, C168 |
| 130 | T-cell surface glycoprotein CD4 | P01730 | L39, C41, A43, F51, W53, I61, L62, L69, L76, A80, W87, F92, L94, I95, I96, L99, Y107, C109, V111, V118, L120, L121, V122, F123, L134, L139, L141, L143, V153, C155, L169, V171, L174, W182, C184, V186, I199, V201, V219, F221, F223, L238, F254, V261, M274, L282, L284, A287, A292, L297, L299, L308, V312, L314, V315, V316, M317, L326, C328, V330, L340, L342, V358, W368, C370, L372 |
| 131 | Ig epsilon chain C region | P01854 | I131, L133, C135, V137, W149, L178, W185, Y191, C193, V195, I237, C239, V241, V251, V280, L284, Y297, C299, V301, L310, V326, L343, C345, I347, F350, I355, V357, W359, V386, L390, V392, F403, C405, A407, V408, H409, A412, V418, V424 |
| 132 | HLA class I histocompatibility antigen, B-7 alpha chain | P01889 | M29, Y31, Y33, F46, V52, F57, V58, F60, A73, W75, I76, Y83, Y91, A95, L102, L105, L119, M122, C125, V127, Y140, Y142, Y147, I148, L150, L154, W157, A163, A164, A177, L184, C188, V189, L192, Y195, L196, L203, V213, A223, L225, C227, A229, F232, Y233, L239, W241, A269, A270, V271, V272, V273, Y281, C283, V285, H287 |
| 133 | HLA class II histocompatibility antigen, DR alpha chain | P01903 | F47, M48, F49, F57, V59, A77, A81, A84, A86, I88, L130, I131, C132, I134, F137, W146, F173, L176, L179, Y186, C188, V190, H192 |
| 134 | HLA class II histocompatibility antigen, DQ alpha 2 chain | P01906 | H50, F58, V60, I78, A85, M89, L131, I132, C133, V135, I138, W147, I174, L177, L180, Y187, C189, V191, H193 |
| 135 | HLA class II histocompatibility antigen, DQ alpha 1 chain | P01909 | H50, F58, V60, A84, I88, L130, C132, V134, I137, W146, I173, L176, L179, Y186, C188, V190, H192 |
| 136 | HLA class II histocompatibility antigen, DRB1-15 beta chain | P01911 | F36, L37, F46, F47, V53, F55, L56, Y59, V67, F69, F76, W90, L97, A103, C108, V120, V128, L138, L143, L144, V145, C146, V148, F151, W160, M171, L190, V199, Y200, C202, V204 |
| 137 | HLA class II histocompatibility antigen, DRB1-3 chain | P01912 | F36, L37, F46, F47, V53, Y55, L56, Y59, V67, F69, F76, W90, L97, C108, V120, V128, L138, L143, L144, V145, C146, V148, F151, W160, V171, L190, V199, Y200, C202, V204 |
| 138 | HLA class II histocompatibility antigen, DQ beta 1 chain | P01920 | F39, V40, F49, V56, Y58, V59, Y62, A70, F72, Y79, W93, L100, C111, L123, V131, L141, L146, L147, V148, C149, V151, F154, W163, V174, L193, V202, Y203, C205, V207 |
| 139 | Collagen alpha-1(I) chain (Alpha-1 type I collagen) | P02452 | C63 |
| 140 | Collagen alpha-1(II) chain (Alpha-1 type II collagen) [Cleaved into: Collagen alpha-1(II) chain; Chondrocalcin] | P02458 | C57 |
| 141 | Collagen alpha-1 (III) chain | P02461 | C55, C1262, L1265, V1279, I1290, C1294, I1303, V1310, V1326, F1328, A1364, I1368, Y1370, A1377, L1390, L1392, F1400, C1417, F1429, Y1431, L1439, I1441, I1444, A1445, V1458, V1463, F1465 |
| 142 | Collagen alpha-1 (IV) chain [Cleaved into: Arresten] | P02462 | V1448, L1474, Y1475, L1487, Y1521, W1522, L1523, I1545, C1548, A1549, V1550, C1551, A1553, F1583, H1586, C1604, F1613, I1614, C1616, C1622, C1662, V1664, C1665, M1666 |
| 143 | Alpha-crystallin A chain | P02489 | L75, V77, V94, I96, V124, L129, L139, F141 |
| 144 | Apolipoprotein A-I | P02647 | V35, L38, A39, Y42, L46, Y53, F57, L106, V117, L138, Y139, L198 |
| 145 | Apolipoprotein E | P02649 | W44, A47, F51, L55, V58, V65, L69, L70, V74, L78, M86, L89, L96, L100, A109, L111, L115, A117, A118, L122, M126, V129, C130, L133, Y136, L144, L151, V153, L155, A156, L159, L162, L166, L173, L177, Y180, A194, L247, L270, V298 |
| 146 | Fibrinogen alpha chain [Cleaved into: | P02671 | I675, Y692, W708, L714, L724, V726, L728, A738, Y740, V744, Y751, L753, A762, A765, H780, F785, C799, A800, W807, Y809, A815, L817, V841, W843, L853, V856, M858 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | Fibrinopeptide A; Fibrinogen alpha chain] | | |
| 147 | Fibrinogen beta chain [Cleaved into: Fibrinopeptide B; Fibrinogen beta chain] | P02675 | C241, I244, M254, Y255, I257, V268, C270, W279, I282, F292, Y299, C316, Y322, W323, I329, L340, L341, I342, M344, A354, H355, Y356, F359, V361, Y368, V372, A379, A382, L383, A387, H400, F405, C424, W432, W433, Y434, A439, A440, Y447, Y452, V465, V466, W467, M477, M480, M482 |
| 148 | Fibrinogen gamma chain | P02679 | C179, I182, Y193, I195, V206, C208, V219, F220, Y237, W253, I259, I262, Y270, A271, L272, V274, L276, A286, Y288, A289, F291, V293, Y300, L302, F307, A312, A315, F316, F321, H333, F338, F348, C352, A353, W360, W361, M362, H366, A367, H369, L370, Y375, Y380, Y389, I393, I394, W395, M405, M410, I412, I413, L418, H427, A431 |
| 149 | Acetylcholine receptor subunit alpha | P02708 | V153, L154, A167, V177, V201, I203 |
| 150 | Band 3 anion transport protein | P02730 | M435, C479 |
| 151 | Protein AMBP [Cleaved into: Alpha-1-microglobulin | P02760 | C287, A304, C333 |
| 152 | Transthyretin | P02766 | L32, V34, V36, A45, V48, V50, V52, L75, L78, F84, I88, Y89, V91, I93, Y98, W99, A111, A117, I127, A128, A129, L130, L131 |
| 153 | Serum albumin | P02768 | V31, A32, F43, A45, L46, V47, L48, I49, A50, F51, A52, Y54, L55, C58, H63, L66, V70, A74, C77, C86, L93, L98, A102, M111, C114, F126, C148, F151, L163, A167, F173, A175, L178, F181, A182, A188, F189, C192, L202, L209, A215, C224, A225, F235, A239, A241, F247, A250, A253, V255, L258, V259, V265, C270, L274, L275, C277, A285, I295, L299, C302, V317, F333, V334, V339, Y343, F354, A359, V367, L369, L370, L371, L373, Y377, L381, C384, Y394, V397, F401, V405, C416, F427, L431, L432, V439, V442, L447, V448, V450, L454, V457, C461, A473, V480, L481, L484, V486, H488, V497, C500, F512, F531, A535, I537, A552, L553, V554, L556, V557, A563, L568, V571, F575, F578, V579, C582, F592, L607, L609 |
| 154 | Ferritin light chain | P02792 | V13, A15, V17, L20, V21, Y24, A27, Y31, L34, Y37, F38, V48, F51, F52, L55, A56, Y63, L66, L67, M69, W90, A96, M97, A99, A100, M101, L107, L111, L112, L114, L126, L130, F134, M145, L149, L152, F167 |
| 155 | Capsid protein/genotype D subtype adw (isolate United Kingdom/adyw/1979) (HBV-D) | P03147 | F9, L15, L19, F23, F24, A36, Y38, A54, L55, C61, W71, W102, F103, L108, F110, V120, F122, W125, A131, Y132, A137, I139, L140 |
| 156 | Estrogen receptor | P03372 | C185, V187, C188, V199, C202, C205, F209, C227, I229, C237, A239, C240, L242, C245, M250, A307, M315, L319, A322, M342, L345, L349, L354, M357, I358, W360, A361, V364, F367, V376, L378, L379, A382, W383, I389, L391, V392, L402, A405, L408, L410, V418, F425, F435, F445, V446, C447, L448, I452, L453, L454, V458, H474, I475, V478, I482, L486, M490, L507, I510, I514, M517, M522, M528, L540, L544 |
| 157 | Fusion glycoprotein F0/strain A2 | P03420 | F32, C37, A39, V40, A47, L48, V56, I57, I59, V76, I79, L83, A89, V90, L93, L158, V164, L171, V187, L188, L195, I199, L203, C212, I214, V220, F223, L230, I233, F237, V247, M251, L252, L257, L260, I261, M264, I266, M274, I280, V281, I288, S290, I291, L297, A298, Y299, V300, V301, L303, Y306, C313, C322, I332, C333, L334, Y342, C343, V349, F351, F352, V365, F366, C367, I379, L381, C382, C393, I395, I407, L410, A412, I413, V414, C416, C422, A424, V442, M447, V450, V459, I475, Y478, A490, V495 |
| 158 | Hemagglutinin [Cleaved into: Hemagglutinin HA1 chain; Hemagglutinin HA2 chain]/strain A/Bangkok/1/1979 H3N2 | P03441 | A11, L13, C14, L15, A19, V26, V36, L42, V43, I51, C52, I58, C64, L66, I67, L70, L71, C76, F79, L86, F87, V88, F94, C97, Y98, Y100, Y105, A106, L108, V112, A113, L118, F125, A138, C139, F147, F148, L151, L154, L164, Y178, W180, V182, H183, H184, Y195, V202, V204, I230, I232, Y233, I236, V237, I242, L243, I245, L251, I252, A253, F258, I274, C281, I282, I288, V309, L316, A317, A334, W343, Y351, A373, A425, L447, L455, C466, F467, I469, H471, C473, C477, I478, I481, A495 |
| 159 | Hemagglutinin [Cleaved into: Hemagglutinin HA1 chain; Hemagglutinin HA2 chain]/strain | P03446 | I20, C21, I22, V33, V43, L58, C59, L69, C72, L74, I78, L79, Y95, I96, V97, L118, F122, C150, M163, L166, I188, V189, F190, W192, I194, Y207, V216, M242, Y244, L249, V255, I257, L263, I264, A265, C294, L327, A347, Y364, A386, L460, L468, H484, C486, C490 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | A/Duck/Alberta/60/1976 H12N5 | | |
| 160 | Hemagglutinin [Cleaved into: Hemagglutinin HA1 chain; Hemagglutinin HA2 chain]/strain A/Shearwater/Australia/1972 H6N5 | P03448 | A8, I19, I21, V42, L48, L49, F57, C58, L66, L68, C71, I73, W76, I77, L78, C83, L86, W92, Y94, I95, V96, Y107, L117, L120, I121, V127, F133, C151, Y153, L163, L164, W165, I166, I177, I189, L190, Y191, F192, W193, V195, H196, H197, Y208, V215, M217, I243, Y245, I249, L250, L256, V258, L264, I265, A266, Y269, A270, F271, F273, A281, C292, C296, V302, L303, I317, V324, L329, L331, A332, A349, M361, Y366, A388, V389, A440, L452, V459, L462, V466, L470, C481, H486, C488, C492, M493 |
| 161 | Hemagglutinin [Cleaved into: Hemagglutinin HA1 chain; Hemagglutinin HA2 chain]/strain A/Turkey/Ontario/6118/1968 H8N4 | P03456 | I19, C20, I21, V32, V42, Y57, C58, L68, C71, I73, I77, Y78, Y94, I95, V96, L117, F121, C149, I162, L165, I188, I189, F190, L191, W192, I194, Y207, V216, M242, Y244, L249, L255, I257, L263, I264, A265, C295, A348, Y365, A387, L461, L469, H485, C487, C491, A509 |
| 162 | Hemagglutinin [Cleaved into: Hemagglutinin HA1 chain; Hemagglutinin HA2 chain]/strain A/Turkey/Wisconsin/1/1966 H9N2 | P03457 | L10, I21, C22, I23, V34, V44, L51, L59, C60, L68, L70, C73, I75, I79, Y80, Y96, I97, V98, L119, F123, C151, M159, L162, A174, I184, L185, F186, M187, W188, I190, Y203, V212, I238, Y240, L245, L251, I253, L259, I260, A261, C290, H304, L323, A343, Y360, A382, L456, L464, H480, C482, C486 |
| 163 | Neuraminidase (EC 3.2.1.18)/strain A/Memphis/1/1971 H3N2 | P03471 | W87, I94, F97, I106, I114, V116, Y121, V122, C124, F132, A133, L134, L140, L158, L159, C175, A177, C183, L190, V192, C193, V194, A201, A203, F205, Y207, L223, C230, V231, C232, V239, V240, M241, I254, L255, F256, I257, V275, C278, C280, Y281, Y284, V287, C289, I290, C291, V302, V303, I305, Y316, V317, C318, L321, V322, V349, W352, A353, F354, V360, W361, M362, Y374, F377, V379, I397, V398, I409, F410, I418, C421, F422, Y423, V424, L426, V436, W438, I443, V444, V445, F446, I464 |
| 164 | Neuraminidase (EC 3.2.1.18)/strain A/Tern/Australia/G70C/1975 H11N9 | P03472 | L88, I95, A106, V107, V115, V117, Y122, V123, C125, F132, Y133, A134, L135, L159, I160, W162, C177, I178, C185, M192, I194, C195, I196, A203, A205, V206, I207, Y209, A221, L225, C232, V233, C234, C239, V241, V242, F243, I256, Y257, Y258, F259, H276, I277, C280, C282, Y283, I289, C291, C293, V304, I305, I307, Y318, I319, C320, V323, L324, V350, F353, Y355, W362, L363, I369, Y375, M377, L378, V380, A383, I397, V398, F410, M411, Y420, A422, C423, F424, Y425, V426, L428, V438, I445, V446, M448, C449, A464 |
| 165 | Neuraminidase (EC 3.2.1.18)/strain B/Lee/1940 | P03474 | F92, I114, I115, F119, V120, A121, F130, L132, L156, V159, A175, A176, A181, C182, I191, V193, A200, L201, V202, I204, I221, L222, I232, C236, Y237, L238, M239, I240, A245, F253, L254, I256, I265, H273, C277, I287, C289, A290, C291, A298, F302, V303, L305, I314, L323, I333, H354, W364, M377, L379, M400, V401, F411, C424, I425, I427, M429, V430, H431, H439, A441, A442, A444, I445, Y446, L448, L454, L455 |
| 166 | Neuraminidase (EC 3.2.1.18)/strain A/Turkey/Oregon/1971 H7N3 | P03476 | F94, I106, V116, Y121, V122, C124, F132, A133, L134, L158, F161, C176, C184, M191, V193, C194, M195, A202, A204, I206, Y208, L224, C231, C233, V240, A241, V242, V255, Y256, W257, I258, L277, C280, C282, I286, V288, C290, I291, C292, W303, M304, I306, Y316, V317, C318, H322, V348, F351, F353, W360, L361, F373, I375, V378, L396, V397, F409, I410, F417, F421, Y422, V423, L425, V436, I443, V444, F446, I464 |
| 167 | Neuraminidase (EC 3.2.1.18)/strain A/Turkey/Ontario/6118/1968 H8N4 | P03477 | I105, V113, V115, F120, I121, F131, F132, L133, L157, C160, A177, W178, A180, A182, C183, L190, L192, I194, A201, V202, A203, L205, M223, V231, C232, Y238, L240, I241, A250, Y252, I254, I257, I262, H274, F275, C278, C280, Y281, V287, C289, V290, C291, I303, F305, I313, C317, I320, F321, F350, F352, Y354, V358, W359, I360, F372, M374, V375, V382, I394, I395, F407, C422, F423, W424, V425, M427, W438, I444, F446 |
| 168 | Neuraminidase (EC 3.2.1.18)/strain A/Shearwater/Australia/1972 H6N5 | P03478 | I98, I106, V108, F113, V114, F124, F125, L126, L150, V153, W171, A173, A175, C176, M183, I185, V187, A194, Y195, A196, I198, L216, V224, C225, I226, Y231, V233, M234, A243, Y245, I247, V255, H267, I268, C271, C273, Y274, M277, V280, C282, V283, C284, L296, F298, C310, I313, F346, F348, V354, W355, A356, I360, F368, V370, L371, I378, I384, V390, L391, F403, I415, C418, F419, W420, L421, M423, W435, F443 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 169 | NADH-ubiquinone oxidoreductase chain 1 (EC 1.6.5.3) | P03886 | Y43, A50, A52, M53, F56 |
| 170 | Angiogenin (EC 3.1.27.—) | P03950 | F33, C50, I53, M54, C63, I66, F69, I70, H71, I77, A79, I80, L93, V102, C105, C116, Y118, V127, V128, V129, P136, L139 |
| 171 | Coagulation factor XI | P03951 | F30, C46, C50, C56, L57, L58, F59, C76, L78, M120, A130, C136, C140, F148, F149, C165, L167, A220, V225, C226, C230, C236, F238, F239, C255, L257, A274, C283, V289, F301, C317, C321, C327, F329, F330, A337, C346, I366, I388, W401, V403, L405, C416, I420, I421, I426, L427, A429, A430, V444, Y445, V463, I481, A482, L483, L484, L486, V490, C500, C514, V516, W519, A535, I537, C545, Y549, I554, C560, A561, A570, L579, C581, V586, H588, L589, V590, I592, V607, Y608, V611, V612, Y614, I618 |
| 172 | Catalase (EC 1.11.1.6) | P04040 | A76, A79, A81, F85, V87, I91, A97, V99, F100, I109, A110, V111, F113, A117, F132, V134, F136, W143, L145, I152, F153, F154, I155, I159, F164, W183, W186, L193, V196, F200, I205, H209, M212, L222, V230, C232, F234, Y236, A250, L265, F266, A268, W277, F279, I281, M284, A289, F294, L299, V313, L316, V317, L318, V329, I332, A333, I343, L351, L355, V375, V443, Y447, L459, C460, I463, A464, L467, A478, V479, F482, V485, Y489, I493, L496, L497 |
| 173 | RAF proto-oncogene serine/threonine-protein kinase (EC 2.7.11.1) | P04049 | I58, V60, L62, V72, L78, C81, L82, L86, A97, V98, A118, L126, V128, C152, C165, C176, V180, C184, V372, I405, V420, I446, A449, A453, M456, L459, H466, M469, L476, V482, I484, F487, A513, V516, V531, Y534, V537, L538, M542, M581, V585, C588, F599, I606 |
| 174 | Glucosylceramidase (EC 3.2.1.45) | P04062 | V54, C55, C57, F76, L108, F120, A123, M124, A127, A128, A129, I132, A139, L142, L143, L144, Y147, F148, I153, Y155, I157, I158, V160, M162, A163, C165, F167, A175, L183, L199, I200, A203, L213, L214, A215, L224, H245, W248, A249, Y251, F252, F255, L256, Y259, L264, A268, V269, A271, C287, L288, F290, F298, I299, L303, L318, M319, L320, A331, V334, A340, I347, A348, V349, H350, A357, L363, L375, F376, A377, A380, C381, V382, W396, Y402, I406, I407, V414, W417, L422, A423, L424, V437, I441, I442, V443, F450, M455, F456, H458, L459, H461, F462, I466, V473, A485, V486, A487, L488, A495, V496, V497, V498, V499, L500, L509, I511, L519, I528, H529, Y531, W533 |
| 175 | Vitamin K-dependent protein C (EC 3.4.21.69) | P04070 | C105, C131, L212, V227, V228, L229, A240, V241, L242, V248, L249, A251, C254, V263, L265, L280, I300, A301, L302, L303, V339, I363, I365, C373, A388, M406, A408, V417, L419, V434, Y435, V438, I445, I449 |
| 176 | Cystatin-B | P04080 | A20, V23, L27, F54, I55, V57, V65, H66, L67, V69, L82 |
| 177 | Trefoil factor 1 | P04155 | C51, C57, C68, F69 |
| 178 | Major prion protein | P04156 | I139, Y150, Y157, V161, Y163, F175, V176, C179, V180, I182, I184, M205, M206, V209, V210, M213, C214 |
| 179 | Superoxide dismutase [Mn], mitochondrial (EC 1.15.1.1) | P04179 | L38, I42, I46, M47, H50, H54, H55, V59, L62, A72, I82, L88, H98, F101, W102, L105, L117, A120, I121, F131, L135, W147, W149, L150, C164, L170, L179, L180, I182, V184, W185, A188, Y189, Y200, L201, I204, V207, I208, W210, V213, Y217 |
| 180 | Phosphatidylcholine-sterol acyltransferase (EC 2.3.1.43) | P04180 | V49, I50, L51, V52, L60, A62, A117, V133, V149, L152, V163, A165, A166, Y168, L184, V188, M191, V199, F200, L201, I202, L206, C208, L209, H210, L211, L212, F214, L215, F230, I231, A235, I241, M244, A248, I261, F289, I290, F305, F306, L309, L328, V333, V335, C337, L338, Y339, V372, A373, C380, W383, L396, M404, V405, I414, L418 |
| 181 | HLA class II histocompatibility antigen gamma chain | P04233 | C213, V253 |
| 182 | T-cell surface glycoprotein CD3 delta chain | P04234 | V33, V35, C37, Y71 |
| 183 | von Willebrand factor | P04275 | V815, C827, C829, C849, C851, C1272, L1276, L1278, V1279, F1280, L1281, L1282, F1293, L1296, F1299, V1300, M1303, M1304, L1307, V1314, V1316, A1317, V1318, V1319, Y1321, I1329, L1340, A1344, V1347, A1355, V1360, L1361, F1369, A1377, I1380, L1382, L1383, L1384, M1385, A1386, F1397, V1401, L1404, I1410, V1411, I1412, V1414, I1416, A1420, I1425, I1428, F1438, L1440, V1443, L1446, I1453, V1454, L1457, L1497, V1499, A1500, F1501, V1502, L1503, F1514, F1520, M1521, V1524, I1525, M1528, I1535, V1537, V1539, L1540, Y1542, Y1550, I1561, V1565, A1581, L1582, L1585, A1600, V1604, Y1605, M1606, V1607, V1625, V1626, I1628, V1630, I1642, L1657, A1661, V1665, L1666, C1670, L1690, V1692, I1693, L1694, L1695, L1696, F1707, F1713, A1714, F1717, I1718, A1721, V1732, L1733, Y1735, V1743, L1754, V1758, M1761, I1770, A1773, L1774, A1777, L1781, A1795, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | V1796, V1797, I1798, L1799, V1800, V1808, A1812, A1815, V1822, I1825, I1827, L1836, L1839, L1857, V1861, L1871, C2724, L2786, C2804 |
| 184 | Argininosuccinate lyase | P04424 | L34, V39, A44, Y45, L49, I63, L67, V70, I88, H89, A91, L96, A104, L107, V118, L121, M125, C129, L132, L136, W137, L139, I140, M143, V144, A147, F155, L161, W169, I173, L174, A177, L180, L187, V190, I194, L197, L199, L216, L220, F222, A232, F238, V239, A240, F242, L243, W245, A246, C249, M250, L253, M256, A257, L260, F268, F270, V271, L273, L293, I296, V303, L310, L325, A331, V332, V335, M339, L343, A346, V349, I350, L353, M360, A363, M368, L369, L373, A374, Y375, L377, A387, A390, A394, A398, L405, L413, F420, V424, V434, A444, V448 |
| 185 | HLA class II histocompatibility antigen, DP beta 1 chain | P04440 | Y36, A46, F47, F53, L54, Y57, A65, F67, F74, W88, L95, V101, C106, L118, V126, L136, L141, L142, V143, C144, V146, F149, W158, V169, V186, L188, V197, Y198, C200, V202 |
| 186 | Envelope glycoprotein gp160/group M subtype B (isolate HXB2) (HIV-1) | P04578 | A55, V65, A70, M95, V101, M104, I108, W112, V120, C131, I154, I165, L193, H216, A221, A224, I225, G235, C239, V242, I251, L259, L260, V270, I284, I285, V286, L288, V292, I294, C296, M326, C331, I333, W338, L342, I345, A346, L349, I359, I360, F361, H374, F376, C378, F383, C385, L390, F391, L416, C418, I423, I424, V430, A433, M434, I449, L452, L453, L454, I467, F468, W479, L483, Y486, V489, I491, V505, I548, V549, L555, L556, A558, I559, A561, L565, L566, V570, I573, L576, I580, L602, A607, I635, I642, W666, W680, M687, I688, V698 |
| 187 | Receptor tyrosine-protein kinase erbB-2 (EC 2.7.10.1) | P04626 | H42, M45, L46, Y50, C53, V56, L60, L62, L65, F73, L74, I77, V80, Y83, V84, L85, I86, A87, V91, V94, L96, L99, I101, V102, A113, L114, A115, V116, L137, L140, L142, L145, I148, V153, I155, L161, C162, Y163, I172, F173, C204, W205, C227, C240, A241, A242, L304, C331, L345, A355, V356, I361, F364, C367, I370, L374, A375, F376, L397, F400, L403, I406, L410, I412, L422, F425, L428, V430, I431, A440, L443, L445, L448, I450, L453, L455, L461, L465, A466, L467, I468, H469, L474, C475, F476, V477, L494, C504, C520, W521, C540, C576 |
| 188 | High affinity nerve growth factor receptor (EC 2.7.10.1) | P04629 | L103, A110, L117, L122, L138, C215, L249, L251, V254, L258, C265, A267, V282, C300, I301, L346, L348, L361, A363, A376 |
| 189 | Hemagglutinin [Cleaved into: Hemagglutinin HA1 chain; Hemagglutinin HA2 chain]/strain A/Duck/England/1/1956 H11N6 | P04661 | I19, C20, I21, V32, V42, V49, F57, C58, I60, I66, L68, C71, F73, A74, W76, I77, L78, C83, L86, W92, Y94, I95, V96, Y107, L117, F121, V124, F127, F133, A149, C151, F153, M163, V164, L166, I176, V188, L189, I190, V191, W192, I194, H195, H196, Y207, V214, V216, Y221, M242, F244, Y245, I248, V249, I255, F257, F263, L264, A265, Y268, A269, F270, I272, L280, C294, H308, H311, I315, L327, A347, Y364, A386, L460, L468, H484, C486, C490 |
| 190 | Heat shock protein beta-1 | P04792 | V6, F8, L10, V97, L99, V101, A105, V118, I120, V148, L163, V165, A167 |
| 191 | Cytochrome b-245 heavy chain (EC 1.—.—.—) | P04839 | A394, V398, V404, M405, L406, V407, V413, F416, I419, V423, L436, F441, Y442, F454, L458, F473, F520, I532, V534, F535, L546 |
| 192 | Insulin-like growth factor I | P05019 | L58, A61, L62, F73, I91, C95, C100, L105, Y108, C109, A110 |
| 193 | Fructose-bisphosphate aldolase B (EC 4.1.2.13) | P05062 | L16, I19, A20, I23, V24, I30, L31, A32, A33, M40, L44, F59, I62, L63, F64, V66, I70, I74, V77, I78, L79, L84, F94, I97, L98, V104, V105, I107, L109, L131, C135, Y138, V143, F145, W148, A150, L152, L162, A163, I164, A168, A170, L171, A172, Y174, A175, C178, L183, V184, I186, V187, C202, V209, L210, V213, A216, L217, L228, L229, V234, Y244, A250, A252, V254, A256, L257, V261, V265, I268, C269, F270, A280, L282, L284, I287, L298, F300, Y302, A305, L306, A308, A310, A313, W314, F328, M329, A332, A334, A338, L357 |
| 194 | Amyloid beta A4 protein | P05067 | I34, A35, L41, M43, Y72, C73, V85, I94, W97, C117, C133, W150, A154, C158, C174, F179, V182, F184, V185, C186, C291, C316, C337, V375, L442, L453, Y476, A479, V490, L494, Y497, V498, A500, A523, I537, L548, A555, I558, I666, V669, H684, L688, V689 |
| 195 | Arginase-1 (EC 3.5.3.1) | P05089 | I8, I10, I11, A13, F15, V24, V30, L31, L36, L40, V67, V73, A76, L80, A81, V84, A85, V87, L95, V96, L97, H101, L103, A104, I105, I108, H111, H115, L118, V120, I121, W122, V123, A125, I129, L140, V145, L148, L149, L152, I169, A171, I174, V175, Y176, I177, L179, L190, F198, V211, M212, L219, I227, H228, L229, F231, V233, L236, A243, L252, I260, I264, L273, I275, M276, V278, V293, A296, I299, A302, C303, F304 |
| 196 | Aldehyde dehydrogenase, mitochondrial (EC 1.2.1.3) | P05091 | C36, I39, F40, A48, F54, V68, A69, V76, A79, V80, A82, A83, A85, W93, L104, L105, L108, A109, L111, I112, Y118, L119, A120, A121, L122, L125, L139, V142, L143, C145, L146, Y149, A150, A153, V178, C179, L189, L190, M191, A193, L196, A199, L200, A201, V205, V206, V207, M208, V210, L216, A218, L219, Y220, V221, A222, L224, I225, A228, V234, V235, I237, V238, A245, I249, A250, V255, V258, A259, I270, A273, A274, I293, I294, A303, A307, H308, A310, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | L311, F312, F313, C318, C319, C320, A321, F326, V327, F335, A343, I370, Y373, I374, F397, I398, V402, F403, V406, I412, A413, I417, V421, M422, I424, L425, F427, I430, V433, V434, L444, A445, A446, A447, V448, F449, L459, A478, F482, L494, L499, Y502 |
| 197 | Integrin beta-3 | P05106 | C31, C39, C42, L43, C49, A50, W51, C52, C64, L70, C75, V109, I114, L116, L118, F126, I128, V130, V133, V138, I140, Y141, Y142, L143, M144, L146, M150, I157, L160, L164, A165, M168, I177, F179, A181, F182, V183, Y190, Y192, A198, C203, C210, Y216, L220, L222, F229, V233, F249, A251, I252, M253, A255, C258, I262, L271, L272, V273, F274, I291, M313, Y315, M321, L325, L332, I333, F334, A335, V336, Y344, I351, L359, V366, I370, A373, Y374, V381, L383, L392, A398, C400, I406, L409, C412, L415, V421, F423, I425, A427, V429, F440, I442, L451, V453, V455, C461, C474, C497, C499, C512, C521, C547, C562, C584, C593, C601, C624, V641, C661, C681, C689, V691, F693, L705 |
| 198 | Integrin beta-2 | P05107 | C25, V30, C33, C36, I37, C43, W45, C46, C62, L68, C73, L98, V103, L105, L107, A113, F115, V117, F119, I127, L129, Y130, Y131, L132, M133, L135, M139, V146, L149, L153, L154, A156, L157, I166, F168, F171, V172, F179, V180, C191, C198, F204, F217, V221, I226, L237, A239, M240, M241, V243, A244, C246, I250, V255, L258, L259, V260, F261, A262, I278, Y293, Y301, L307, L311, I316, I319, F320, A321, V322, Y330, L333, I337, A341, L345, V352, I356, A359, V367, L369, L378, Y382, C400, V403, I409, F411, V413, V415, A417, F426, I428, A430, V437, V439, V441, C445, C459, C467, C481, C483, C497, C506, C534, C549, C557, A572, C573, C582, C590, C612, A629, C662, V672, Y674, I687, V689 |
| 199 | Interleukin-4 | P05112 | L31, I34, L38, L41, C48, I56, F69, C70, A72, A73, V75, L76, C89, H100, L103, L107, L110, L114, A118, L133, F136, L137, L140, M144 |
| 200 | Interleukin-5 | P05113 | V84, L87, L91 |
| 201 | Plasminogen activator inhibitor 1 | P05121 | V31, A32, A35, F38, V40, V42, F43, V46, A47, V55, V56, F57, Y60, V62, A63, V65, L66, A67, M68, L69, L71, I81, M85, I89, M94, A95, L101, L105, I114, A119, I120, F121, V122, L128, F132, F136, F140, V144, V147, F149, A155, I159, V163, I171, L174, L175, V180, L186, V187, L188, V189, A191, L192, F194, W198, F202, L211, F212, M224, M225, F231, Y244, I246, L247, L249, Y251, L256, M258, F259, I260, A261, A262, L270, L273, L277, A279, I282, W285, L296, V297, L298, F301, V307, L309, L313, L316, M318, M321, F329, L332, L338, V340, A343, L344, V347, I349, V351, A358, A363, V364, I365, V366, A368, M377, F381, L382, F383, V384, V385, H387, V393, L394, F395, M396, V399, M400 |
| 202 | Protein kinase C gamma type | P05129 | L120, V386, A461, I476, W538, L544 |
| 203 | Plasma protease C1 inhibitor | P05155 | L142, A145, F149, L153, Y154, A168, F169, I174, A175, L177, L178, L193, L197, F213, V218, I224, F225, L230, F236, I262, V266, I274, L278, L281, V288, L290, A292, I293, L295, F313, M325, Y330, A333, A342, V344, L347, L353, L355, V356, M370, L374, L386, M409, M413, L430, M441, H443, L447, L449, V454, A456, A457, A458, A459, A461, L478, F479, V480, L481, F488, V490, F491, M492 |
| 204 | Complement factor I (EC 3.4.21.45) | P05156 | C33, V74, A76, C86, F100, V129, I140, A150, V152, A153, C154, A163, C181, L182, V184, C186, L193, A210, C214, C229, C241, C247, L254, C256, C266, I357, C365, I368, I375, L376, A378, A379, L382, I430, A431, L432, I433, A452, C467, L491, M508, C510, A511, L529, V530, C531, V540, W541, V543, V558, V562 |
| 205 | Alkaline phosphatase, tissue-nonspecific isozyme | P05186 | L46, A51, V54, I55, M56, F57, L58, A69, A70, L87, M89, A96, A111, A114, A116, Y117, L118, A123, V128, V130, I150, L151, A154, V161, I163, V164, V169, A172, A179, A182, M192, A196, I204, A205, L208, M209, I215, V217, I218, M219, M226, L252, V253, W256, I269, L275, L278, V283, L286, L287, L289, F290, M295, M312, V315, A316, L320, F327, F328, L329, L330, V331, I336, H340, A345, A348, L349, A352, V353, M355, A358, I359, A362, L372, V374, V375, A377, H379, I395, A412, I413, V459, V461, A468, L471, V480, V483, M484, A485, A487, I490 |
| 206 | Interleukin-6 | P05231 | I53, I57, I60, I64, L67, A86, L92, C111, I115, I116, L119, F122, V124, Y125, L126, Y128, L129, A140, V143, L150, I151, L154, I164, L179, M189, I194, L195, F198, F201, L202, A208 |
| 207 | 60S acidic ribosomal protein P1 | P05386 | A8, C9, A13, L16, I28, I32, F47 |
| 208 | T-cell surface glycoprotein CD4 | P05540 | A222, F224, F226, L239, F255, V262, L283, I285, A293, L298, L300, V311, L313, V314, V315, M316, L326, C328, V330, L340, L342, I358, W368, C370 |
| 209 | Integrin beta-1 | P05556 | C27, A32, C38, I39, C45, C64, I114, L119, L121, L123, F131, L133, I143, L145, Y146, Y147, L148, M149, L151, M155, V162, L169, M173, I182, F184, F187, V188, Y195, I196, C213, Y219, F232, V236, F252, A254, I255, M256, V258, A259, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | C261, I265, V270, L273, L274, V275, F276, I293, Y316, L322, L326, I331, I334, F335, A336, V337, Y345, L348, I352, L360, V367, I371, I372, V382, L384, C415, I418, F426, I428, I430, I445, V454, V456, L458 |
| 210 | Gag-Pol polyprotein/group M subtype B (isolate MN) (HIV-1) | P05961 | L8, W16, I19, L21, Y29, V34, A37, L41, L50, L51, C57, I60, L61, L64, L75, L78, V82, A83, L85, Y86, C87, V88, I94, A100, I104, W158, V161, V162, F167, V171, I172, F175, A182, L187, M190, L191, V194, A199, A200, L204, I208, A212, I239, A240, W252, V261, Y265, I269, L273, I276, V277, I285, F296, Y299, V300, F303, Y304, L307, A309, L325, C333, L337, M350, C353, C395, A405, C416, L499, I507, I509, A516, L518, V526, L527, M530, V550, Y553, I556, I558, I560, C561, A565, V569, L570, V571, I578, I579, L583, L584, L591, V603, I624, A626, L627, I630, C631, I640, I643, V653, F654, A655, I656, L667, V668, F670, L673, V683, A691, L693, V699, V701, L702, V704, A707, Y708, F709, V711, L713, F717, A722, F723, I725, I728, Y737, Y739, V741, L742, W746, A751, I752, F753, M757, I760, L761, F764, L780, Y781, V782, L786, H791, I795, L798, H801, L802, L803, F807, F820, W822, M823, Y825, L827, W832, V834, L839, W845, V847, I850, L853, L857, A860, I863, Y864, I867, L872, L876, L888, A892, L896, A897, L903, L918, I919, A920, V922, W930, Y932, I934, L942, A948, A953, V958, L961, A964, V965, I968, I973, V974, F982, L984, I986, W991, W994, W995, A1001, W1003, I1004, W1007, V1016, W1019, I1027, F1033, V1035, A1039, A1048, Y1050, L1062, L1072, A1074, I1075, H1076, L1077, A1078, L1079, V1086, I1088, V1089, A1095, I1099, V1111, I1114, I1115, L1118, V1124, L1126, V1141, V1145, A1161, M1175, A1186, W1214, V1225, I1226, L1227, A1229, V1230, H1231, I1237, F1253, L1254, L1257, A1258, V1279, C1283, L1311, I1314, A1328, V1329, A1332, V1333, I1344, A1349, I1353, A1358, I1361, V1378 |
| 211 | Collagen alpha-2 | P05997 | C64 |
| 212 | T-cell surface glycoprotein CD5 | P06127 | F33, A35, C44, L48, V50, L52, V59, C60, W64, A77, V80, C81, L90, L92, I105, I106, C107, F114, C125, L128, L130, C132, L133, V289, V291, L300, C301, W312, V315, C316, C321, C350, C360, V365 |
| 213 | Insulin receptor | P06213 | L29, C35, I40, L47, L50, C53, V55, I56, L60, M65, L81, M83, I84, L88, L90, V93, L99, L102, F103, L106, V108, I109, A119, L120, I122, M125, L128, L131, L133, L136, V144, I146, L152, I163, L164, C186, C209, W210, C223, C228, C235, C239, C252, A254, F275, W278, C286, V305, L326, I348, A354, L357, C360, I363, L367, I369, I371, L381, L385, I388, I391, Y394, L395, I397, L406, F408, F409, L412, I415, F427, A429, L435, L438, W439, L446, I448, L453, F455, H456, L461, I466, M469, I512, L514, W516, L532, A537, M580, I591, V593, A608, I638, L640, V657, I809, I820, L822, A824, C825, V867, H868, V886, V900, C911, V923, I925, A927, F942, V944 |
| 214 | Tyrosine-protein kinase Lck (EC 2.7.10.2) | P06239 | V66, L88, A100, I111, A137, L141, F151, L152, I153, L165, V167, I183, I193, L205, Y209, L216, L220, V240, L245, L247, V270, V272, L275, F285, A289, L295, L300, L303, A305, V306, V307, I312, I314, I315, L324, L328, L341, L342, M344, A345, I348, A349, M352, I355, I361, H362, L365, A367, A368, I370, V372, C378, I380, A381, F383, A386, A408, A411, F417, V423, W424, F426, I428, L429, L430, I433, V449, L453, C465, L469, M473, C476, W477, F487, L490, V493, L494 |
| 215 | Alpha-galactosidase A (EC 3.2.1.22) | P06280 | W44, H46, C63, I64, L68, F69, M72, A73, M76, W81, Y86, L89, C90, I91, C94, W95, M96, L120, A121, V124, L129, L131, I133, Y134, A135, V137, Y152, A156, F159, V164, L167, F169, L180, Y184, M187, A190, V199, Y200, C202, I219, C223, H225, W226, I232, I239, I242, L243, I253, W262, M267, L268, V269, I270, V281, M284, A285, L286, W287, A288, I289, M290, A291, A292, L294, M296, A307, L311, V316, I319, F337, V339, W340, A348, A350, V351, A352, M353, I354, I367, V369, L372, A377, C378, A381, C382, I384, L403, I407, V413, L414, L415, L417 |
| 216 | HLA class II histocompatibility antigen, DO alpha chain | P06340 | H50, F58, V60, A78, A87, I89, L131, I132, C133, V135, I138, W147, F174, L177, V180, Y187, C189, V191, H193 |
| 217 | Gelsolin | P06396 | F59, I70, W71, V73, L78, V81, L85, F89, A94, Y95, V96, I97, L98, V101, L112, H113, W115, A127, A128, L135, A143, F157, A173, L189, F190, V192, V198, A200, F210, C215, F216, I217, L218, L220, I224, W227, L238, A240, V243, I247, G254, G264, M270, L271, P276, A279, L280, A282, G283, A292, A298, L300, V303, M310, A316, F321, A322, L326, C331, F332, I333, L334, I342, F343, V344, A358, L359, A362, F365, I366, V377, V379, L380, F389, F392, A434, M439, I449, I452, F468, Y474, I475, I476, Y478, Y480, I489, I490, W493, V526, H534, L535, L538, F539, M544, I545, I546, L565, F566, V568, A578, L588, A593, F594, V595, L596, A602, L604, W605, A610, A618, L621, L622, V632, F641, A644, L645, L657, L669, A671, C672, V680, L693, A694, V698, M699, L700, L701, V707, F708, V709, W710, A723, L724, A727, I744, V747, F756 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 218 | Complement C2 (EC 3.4.21.43) | P06681 | L47, A82, C89, Y107, V113, C144, C151, A160, V173, C191, I462, M573, V697 |
| 219 | Complement C5 | P06684 | A691, C703, C728, A731, C735, C736, A739 |
| 220 | Glycogen phosphorylase, liver form (EC 2.4.1.1) | P06737 | I16, V25, L28, F32, L36, F54, A55, L56, A57, V60, L64, V83, Y84, Y85, L86, L88, F90, L96, M100, I101, L105, A108, C109, I113, L118, L123, L132, L137, L140, A141, A142, C143, F144, L145, M148, A149, L151, L153, A154, A155, Y156, Y158, I160, Y162, V201, F203, V222, A224, V239, M242, L244, W245, A247, A273, I276, L280, L294, Y298, F299, V300, V301, A302, A303, L305, I308, I309, F317, F327, F330, V334, A335, I336, L338, A344, L345, A346, I347, L350, M351, F354, I357, L360, A365, L368, F373, A374, Y375, V380, W388, L392, V393, L396, L397, H400, I403, I404, I407, I415, L418, M429, L431, I432, I440, M442, A443, L445, C446, I447, A452, V453, V456, A457, I459, H460, V464, F469, F472, L475, I487, W492, L493, L494, A501, L503, I504, Y512, V513, L516, L519, L522, H523, F531, L532, V538, L544, F546, L550, M563, F564, V566, I571, Y574, L578, L579, C581, L582, H583, V584, I585, I591, V604, I605, I606, A610, A611, M616, A617, I620, I621, L623, I624, V627, V630, V631, M636, V637, L641, V643, I644, L646, V651, L653, A654, V657, I658, A660, L663, I667, A670, M680, F682, M683, L684, A687, L688, I690, A696, M700, A701, F712, A729, L736, L739, V742, I743, I746, F759, I762, L766, F772, F775, Y778, Y781, V782, C784, V788, Y792, V802, L803, I806, A807, F812, I818, Y821, A822, W826 |
| 221 | Glucose-6-phosphate isomerase | P06744 | A2, L4, F10, L13, W16, L26, F40, I51, V53, Y55, L59, V60, V64, M67, L68, L71, A72, V77, A79, A80, M84, A97, V98, L99, H100, V101, A102, L103, I111, V118, V125, M129, F132, C133, V136, I149, V152, I153, I155, M166, V167, A170, L171, V184, I192, L205, F206, I207, I208, A209, F213, A222, A225, F229, A233, A238, V239, H242, F243, V244, A245, L246, V253, F256, I258, F264, F266, W269, V270, Y274, L276, W277, A279, I280, L282, I284, A285, L286, F293, L296, L297, A300, M303, F307, L312, A316, V318, L319, L320, A321, L322, L323, I325, W326, A337, M338, L339, Y341, L345, F348, F352, V379, Y392, I395, C404, F406, L407, I408, F429, L436, M437, A445, L463, I477, F479, L482, M486, L487, A489, L490, V491, A492, M493, Y494, H496, I498, F499, V500, I503, I504, W505 |
| 222 | Tumor necrosis factor | P06804 | A93, V95, L127, V137, V141, F143, L154, H156, V158, C179, L204, L210, A212, F230, V232 |
| 223 | Beta-hexosaminidase subunit alpha (EC 3.2.1.52) | P06865 | W24, Y37, V60, L61, A64, L90, V94, L95, V96, V97, Y116, L118, I120, C125, L127, V132, W133, A135, L136, L139, F142, I156, I161, H169, L172, L173, L174, L181, I186, L190, V192, M193, L198, V200, F201, H202, W203, H204, L205, V206, F211, F216, L221, Y234, V239, V242, A246, I251, V253, L254, A255, F257, L264, W266, L273, V290, F300, M301, F304, F305, V308, F312, L317, H318, L319, F326, W329, I335, M339, L351, F354, Y355, I356, L359, L360, V363, Y366, V371, V372, W373, V376, I389, V391, V398, Y400, L404, V407, A414, L415, L416, W420, L422, F434, Y435, A457, C458, M459, L469, L473, W474, A477, A479, V480, A481, L484, W485, A496, L500, F503, L507, V519 |
| 224 | Thrombomodulin | P07204 | C369, C388, C390, C413, C439, C464 |
| 225 | Vitamin K-dependent protein S | P07225 | C212, C241, C265, C267 |
| 226 | Prostate-specific antigen | P07288 | I25, V40, V42, V53, L54, V55, V60, L61, A63, A64, C66, I73, L75, F90, V92, L121, L123, L124, L126, L132, A135, V136, C152, A154, F165, V174, L176, C184, C198, A199, L217, C219, L223, I226, L242, Y243, V246 |
| 227 | Cathepsin D (EC 3.4.23.5) [Cleaved into: Cathepsin D light chain; Cathepsin D heavy chain] | P07339 | L71, I83, I85, F92, V94, V95, W104, V105, C117, Y123, L147, V156, F179, F190, F195, I198, L199, M201, V214, F215, L218, F229, A268, W270, V272, L274, V277, V279, L285, A292, V294, M301, V308, L311, A317, I327, I338, L340, L342, L349, Y354, F370, L382, L385, V388, F389, I390, Y394, V396, F397, V404, F406, A407 |
| 228 | Trypsin-1 (EC 3.4.21.4) | P07477 | I24, V39, L41, L52, W57, V58, V59, A61, C64, I69, V71, L73, V80, L81, F87, I88, I108, M109, L110, I111, L113, I119, V123, I126, L128, C139, I141, W144, C160, A163, C171, A173, Y175, F184, C185, V186, V204, C206, L210, V213, V214, V228, Y229, V232, Y235, V236, I239 |
| 229 | Decorin | P07585 | V65, C67, V75, L86, L88, I93, I96, F101, L107, L110, L112, I117, A124, F125, L128, L131, L134, L136, L144, L152, L155, A157, I162, V165, F170, L173, M176, I179, L181, L186, A195, F196, M199, L202, I205, I207, A208, I212, I215, L223, L226, L228, I233, V236, L241, L244, L247, L250, L252, I257, L265, L271, L274, L276, L281, L288, I294, V297, L299, I304, F312, C313, Y324, V327, L329, A352 |
| 230 | Prosaposin | P07602 | C66, V69, V70, A73, I86, L90, C94, V110, I117, L118, V131, C132, C230, C265, C271, V317, C318, L321, V325, I338, M345, C346, C357, V360, I368, L369, V381, C382, V411, C412, L415, V416, L419, I432, L436, C451, F454, L462, L466, M470, V475, C476, A481 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 231 | Beta-hexosaminidase subunit beta (EC 3.2.1.52) | P07686 | A55, W57, L70, C91, L93, L94, A97, V124, L127, V129, I131, A139, Y149, L151, V153, A158, L160, A162, V165, W166, A168, L169, L172, F175, I189, I194, H202, I205, L206, I207, L214, I219, L223, A225, M226, F228, F231, V233, L234, H235, W236, H237, I238, V239, F244, I249, L254, Y266, V271, V274, A278, I283, L286, F289, L296, W298, L305, I322, L333, F336, F337, I340, F344, I349, H350, L351, F358, W361, I367, M371, L383, F386, Y387, I388, V391, L392, I395, I398, I403, V404, W405, V421, V423, Y429, L433, V436, V443, I444, L445, W449, L451, Y463, Y464, A486, C487, L502, W503, A506, A508, V509, L513, W514, A525, L529, H532, M536, I541, A548 |
| 232 | Uromodulin | P07911 | C106, C315, V357, F369, A424 |
| 233 | Proto-oncogene tyrosine-protein kinase receptor Ret (EC 2.7.10.1) | P07949 | Y30, F31, Y36, L40, V42, L50, V53, L68, L72, L80, I86, L95, L97, L109, V121, L123, V125, A143, V145, F147, C166, F174, F185, C197, V223, L229, L239, A241, V242, C243, V245, F258, V260, V262, Y263, A269, Y314, F329, L358, L372 |
| 234 | Fumarate hydratase, mitochondrial | P07954 | V62, A70, V92, I93, A95, F96, I98, L99, A102, A103, A104, V106, A117, A119, I120, A123, A124, V127, L138, V140, V153, V156, I157, A161, I162, V175, V181, F191, A194, M195, H196, I197, A198, A199, A200, V203, L207, L211, L214, L218, A220, F225, I228, I229, I231, V240, L242, L244, F248, Y251, V255, A258, I262, M266, I269, L272, A273, A274, A278, F289, V293, A294, V297, L303, A308, L315, A317, H318, A320, L321, L324, M328, A332, L335, I338, A339, I342, L356, L358, C377, M380, V383, A384, V387, M388, V392, V394, V407, M411, M412, I413, V416, L417, A420, L422, L423, F430, C434, V435, V436, I438, A440, I445, M449, L455, L459, A468, I471, A475, L482, A486, L492, F497 |
| 235 | Gap junction beta-1 protein | P08034 | F51, C60, C64, H73, C168, V170, C179 |
| 236 | Rhodopsin | P08100 | V11, Y26, W35, F103, C110, L112, I179, C185 |
| 237 | Beta-microseminoprotein | P08118 | C38, C57, C60, C62, I67, C84, V97 |
| 238 | Annexin A6 | P08133 | A26, L29, A32, M33, I43, L44, I47, V58, Y62, L70, I71, L74, L85, I86, V87, L89, M90, A98, I101, A104, I105, C114, L115, I116, I118, L119, M127, L130, A133, Y134, L142, I146, I147, M157, L158, V159, L162, V177, V181, L184, A187, F199, I200, I202, L203, L211, V214, F215, Y218, I226, I230, L241, M242, L243, A244, V245, V246, C248, I249, F256, A257, L260, A263, M264, L274, I275, I277, M278, V279, L284, M286, L287, I289, I292, F293, L301, I305, L317, L318, L320, V338, A339, W343, V357, A369, L372, A375, M376, I386, I387, I390, I401, F405, L413, M414, L417, L428, I429, L432, M433, Y439, A441, W44, A447, M448, A457, L458, I461, L462, A463, I470, I473, A476, Y477, L485, L489, I500, L501, A505, A519, A523, V525, A526, I529, L530, I532, F547, M548, I550, L551, L559, V562, F563, F566, V574, I578, A589, F590, A592, I593, V594, V597, L602, F604, A605, L608, M612, L622, I625, M626, I632, L634, L635, I637, F641, L649, I653, A664, L665, L666, L668, C669 |
| 239 | Multidrug resistance protein 1 (EC 3.6.3.44) | P08183 | A58, M75, L107, M111, Y118, V125, A129, F135, C137, A139, A140, I144, I147, F151, F152, A154, I155, M156, I160, L171, L175, V179, I182, I186, A198, V206, L214, I218, A233, A250, A254, V257, A260, V264, A266, F267, Y277, L281, A284, A292, A301, A302, A308, A311, A313, F314, L332, V334, F335, V338, A348, A358, A362, I365, I369, I375, L392, V397, L410, L413, V417, V423, A424, L425, V426, C431, L439, M440, V451, I458, I461, V463, L466, I470, V473, L479, F480, I484, I488, I500, V504, A507, A509, I513, V524, I539, A540, I541, A542, A544, I551, L553, L554, A557, V569, A572, L573, A576, I583, I585, V592, I598, A599, F601, L615, Y622, I700, C717, A718, I735, I736, L754, L758, F759, L762, A780, L784, L788, V792, F793, M796, L797, L818, A822, V825, A828, A834, A841, L857, A897, A900, I901, F904, V907, F916, A935, C956, A961, L976, V977, F983, A1001, A1005, H1007, I1008, V1035, F1037, V1040, F1042, L1053, L1056, V1060, L1066, A1067, L1068, V1069, V1079, L1082, L1083, V1094, I1101, L1104, V1106, L1109, L1113, V1116, F1123, A1128, I1131, I1145, A1148, A1149, A1152, I1154, Y1165, V1169, A1185, I1186, A1187, L1190, L1198, L1199, V1214, A1217, C1227, I1228, I1230, I1237, I1243, V1244, V1245, L1260, Y1267 |
| 240 | Mineralocorticoid receptor | P08235 | C603, V605, V617, C620, C623, F627, A630, C645, I647, A657, C658, C663, M668, L742, A752, L765, L769, L772, M777, W783, A784, L787, F790, L801, W806, L809, F812, L814, L827, A830, L833, F835, C849, I855, F859, L862, L864, F866, Y869, I871, M872, V874, L875, L876, L877, L878, F892, M895, L903, V907, L924, L927, L928, M931, F943, V954, L960, I964 |
| 241 | Beta-glucuronidase (EC 3.2.1.31) | P08236 | W45, F47, L68, V99, W100, Y101, V119, V120, I123, A130, V132, L147, I168, I170, A171, I172, L176, F208, Y211, L214, V218, L220, V244, L258, V260, L262, V282, W288, L303, V305, L307, A309, V324, F336, I338, F345, H346, V348, L373, L376, A378, A380, F381, Y386, Y388, M395, V402, V403, I404, C407, L412, H426, M430, V433, A442, V444, |

TABLE 5-continued

| SEQ ID NO. | Protein Name/Strain | UniProt ID No. | TARGETS: Exemplified Sites of Mutations to Generate Peptidogenic Protein (Each position can be substituted alone or in any combination with any of the other listed amino acid positions.) |
|---|---|---|---|
| | | | M445, W446, V448, A449, A459, L463, M465, V466, V479, V482, A493, V498, I517, L521, F525, I536, I537, Y541, A543, Y561, L565, L566, Y569, L573, V581, L585, I586, F589, F592, V601, I608, F609, A618, A619, L622, Y626 |
| 242 | ATP-dependent 6-phosphofructokinase, muscle type | P08237 | I18, A19, V20, L21, A27, M30, A32, A33, V34, A36, V37, V38, A46, V48, V51, L58, V59, V73, L77, A101, A102, L105, L113, C114, V115, I116, L122, F128, L135, V159, L161, V162, I165, F169, I176, A181, I185, M186, V189, A196, F203, V204, L205, V207, C212, L215, A216, L217, F229, I230, L243, C244, L247, I260, I261, V262, A263, A266, I279, V283, V284, V293, L296, A307, L312, A320, V321, L324, L325, A333, V335, V336, L348, V358, A370, A389, A404, V405, M406, V408, A412, A413, M415, A417, A418, V419, V423, V433, L434, V435, V436, F440, V456, I481, V494, I495, I496, A501, Y502, L506, C519, F522, V523, V524, I525, A527, V533, V540, A542, A545, C550, C553, A560, V567, F568, I569, I570, C577, L580, A581, A584, L586, A587, I595, L605, V609, L612, M616, L624, V625, L626, I640, Y644, A676, M679, A683, M684, M687, I691, A702, V710, L711, V723, L726, W742, L745 |
| 243 | Neutrophil elastase (EC 3.4.21.37) | P08246 | I30, V45, L47, A57, L59, V65, M66, A68, A69, V72, A73, A79, V80, V82, L84, I118, V119, I120, L121, V133, A153, M154, W156, A166, L172, V174, C187, L206, V207, C208, I212, I215, A216, C223, A231, F232, A233, V235, I242 |
| 244 | 72 kDa type IV collagenase (EC 3.4.24.24) | P08253 | A50, L54, C60, L74, M77, L83, I124, L135, V140, A143, F144, A147, F148, W151, L157, A167, I169, I171, F173, F184, A192, F195, F207, L212, W213, V221, V223, Y225, G226, A228, C233, F235, F237, C247, W258, C259, C274, A286, C291, F295, C305, W316, C317, C332, A347, C349, F353, F355, W374, C375, A376, A379, Y381, W387, C390, L397, F398, V400, A401, A402, F405, H407, A408, M409, L411, A419, L420, M421, A422, Y427, L433, I441, L444, I478, A479, I485, F487, F488, I493, W494, A522, V523, Y524, A526, V533, F534, F535, Y543, L556, V568, A570, A571, F572, I582, F583, I606, L617, A619, V620, V621, F631, F632, L640, W657 |
| 245 | Neuraminidase (EC 3.2.1.18)/strain A/Equine/Kentucky/1/1981 | P08326 | I104, V112, V114, F119, V120, F130, F131, L132, L156, V159, A176, W177, A179, A181, C182, M189, V191, V193, A200, V201, A202, V204, L222, C231, I232, Y237, V239, M240, A249, Y251, I253, A256, I261, H273, I274, C277, C279, Y280, V286, C288, V289, C290, L302, I304, C316, I319, F349, F351, V357, W358, A359, I363, F371, I373, I374, I393, I394, L397, F406, L418, C421, F422, W423, V424, M426, W437, I443, M445 |
| 246 | Neprilysin (EC 3.4.24.11) | P08473 | A66, L69, F83, A87, C88, L118, L122, A132, A136, A138, L139, L157, L158, I164, W167, V169, W174, A184, A187, I188, A189, L191, I201, L203, I217, H218, I219, Y231, A244, Y245, F248, M249, V252, A253, I256, M273, V276, L279, I283, A284, A286, M303, L305, A306, I308, L314, I316, W323, F326, I330, M331, I336, V344, V345, V346, A348, Y351, L352, L355, L359, L367, M371, W373, I376, V380, L383, Y387, F394, C411, A412, V415, M419, A422, V423, Y427, V440, I444, I447, V450, F451, L455, A463, A469, A473, A475, L493, Y497, L500, A539, I553, V554, F555, F564, F565, L573, I578, M580, I582, I586, F590, F615, M622, Y626, A634, I649, A650, A658, A661, Y662, L685, F686, F687, L688, F690, A691, V693, C695, A703, I719, L723, F729, C735, M741, V749 |
| 247 | Integrin alpha-IIb | P08514 | L34, Y42, F50, L54, H57, I66, V67, V68, A70, V84, C87, L115, L124, V128, I135, V136, A137, C138, A139, W144, V146, A153, V158, C161, L163, A164, A172, Y174, C198, A200, L212, V213, L214, A216, L225, L226, A227, A229, V231, I234, L243, V247, Y284, V285, V286, A288, W291, A297, V298, I300, L301, F320, A325, V329, L337, L338, V339, A341, A354, V356, V359, Y360, L361, L378, F387, A392, L394, L397, I405, A406, V407, A408, V420, V422, L438, A447, F448, Y463, L466, I467, V468, A470, V476, A477, V478, Y479, A481, V485, I518, V522, L535, A537, L539, L541, V552, A581, I596, L598, L600, C633, L662, L664, A675, A681, V682, A688, A693, V715, V716, M724, M734, V736, F750, L752, I754, A775, Y815, L817, V825, L828, I832, V919, C921, M926, V934, L940, L945, L955, A959, V982, L986 |
| 248 | Apolipoprotein | P08519 | C4145, W4148, C4173, C4184 |
| 249 | Pleckstrin | P08567 | V26, V27, L28, I33, F35, I48, V68, F69, I71, H79, F81, W92, I96, I100, M133, I140, C155, F156, V161, I162, L165, A181, L184, L190, A200, F209, A215, Y217, F219, L251, F266, L268, A273, L275, H276, I290, L292, L314, F315, I317, L327, A329, W338, I342, A345 |
| 250 | Collagen alpha-2 | P08572 | L1492, L1518, Y1519, L1531, Y1565, W1566, L1567, I1587, C1590, V1592, C1593, A1595, F1625, H1628, A1630, C1646, F1655, I1656, C1658, C1665, C1705, V1707, C1708, M1709 |
| 251 | Receptor-type tyrosine-protein phosphatase C (EC 3.1.3.48) | P08575 | C226, F246, A248, V279, I281, L295, V297, V301, I319, L321, F340, C365, I369, I408, W410, F420, L422, L444, L455, L457, A459, A463, M499, V501, L518, V520, F537, F550, A552, F554 |
| 252 | Hepatocyte growth factor receptor | P08581 | A48, I62, F63, L64, A66, I70, Y71, V72, L73, L78, L130, I131, C133, C141, H144, I154, I161, C175, V176, V177, I193, F195, F196, V197, I214, V216, L219, I235, V237, Y245, I259, Y260, F261, L262, I278, I279, F281, L288, Y291, M294, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | L296, C298, I299, L300, F314, I316, L317, A319, L329, A330, I341, F343, G344, V345, F346, A347, A354, A361, M362, C363, F365, I367, V370, V383, L386, H388, F389, L424, L429, F430, L439, I442, I452, A453, L455, F462, V465, V467, H476, V477, V486, L503, V504, I505, I510, I513, L515, L518, C520, C529, C541, C561, A573, L581, I583, F588, V603, L622, C624, I638, I640, F652, I659 |
| 253 | Complement factor H | P08603 | C21, A48, Y50, V62, C66, C80, V108, A110, C129, C141, V144, C146, V174, F176, M190, C192, C205, Y227, F233, Y235, A249, C251, C325, V347, Y355, I372, C389, F391, L394, V414, L422, V429, C431, Y467, A473, C494, C505, L532, I551, C553, C569, Y587, L593, F595, V609, C611, L636, V655, Y657, I671, C673, C684, Y709, V715, F717, I731, C733, C744, C753, L761, F771, I777, C792, C870, I876, C915, C926, V942, V955, A971, C973, C984, C1048, Y1067, V1073, V1089, C1109, I1120, V1134, Y1136, C1138, L1144, I1150, C1152, C1167, I1169, M1174, I1179, L1181, L1189, V1197, F1199, C1218, L1223, C1228 |
| 254 | Genome polyprotein [Cleaved into: Protein VP0/genotype IB (isolate HM175) (HHAV) (Human hepatitis A virus (isolate Human/Australia/ HM175/1976)) | P08617 | W91, V106, V107, L110, V117, L121, A127, F129, I131, V135, L147, I148, A150, M151, V152, V202, I207, V209, L213, V227, A229, F231, A306, V326, Y329, F331, L346, A347, C350, W356, L360, L376, C379, V418, A443, I444, I448, Y450, C451, V465, L471, F600, Y628, V644, V702, I722, Y727, L734, C738, L841, F869, L880, I907, I911, F914, L953, L954, I962, V1528, V1533, F1535, V1537, M1548, A1550, L1551, V1553, L1558, L1559, V1560, F1576, F1578, V1604, V1605, L1606, M1607, V1609, I1618, I1623, A1631, A1636, L1638, V1639, L1654, V1676, A1679, W1680, M1690, A1694, L1695, V1696, I1706, L1707, I1709, A1712, L1718, V1719, A1720, L1722, V1723 |
| 255 | 40S ribosomal protein S17 | P08708 | V9, A13, I17, C35, I50, A51, V54, I61 |
| 256 | Coagulation factor VII (EC 3.4.21.21) | P08709 | C141, I213, C219, V228, L229, L230, L242, V248, V249, A251, A252, L264, A266, L268, V285, V288, I289, Y294, I303, A304, L305, L306, V318, L321, L333, V341, W344, A354, V362, C370, M387, F388, C389, A390, H408, A409, H411, L418, I421, V422, V436, Y437, V440, Y443, I444, W446, L447, L450, A463 |
| 257 | Interleukin-6 receptor subunit alpha | P08887 | L45, C47, V50, V58, W60, V86, Y94, C96, V130, C132, L148, L149, V150, C176, L178, Y188, V190, M192, V194, L234, V236, L251, F253, L255, Y257, A259, V270, L273, I279, A282, H288, V290, L292, A294 |
| 258 | Dihydropteridine reductase (EC 1.5.1.34) | P09417 | V13, L14, V15, C26, V27, F30, V37, A38, V40, V67, V71, V80, A82, I83, L84, C85, M107, L121, A122, L131, L132, L134, A153, V157, H158, C161, A176, A177, I178, A179, V180, L181, L208, F212, L227, I228, V230 |
| 259 | Fructose-1,6-bisphosphatase 1 | P09467 | L14, F17, V18, L34, L38, A41, V42, I45, A52, L74, V82, L86, A91, C93, V94, L95, V96, V106, V115, V116, C117, F118, L121, V133, I136, F137, I139, Y140, A153, A162, A163, Y165, A166, L174, V175, L176, A177, V182, C184, F185, F194, A223, V224, Y227, V250, V253, L257, I262, F263, L264, L278, L279, Y280, C282, M285, A286, Y287, V288, M289, A292, A296, V303, L304, I311, A315, V317, I318, L319, V325, F328, V331 |
| 260 | Macrophage colony-stimulating factor 1 | P09603 | C39, I43, L51, L54, F69, V70, L75, C80, A85, V89, M93, L112, L115, L119, C122, C134, L145, V149, V152, F153, L160, F167, C171 |
| 261 | Platelet-derived growth factor receptor beta | P09619 | L52, C54, V60, W62, L85, L90, C100, Y117, I118, F119, V120, I147, C149, V151, L160, C190, V225, I231, L233, C235, V237, L265, L276, I278, Y289, C291, V293, I308 |
| 262 | Pro-cathepsin H [Cleaved into: Cathepsin H mini chain; Cathepsin H (EC 3.4.22.16); Cathepsin H heavy chain; Cathepsin H light chain] | P09668 | V240, V279 |
| 263 | Ubiquitin carboxyl-terminal hydrolase isozyme L1 | P09936 | M12, L13, V16, L17, L20, V22, A23, V42, C47, A48, L49, L50, L51, L52, F53, I67, M82, I86, L95, I96, H97, A98, V99, L114, F117, L118, A130, F133, I139, A142, H143, V146, A147, F160, H161, F162, I163, L164, F165, L172, Y173, L175, M179, L193, L194, A197, A198, C201, V212, V217, A218, L219, C220 |
| 264 | Leukotriene A-4 hydrolase | P09960 | C8, V16, C17, L22, V28, L35, A39, L41, V43, L53, L55, V65, I67, M87, I89, A94, L95, I103, I105, F107, A115, L116, L119, Y131, L132, F133, C136, A138, C141, A143, L145, C147, V153, Y157, A159, V161, V163, L167, A169, L170, A173, F192, I198, C200, Y201, L202, A204, V206, V207, V221, V228, F235, M241, L242, A245, L248, L259, L260, V261, L262, F266, C275, L276, F278, V279, L283, I294, A295, I298, H300, W302, V307, W312, W316, L317, H321, Y324, L325, H328, I329, A343, L344, L350, L366, L370, V382, F388, A389, L390, L391, F392, L394, L397, L398, F404, F407, L408, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | Y411, V412, I420, W425, L429, L440, W448, C469, W476, F487, F503, L504, I518, M521, F527, I535, W539, L540, L542, C543, I544, A551, L554, A555, A559, F567, L571, F572, L575, A585, Y589, H597, L603, V604 |
| 265 | Complement C4-A | P0C0L4 | L24, L25, F26, V31, L37, V39, V41, L43, V52, V56, L76, L87, A94, L110, V111, A112, I130, L132, I149, Y150, V156, Y158, V160, A162, I174, V176, V178, I215, A217, F219, F231, V233, F241, I252, I266, A268, I271, V276, A280, V282, L286, L305, F319, V340, A341, A343, I345, L378, A382, L386, V390, V403, V405, A407, V409, V431, I433, I435, L444, A450, V462, L473, L491, M508, L510, V529, V533, F541, F543, V544, A545, F546, Y547, V560, A564, L633, V646, F647, L652, F654, I687, C703, A720, C735, A739, F833, L835, L837, L855, L863, V865, V867, V889, V897, V901, V913, V914, A915, V927, L931, V945, L948, V978, V980, A994, L995, V1000, A1001, M1015, I1016, L1018, A1019, A1023, A1024, Y1027, L1028, A1045, I1049, I1056, Y1066, A1067, A1068, W1077, L1078, A1080, V1082, L1083, V1085, L1086, A1089, L1107, F1117, L1132, V1139, A1140, L1141, A1143, F1144, V1145, I1147, A1148, L1149, V1168, A1175, L1179, A1192, A1193, A1194, I1195, A1197, A1199, L1200, A1205, L1210, A1213, L1217, W1230, I1262, A1266, Y1267, A1268, L1269, H1271, A1282, A1285, L1289, V1306, I1307, A1308, A1311, L1327, V1329, L1331, L1358, I1366, V1368, L1378, Y1384, L1501, V1512, V1522, L1524, F1538, A1540, L1578, A1617, Y1625, F1627, V1629, F1643, I1647, F1667, V1669, Y1683, L1684, I1685, M1686, Y1701 |
| 266 | Complement C4-B | P0C0L5 | L43, I149, I271, L305, V409, L510, A564, L652, I1366 |
| 267 | Serum amyloid A-1 protein | P0DJI8 | M35, A38, F54, A56, A62, A72, A73, A99, A100 |
| 268 | Serum amyloid A-2 protein | P0DJI9 | A72, A99 |
| 269 | Transcriptional activator GLI3 | P10071 | C548, L563, C578 |
| 270 | HLA class I histocompatibility antigen, Cw-7 alpha chain | P10321 | M29, Y31, A35, F46, V52, F57, V58, F60, A73, W75, V76, Y83, Y91, A95, L102, L105, L119, M122, C125, L127, Y142, Y147, I148, L150, L154, W157, A163, A164, A176, A177, L184, C188, V189, L192, Y195, L196, L203, V213, A223, L225, C227, A229, F232, Y233, L239, W241, A269, A270, V271, V272, V273, Y281, C283, M285, H287 |
| 271 | Hemagglutinin [Cleaved into: Hemagglutinin HA1 chain; Hemagglutinin HA2 chain]/strain B/Bonn/1943 | P10448 | A50, L61, C62, C65, L71, A74, L75, C80, A87, V89, V91, C102, I112, L115, L119, A135, Y143, I145, C151, F161, M164, A165, W166, A167, V168, V180, V182, I193, V195, W196, H199, M206, Y210, F218, I251, V253, I266, Y268, I272, L273, L274, V278, A281, I288, C300, L301, H302, A385, A511 |
| 272 | Lysosomal protective protein (EC 3.4.16.5) | P10619 | L54, H61, L62, H63, Y64, W65, F66, V67, V78, V79, L80, W81, L82, L91, L94, L95, H98, F101, W117, A121, V123, L124, Y125, V132, F134, V149, A156, L157, F160, F164, Y167, L172, F173, L174, Y179, A180, I182, Y183, I184, L187, A188, V189, V191, L202, V204, L208, L218, V219, A222, L236, F248, C256, L260, V263, V267, V297, V298, M327, A337, Y340, L341, V346, L350, W359, C362, V366, Y370, M377, Y381, L382, L384, L385, L393, L394, Y395, M401, F411, V412, W426, V428, V441, I447, A448, F449, L450, I452, A455, H457, V459, A466, A467, M470, F471, F474 |
| 273 | Mast/stem cell growth factor receptor Kit | P10721 | I54, L56, C58, W66, Y95, C97, I107, V109, V111, F118, V134, C136, I170, I172, V175, L184, C186, V188, F200, L202, V213, F229, V231, C233, I235, W246, A273, L275, A280, F288, C290, A292, V325, L333, V335, Y337, A339, W348, Y362, V374, L377, L382, Y390, F392, V394, F405, V407, V409, C428, A430, A431, W440, V473, V474, V489, C491, A493 |
| 274 | 60 kDa heat shock protein, mitochondrial | P10809 | A36, M40, V44, L47, A48, V51, V80, A81, A95, V98, V101, A102, A116, V118, L119, A120, I123, A124, I140, V144, A147, V148, A150, V151, L155, V162, I168, V171, A172, A176, I182, I186, A189, M190, F219, F228, C237, A242, V244, L245, L246, I251, I257, V258, A260, L271, V272, I273, I274, A275, V278, A282, L286, V297, V298, A299, V300, A302, L313, M316, A317, A319, V324, F325, L342, V345, V348, I349, V350, L357, L358, I371, I374, A395, L397, V401, A402, V403, L404, V406, V421, A424, A427, A430, A431, V437, L438, C442, A443, L444, L445, C447, I465, I467, I468, L472, A476, A480, I490, V491, I494, A507, M513, I519, A528, L529, A532, A533, A536, L539 |
| 275 | Thyroid hormone receptor beta | P10828 | C107, V109, A114, C124, C127, F131, C151, I153, C164, F166, C169, M174, V225, A228, H229, L246, A268, F269, I280, V283, F286, A287, L290, F293, L304, C308, C309, I312, L315, A318, L328, A335, V336, V349, F354, A371, L372, L373, A375, L377, L378, M379, I392, F399, A402, F403, L421, V425, L428, I431, A436, F439, M442, C446, L456 |
| 276 | Growth hormone receptor | P10912 | F64, C66, L84, C112, F114, Y125, I127, L129, C140, V143, V147, L160, A169, I171, V173, M188, L194, V217, L220, V228, V230, V249 |
| 277 | 78 kDa glucose-regulated protein | P11021 | V30, V31, I33, L35, C41, V42, V44, I53, Y65, V66, A67, F68, A80, V92, L98, I99, V108, V119, Y127, I128, V130, A141, I145, A147, L150, M153, A157, A159, V165, A168, V169, V170, V172, A174, A183, A187, A191, L193, V195, M196, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | A204, A205, A206, I207, A208, L211, I220, L221, V222, F223, L225, F230, V232, L234, L235, I237, F242, V244, V245, A246, L253, F258, V262, M263, F266, I267, Y270, V278, A284, V285, L288, V292, A295, L299, A305, I307, I309, Y313, F318, L322, F327, L334, F335, M339, V342, V345, L346, I356, I359, V360, L361, V362, I371, V375, F379, A393, V394, A395, A398, A399, V400, A402, L422, I426, I437, F451, V461, I463, V465, Y466, I487, I497, V499, F501, L509, V511, A513, V542, L565, Y568, A569, L572, M594, A597, V598, L605, F616, L623, V627 |
| 278 | Hemagglutinin [Cleaved into: Hemagglutinin HA1 chain; Hemagglutinin HA2 chain]/strain A/Duck/Ireland/113/1983 H5N8 | P11132 | V5, I19, C20, I21, A25, V32, I35, V42, I48, L49, L57, C58, L60, L66, L68, C71, V73, A74, W76, L77, L78, C83, F86, W92, Y94, I95, V96, Y107, L117, L120, L121, F127, I133, A150, C151, Y153, V163, V164, W165, L166, I176, L188, L189, I190, L191, W192, I194, H195, H196, A201, Y207, Y213, V214, V216, L221, M242, F244, F245, I248, L249, I255, F257, F263, I264, A265, Y268, A269, Y270, I272, I280, M281, C290, C294, A300, I301, H308, H311, I315, V322, L327, L329, A330, A349, M361, Y366, A388, I389, A440, L452, V459, L462, V466, L470, C481, H486, C488, C492, M493, A510 |
| 279 | Solute carrier family 2, facilitated glucose transporter member 1 | P11166 | I40, Y44, W65, I297, F298 |
| 280 | Solute carrier family 2, facilitated glucose transporter member 2 | P11168 | L10, A17, Y26, V30, I31, I38, Y42, W97, V101, F104, M128, A131, A139, M142, I154, Y164, C165, L171, V172, M174, Y175, I176, I179, W218, L221, L222, A229, L234, L236, L246, A256, L260, L263, M276, L294, I304, V306, A307, L310, I322, Y325, I329, F330, V360, F369, M373, M376, C379, A380, M383, A403, I404, F407, V408, I418, M422, V423, A424, F427, A435, A439, V465, F466, L473, I495 |
| 281 | Pyruvate dehydrogenase E1 component subunit beta, mitochondrial | P11177 | A38, I39, M43, L47, V53, L55, V60, A61, I82, A93, I95, A96, A100, I107, C108, F110, F113, A119, V123, A127, V140, I142, F144, F162, A163, Y166, V174, V175, A183, L186, I187, A190, V197, V198, V199, L200, Y206, F212, A216, I225, I237, V239, V240, V246, A252, A253, L256, C263, V265, I266, M268, I279, V283, L289, V290, I305, I309, A314, I337, I349, I353 |
| 282 | Integrin alpha-M | P11215 | F27, F34, V46, V47, V48, A50, L63, C66, A84, M87, L89, L102, L103, A104, C105, C123, F124, I151, A152, F153, L154, I155, I161, M169, F172, V173, V176, M177, L180, F187, L189, M190, Y192, F200, F202, F205, V215, A228, I231, V234, L238, I252, L253, V254, V255, I256, V271, I272, A275, V280, I281, V284, I285, V287, A290, F291, L300, I303, A304, F313, V315, F318, A320, L321, L328, I332, F333, L365, L366, V378, I390, M399, L404, I411, L419, V420, L421, A423, V432, A433, M434, F435, V464, V466, L474, V475, L476, I477, A479, V491, V493, C494, L509, F520, L527, V530, V538, A539, I540, A542, A551, V552, Y553, L554, F555, I571, A572, L580, F583, L601, V603, A605, V609, L612, V617, L618, V631, V657, I670, V674, L680, A689, F691, L714, L716, L718, I729, L731, L733, L748, F764, L792, V794, F800, V802, V804, V806, V818, F820, F822, C864, I881, F883, A889, L895, L897, A899, V925, M951, H953, Y955, V957, L965, I967, L969, F971, V973, L977, I982, W983, L1014, V1020, A1025, C1027, C1032, F1037, I1039, F1043, A1045, L1047, L1051, W1055, L1064, I1066, A1070, I1072, V1097 |
| 283 | Glycogen phosphorylase, muscle form (EC 2.4.1.1) | P11217 | V16, V25, L28, L36, F54, A55, A57, V60, L64, I83, Y84, Y85, L86, L88, F90, L96, M100, V101, L105, A108, C109, L118, L123, L132, L137, L140, A141, A142, C143, F144, M148, A149, L151, L153, A154, A155, Y156, Y158, I160, Y162, V201, F203, V222, A224, V238, V239, M242, L244, W245, A247, A273, I276, L280, L294, Y298, F299, V300, V301, A302, A303, L305, I308, I309, F317, F327, F330, V334, I336, L338, L345, A346, I347, L350, M351, L354, L357, M360, A365, V368, C373, A374, Y375, V380, W388, L392, L393, L396, L397, H400, I403, I404, I407, F411, V415, A418, M429, L431, V432, I440, M442, A443, L445, C446, I447, A448, A452, V453, V456, A457, I459, H460, L464, F469, F472, L475, I487, W492, L493, V494, A501, V503, I504, F512, I513, L516, L519, L522, L523, F531, I532, V538, L544, F546, L550, L563, F564, I566, I571, Y574, L578, L579, C581, L582, H583, V584, I585, I591, V604, M605, I606, A610, A611, M616, A617, I620, I621, L623, V624, A626, I627, V630, V631, A636, V637, L641, V643, L646, L653, A654, V657, I658, A660, A661, L663, I667, A670, M680, F682, M683, L684, A687, L688, I690, A696, M700, A701, F712, A729, I736, L739, V742, I743, L746, F759, I762, M765, L766, F772, F775, Y778, Y781, I782, C784, V788, Y792, V802, I803, I806, A807, F812, I818, A819, Y821, A822, W826 |
| 284 | Spike glycoprotein/strain A59 (MHV-A59) (Murine hepatitis virus) | P11224 | I16, V44, L79, V87, Y96, I104, A106, V108, L111, A121, I128, F132, V140, I148, A150, V152, C153, I157, C158, C165, F202, H205, A215, F226, Y240, V241, F244, I245, C246, Y258, Y268, L269, F270, I292, V319, C354, F385, F393, V395, L411, A414, Y416, Y429, A468, C471, V474, C479, C481, A482, A499, A529, I534, I549, F550, A551, L585, F594, F619, A641, L652, C658, V661, C682, C706, C775, C780, C786, V800, L876, Y891, V900, V906, I912, A931, V952, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | I956, A980, A994, I998, I1030, A1039, L1046, I1047, A1053, L1054, L1067, A1072, A1075, V1079, I1099, V1103, Y1111, F1112, I1113, H1114 |
| 285 | Acetylcholine receptor subunit beta | P11230 | W141, C151, Y157, C165, V329 |
| 286 | Ras-related protein Ral-A | P11233 | H15, V17, I18, M19, V20, V25, L30, F34, V55, L57, V62, I64, I66, L67, A70, I78, F83, F89, L90, C91, V92, F93, I95, F101, F107, I111, V114, V120, F122, L123, L124, V125, L131, V137, A142, A146, A158, V164, V167, F168, L171, M172, I175, M180 |
| 287 | Medium-chain specific acyl-CoA dehydrogenase, mitochondrial | P11310 | A27, A52, F55, A56, I60, A65, I78, A81, M87, I91, C106, L107, I108, L112, A113, C116, V119, A122, M131, I133, Y145, L146, M149, C156, A157, C159, I172, I185, I192, W200, Y201, F202, L203, L204, A205, A215, A218, F219, F222, I223, V224, I233, C244, I250, F252, V255, V257, L263, V272, A273, A276, V283, V284, A285, A286, A288, V289, L291, A292, A295, A299, A303, M326, V330, A333, M335, A340, A341, A354, A357, A361, A365, L368, A369, A372, V387, A394, Y397 |
| 288 | Fibroblast growth factor receptor 1 | P11362 | L51, L53, C55, V86, V88, C101, F114, V174, F176, C178, I215, M217, V220, Y228, C230, V232, F275, C277, C341, A343, L356 |
| 289 | Glucose-6-phosphate 1-dehydrogenase | P11413 | I33, F34, I35, I36, M37, A39, A44, I48, I52, W53, L55, I67, V68, Y70, A71, F88, F101, Y118, L121, M125, A134, L137, F138, Y139, L140, Y147, V150, I154, C158, I167, I168, I196, Y197, I199, Y202, M207, I230, C232, V233, L235, I255, I256, V259, M260, L264, L265, M267, L268, C269, V271, A272, M273, V284, Y308, Y322, F337, A338, A339, V340, V341, L342, V344, W349, F354, I355, L356, C358, A361, A367, V369, L371, V391, I392, V394, A399, L440, V444, F452, I464, F465, A492 |
| 290 | Dystrophin | P11532 | V25, F29, L40, L50, L51, L54, V77, A80, L81, L84, I99, I111, I114, L140, W143, V144, V156, A168, A171, L172, I173, L196, A199, F200, A203, I228, Y231, I232, L235, Y344, L348, L355, V375, H382, I399, V420, L427, L445, L3053, V3070, Y3073, M3088, L3098, A3109, L3112, L3115, L3119, L3121, A3129, M3145, I3150, C3153, L3154, Y3158, V3175, C3178, L3179, W3181, L3182, L3183, F3199, I3204, L3206, C3207, C3229, L3234, L3238, I3242, I3244, V3263, C3266, W3294, L3295, V3297, L3298 |
| 291 | C-1-tetrahydrofolate synthase, cytoplasmic | P11586 | L20, V24, L38, A39, I40, L41, I53, A60, I63, V81, I85, V94, F97, L98, V114, V124, L135, C152, L155, I156, A168, V169, V170, M181, L185, C195, V206, I211, L212, V213, V214, V222, I227, A231, V233, I234, V256, A261, I268, M278, A281, L283, M284, A291, L393, V394, A396, L397, V405, F406, A407, V480, L497, I502, F518 |
| 292 | Cholesteryl ester transfer protein | P11597 | A26, V29, A36, A51, V72, I103, V106, V108, I188, I200, I207, F267, L313, V328, V329, A336, C350, F367, V376, F380, L426 |
| 293 | B-lymphocyte antigen CD20 | P11836 | F146, L147, L152, I162, I164, C167, Y182, C183 |
| 294 | Amyloid beta A4 protein | P12023 | Y476, A479, V490, Y497, L509, F512, A523, I537, L548, M580, L749, M752 |
| 295 | Collagen alpha-3 | P12111 | C3112, C3158, C3162 |
| 296 | Coagulation factor V | P12259 | V36, A37, A38, V65, Y66, L85, L86, A92, I98, V100, F102, L110, I112, H113, A126, V142, Y150, W152, I154, C167, I171, Y172, L186, I187, L190, I192, C193, L213, L214, F215, A216, F218, V234, V238, I245, V247, I253, W255, H256, L257, L258, F267, I269, H270, F271, L276, L288, V289, A296, M298, W306, I308, H315, M320, I324, I354, A355, A356, Y363, Y391, V394, M395, L431, F435, Y443, Y483, I487, C500, A516, L519, L523, L524, I525, C526, A546, F548, M586, I589, V593, V608, W610, H611, F612, I621, I624, H629, F631, L643, V651, V653, M655, W661, L663, L675, F679, I1584, A1585, A1586, V1618, F1620, I1643, I1648, A1650, I1656, V1658, F1660, Y1668, L1670, H1671, A1672, L1675, Y1677, Y1708, W1710, A1712, A1729, Y1730, L1744, I1745, L1748, I1750, C1751, F1769, V1770, L1771, L1772, F1776, A1807, I1808, L1818, M1820, V1826, L1828, L1830, I1839, H1840, V1841, V1842, F1844, H1845, L1849, L1864, L1872, W1882, L1884, V1888, M1896, F1900, I1902, C1907, L1913, A1937, A1947, W1948, I1963, V1971, F1993, F2032, I2043, L2054, L2056, M2072, A2101, A2111, W2112, A2114, L2123, I2125, I2133, A2135, I2136, C2141, V2150, Y2153, I2155, F2178, I2196, I2201, V2203, I2212, A2213, L2214, L2216, L2218 |
| 297 | Low affinity immunoglobulin gamma Fc region receptor II-a | P12318 | A41, L53, V58, L60, C62, I73, W75, A94, Y102, C104, L117, L120, L124, V125, L126, L131, F133, I139, L141, C143, H144, V154, F156, F157, F172, A177, Y185, C187, I203, V205 |
| 298 | Bone morphogenetic protein 2 | P12643 | F305, C329, A343, M371, C393, C395 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 299 | Bone morphogenetic protein 4 | P12644 | F317, C341, A355, M383, C405, C407 |
| 300 | Angiotensin-converting enzyme | P12821 | A46, F49, A57, A86, W97, A101, Y105, L117, I121, L132, M147, L172, L176, L185, L186, A188, W189, W192, H193, A196, L200, Y204, F207, A214, Y231, L240, Y244, L247, Y251, L254, H255, A256, V258, L262, I271, I277, A279, H280, L282, A287, W290, I293, V297, L306, V308, M312, A319, M322, F323, A326, F329, F330, L333, F342, F366, F372, I374, V388, H389, M392, I395, Y397, Y401, L408, F416, A419, I420, V423, L424, L426, L434, L439, Y453, L454, L455, M457, A458, L459, A463, L465, F467, L470, V471, W474, W492, L495, I502, C503, F513, A515, A517, V521, F531, V532, V535, L536, F538, F540, H541, L544, C557, I559, A565, L569, L573, V584, L585, A596, L599, Y602, F603, V606, A649, F652, Y674, Y700, A704, I717, I720, I721, L732, M747, L770, M774, L783, L784, A786, W787, W790, A794, I798, Y802, Y805, L808, A812, A821, Y829, L838, F842, L845, L848, Y849, L852, H853, A854, V856, A859, L860, I869, I875, A877, H878, L879, L880, A885, W888, I891, V895, A901, M904, A909, M910, M920, F921, A924, F927, F928, L931, F940, L946, V956, F964, F970, I972, L983, A986, H987, M990, I993, Y995, Y999, V1004, A1005, L1006, A1010, F1014, A1017, I1018, V1021, L1022, A1023, L1024, V1026, L1032, L1037, F1051, L1052, M1053, M1055, A1056, L1057, I1060, A1061, I1063, F1065, Y1067, L1068, V1069, W1072, W1090, L1093, L1100, C1101, F1111, A1115, I1119, F1129, V1130, I1133, I1134, F1136, F1138, H1139, A1141, L1142, C1143, H1153, C1155, I1157, A1163, L1167, A1170, M1171, F1175, A1182, M1183, I1186, A1194, A1196, M1197, Y1200, F1201, L1204, L1208 |
| 301 | Cadherin-1 | P12830 | C163, I178, V188, V204, F205, L214, V216, L220, Y228, L230, A234, M246, I248, I250, V252, F262, V271, V284, A301, M316, I326, V328, Y341, L343, V344, V345, A347, A348, A359, A361, I363, V365, L396, L436, L442, L452, V454, V456, A471, V473, V475, Y508, I542, L548, Y561, A563, I565, A567, L581, L583, I600, I612, I650, L652, I665, L667, L669, M670, L681, V683 |
| 302 | Xaa-Pro dipeptidase | P12955 | V18, L22, F23, L30, C31, L34, I45, V46, V47, F71, H72, W73, A74, F75, V77, C82, V85, I86, V88, L95, F96, V97, L136, L144, L145, L176, I180, V185, V194, L195, A205, H206, V209, M210, L222, F226, C243, C245, I267, M272, C273, F275, M277, Y281, F284, A285, I288, F292, V305, Y306, A308, V309, V316, W326, H330, A333, L338, L341, I346, M354, L359, F363, M364, L368, L372, L394, L397, L403, M407, V408, L409, V411, I415, Y416, L422, A425, F443, V449, I451, V455, I475 |
| 303 | Hemagglutinin [Cleaved into: Hemagglutinin HA1 chain; Hemagglutinin HA2 chain]/strain A/Gull/Maryland/704/1977 H13N6 | P13103 | I21, C22, V23, V34, V44, I51, Y59, C60, L70, F75, I79, V80, Y96, L97, L119, L122, F123, I126, F129, I135, C151, F167, I177, V189, L190, V191, L192, I195, Y208, V217, M243, I245, I250, I256, F258, F264, L265, A266, Y271, I273, F282, C295, I302, L328, A348, Y365, A387, L461, L469, H485, C487, C491 |
| 304 | Platelet glycoprotein Ib beta chain | P13224 | V37, C39, L60, L62, L67, A69, L70, W91, C93, L97, L100, L104, L116, C118, L128, L129, L137 |
| 305 | C-C motif chemokine 2 | P13500 | C34, C35, C59, A63, V64, I65, F66, I74, A76, V83 |
| 306 | Cystic fibrosis transmembrane conductance regulator | P13569 | V1240, L1242, L1253, F1257 |
| 307 | Integrin alpha-4 | P13612 | Y44, F52, H59, L67, V69, A71, A74, A87, C91, L106, V142, C144, L160, C165, A196, C198, A200, V212, M213, A215, L225, V227, V245, L251, F260, V268, V269, A272, H275, A281, Y282, I283, F284, L291, F306, V313, L315, L323, L324, V325, A327, V339, V341, A349, A366, F368, L375, I378, V386, A387, I388, A390, A399, I400, Y401, Y403, I418, F430, Y445, A449, V450, A452, A458, V459, L460, L461, V466, F502, M519, L521, F535, V550, A562, A579 |
| 308 | Sodium/potassium-transporting ATPase subunit alpha-3 | P13637 | H34, M36, V41, A58, L94, A98, C101, V125, V130, V161, I162, V175, V176, L180, V181, A191, L193, I195, C201, V203, F234, C239, A244, V247, V248, A264, I278, A289, A310, I312, F313, I317, L326, V332, A338, C346, V354, C364, L371, M376, A379, M381, W408, A410, L411, I414, A415, L417, C418, A421, V432, A445, L446, V457, L480, I482, H483, Y493, L494, L495, V496, M497, I504, L512, Y532, L535, F545, C546, H547, L550, L573, C574, F575, V576, L578, M581, A587, V589, A592, V593, C596, A599, I601, I604, M605, A614, A616, A618, I623, I624, A635, A636, A650, A652, I678, V679, F680, A681, I691, V692, C695, V702, V709, A714, L715, A718, I720, V722, A723, M724, I739, L740, F745, V752, L757, I758, Y768, L770, F783, L792, I800, A809, L812, L834, V835, L839, A843, I847, Y859, I862, L863, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | F868, L873, W880, C908, A911, F912, F913, V914, I916, V917, V918, V919, L924, I926, C927, L944, L948, A955, L968, M970, A981, I988, L999, Y1013 |
| 309 | Delta-aminolevulinic acid dehydratase | P13716 | L31, Y33, I35, F36, V37, L50, V53, Y56, L61, L65, V76, L77, I78, F79, V81, A94, A101, A104, I105, L108, L115, V117, C119, V121, C122, L123, H129, C132, L134, L150, A151, V153, A154, Y157, C162, V164, V165, A166, M170, M171, V175, I178, L182, V193, M194, Y196, A198, F200, A211, A212, A234, V238, L249, M250, V251, V261, V264, H268, L273, A274, V275, Y276, H277, V278, F282, V300, A303, M304, F307, A310, A312, I315, I316, Y318, Y319, L323, L324 |
| 310 | Tissue factor (TF) (Coagulation factor III) | P13726 | A41, F51, L55, Y66, V68, I70, C89, L91, I95, A105, V107, V155, V157, V159, L175, F179, L183, Y185, L187, Y188, Y189, F207, I209, V211, F219, V221, A223, V224, I225 |
| 311 | HLA class I histocompatibility antigen, alpha chain E | P13747 | L26, Y28, H30, F43, V49, F54, V55, F57, M66, A70, W72, M73, Y80, A88, A92, F95, L99, L102, L116, W118, M119, C122, L124, F137, Y139, Y144, L145, L147, L151, W154, A160, A161, A174, L181, C185, V186, L189, Y192, L193, L200, V210, A220, L222, C224, A226, F229, Y230, L236, W238, H245, A266, A267, V268, V269, V270, Y278, C280, V282, H284 |
| 312 | HLA class II histocompatibility antigen, DO beta chain | P13765 | F33, V34, F43, V50, F52, V53, F56, L60, V64, F66, F73, W87, L94, A100, C105, V117, V125, L135, L140, L141, H142, C143, V145, F148, W157, V168, L187, V196, Y197, C199, V201, W214 |
| 313 | Electron transfer flavoprotein subunit alpha, mitochondrial | P13804 | L23, V24, I25, I41, A43, A44, V51, C53, L54, V55, C60, V63, A64, L67, C68, V70, V76, A79, L92, L95, I96, I108, C109, A110, L119, V123, A124, A125, I135, F144, V165, F166, V168, V218, V219, L225, F231, L234, L237, A238, A243, A244, A247, A251, V263, V270, Y275, I276, A277, V278, M290, A298, A305, I307, V323 |
| 314 | Glycogen [starch] synthase, muscle (EC 2.4.1.11) | P13807 | V28, L80, Y102, W160, F165, L166, L190, F202, A215, A247, F287, H291, F293, F307, A345, I456, V473, F477, L482, C500, V504, L592 |
| 315 | Endothelin-3 | P14138 | C107, C169 |
| 316 | Macrophage migration inhibitory factor | P14174 | P2, F4, V6, F19, L23, L27, C57, A58, L62, Y76, L79, L80, L83, L84, L88, I90 |
| 317 | Folate receptor beta | P14207 | A34, C51, W54, A58, C59, C60, M86, C90, F94, C99, L100, C103, V126, L128, C129, C133, W136, C140, F176, L182, C183, L186, C203, I204, M206, V219, A220 |
| 318 | Hepatocyte growth factor | P14210 | I39, F42, L50, C70, A71, C74, L80, C84, A86, F87, V88, C96, W98, F99, F101, F112, L118, Y136, C149, W152, L172, C177, C189, F190, C206, Y219, C232, W235, C260, W270, C271, Y272, C283, I285, C288, Y313, W329, C354, W364, C365, F366, C377, I380, C383, V495, M508, V509, L511, C519, L523, V529, L530, A532, C535, Y544, A546, L548, I550, L579, V580, L581, M582, L584, V594, I597, C612, V614, L629, A632, L634, C642, I657, C658, A659, C669, L677, C679, V687, V690, I691, F706, V709, A713, I716 |
| 319 | Perform-1 | P14222 | V61, L249, F442 |
| 320 | D(2) dopamine receptor (Dopamine D2 receptor) | P14416 | V78, F189 |
| 321 | Solute carrier family 2, facilitated glucose transporter member 4 | P14672 | L24, A27, A31, Y40, V44, I45, I52, Y56, W81, V85, A86, F88, I99, M112, A119, M126, A129, L138, I145, Y148, L155, V156, M158, Y159, V160, I163, A187, W202, L205, L206, V210, A213, V218, L220, L230, A240, L244, L247, L260, L278, L288, I290, A291, L294, A305, V306, Y309, I313, F314, V344, H353, L357, M360, C363, A364, M367, A370, A387, I388, F391, V392, I402, I406, V407, A408, F411, A419, A423, V449, F450, L457, I479 |
| 322 | Platelet glycoprotein IX | P14770 | L93 |
| 323 | Interleukin-1 receptor type 1 | P14778 | I39, W57, H75, L81, F83, A86, C96, V97, V98, C104, I107, A111, L140, C142, M145, F148, W160, L181, V183, Y194, C196, A198, I209, I213, F215, V238, L246, C248, V250, W260, L296, I298, I301, F305, F310, C312, F313, A314, L327 |
| 324 | Matrix metalloproteinase-9 | P14780 | A45, L49, L74, L78, C99, I121, I137, A140, F141, A144, F145, W148, L154, A164, I166, I168, L187, A189, H190, A191, F192, A202, F204, W210, V218, P219, F222, A225, C230, F234, G238, C244, W255, C256, C271, A283, C288, F292, C302, W313, C314, A315, C329, C347, F351, F353, W372, C373, A374, F379, W385, C388, L395, F396, V398, A399, A400, F403, H405, A406, L407, L409, A417, L418, M419, Y420, F425, L431, I439, A515, A523, L531, L533, F534, I556, F580, F581, F582, V587, L604, V613, L626, F627, F635, F673, C674, Y679, L702 |
| 325 | Interleukin-2 receptor subunit beta | P14784 | C36, Y38, A42, I44, C46, W48, V61, A63, L88, L98, V101, V104, L106, V108, F124, F127, L130, L132, C148, I150, F167, A169, F206, V208, V210 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 326 | Gamma-aminobutyric acid receptor subunit alpha-1 | P14867 | V416 |
| 327 | Protein C-ets-1 | P14921 | A323, A327, F340, L341, L342, L345, C350, I354, F363, L365, V371, A372, L389, L393, I401, I402, V411, F414, L418, L429, L433 |
| 328 | Junction plakoglobin | P14923 | A140, A162, A163, V166, A174, L179, L185, V186, A188, V189, V190, M193, L209, L212, L219, I222, I228, A230, L231, V232, V242, A246, I247, L250, L253, A260, V264, L270, M273, F284, L285, A286, C291, L292, L295, A296, I306, A308, L315, V316, I318, M319, L327, V334, L335, L338, C341, I348, V349, A351, M354, A356, L357, L361, L368, V369, C372, L373, L376, L379, V382, A383, L389, V392, L393, L396, V397, L400, L408, C410, A411, L415, L418, V429, V435, L438, I439, A441, A445, I451, A455, V456, A458, L459, L462, A472, V476, I485, V486, L488, L489, L497, V498, A500, I502, L504, I505, L508, A509, L510, A513, A516, L518, V523, I524, L527, L530, L531, A534, M556, I559, V560, C563, A566, L567, L570, A571, I580, I586, L588, F589, V590, L592, L593, I600, A604, A605, V607, L608, L611, A612, A618, A620, I621, A623, A626, L630, L633, L634, A642, A645, A646, V648, L649 |
| 329 | Leukemia inhibitory factor | P15018 | L44, I48, L52, L55, A59, L62, Y66, F74, L81, C82, L102, L105, Y106, I108, V109, V110, L112, L116, I119, A130, L133, L137, L144, L147, L148, V151, L152, C153, L155, C156, V164, C185, L187, L188, Y191, I195, L198 |
| 330 | Phosphoglycerate mutase 2 (EC 3.1.3.13) | P15259 | L6, V7, M8, V9, H11, F22, A28, A38, A42, A44, I45, F52, I54, C55, Y56, L60, A63, L67, I70, L71, L87, H91, L95, V112, M126, I136, Y142, L156, I160, A163, W167, I171, I175, A177, V181, L182, I183, A184, A185, H186, L190, I193, V194, L197, I205, L210, I214, I216, V217, Y218, L220, V239 |
| 331 | Interferon gamma receptor 1 | P15260 | V46, W48, F59, V61, V63, C85, I87, L98, V100, V102, A104, A120, I141, I143, I145, Y172, V174, V176, I187, C200, C214, V215, A217, I238 |
| 332 | Arylsulfatase A | P15289 | I23, V24, L25, I26, F27, A28, L31, L36, L49, Y63, V64, A74, A75, L76, L77, L100, V107, A108, L111, Y116, M120, A121, W124, L126, I147, Y149, H151, C156, C161, V177, I179, L181, L182, A189, L194, L197, Y201, A205, L208, M209, A212, F219, F220, L221, Y222, Y223, A224, H226, H227, F238, F247, L251, L254, A257, V258, L261, I265, L275, V276, F278, A280, V310, A314, L315, A331, L337, L340, A341, A344, L358, F375, Y376, V386, F387, A388, V389, Y394, A396, H397, C414, H415, P426, L428, L459, C500 |
| 333 | Beta-1,4-galactosyltransferase 1 | P15291 | V154, V178, A179, I180, I181, I182, F184, L191, W194, L195, L198, H199, V201, L202, L207, Y209, I211, Y212, V213, I214, A225, L227, L228, V230, A235, Y241, F244, V245, F246, L251, I252, Y260, H268, I269, A272, V289, A291, L292, F297, I300, F303, W308, W310, I317, L321, M366, L367, Y376, L386, V392, I394 |
| 334 | V-type proton ATPase subunit B, kidney isoform | P15313 | V47, V52, V53, L54, V57, V66, F68, V80, V83, A88, I89, V90, V92, C106, V117, M121, V125, F126, I147, M163, I164, I168, I171, V173, I177, A178, I183, I185, F186, A188, I196, A197, A198, I200, C201, A204, L206, V207, H217, A222, I223, V224, F225, A226, A227, M228, F238, F242, V251, C252, L253, F254, L255, I266, I267, L271, A272, L273, A276, F278, L279, A280, V287, L288, V289, I290, L291, M294, Y297, A298, A300, L301, V304, A306, A307, M321, L325, I328, Y329, A332, V335, I342, I345, I347, L348, I359, F365, I371, V373, L377, I386, V388, A399, H409, V412, L416, C419, Y420, V426, F448, L449, F452, F456, I457, V467, L471, W475, L478, F481 |
| 335 | Folate receptor alpha | P15328 | C37, L53, C57, W60, A64, C65, C66, W86, M92, C96, F100, C105, L106, C109, V132, L134, C135, C139, W142, C146, C152, W156, F178, F182, L188, C189, I192, Y197, I210, M212, V225, A226, M233 |
| 336 | B-lymphocyte antigen CD19 | P15391 | L36, C38, W52, F83, V87, F94, L96, C97, V113, L188, L196, L198, C200, W214, L225, L228, W240, L246, L248, W281, W283, L284, W290 |
| 337 | Granulocyte-macrophage colony-stimulating factor receptor subunit alpha | P15509 | L47, C60, L62, C81, F94, V96, I128, M134, C136, Y150, L152, C178, F192, V194, C233, W237, F251, Y253, L255, V257, L270, V294, I296, A298, A299 |
| 338 | Membrane cofactor protein | P15529 | C80, A93, M123, F125, L139, C141, A148, V160, V187, I208, C210, V226, V252, I268, C270, C283 |
| 339 | Vascular endothelial growth factor A | P15692 | C52, I61, I72, F73, V78, L80, L92, I106, F122, C213, C225 |
| 340 | Immunoglobulin lambda-like polypeptide 1 | P15814 | W67, C82, V97, L104, V106, L107, V116, A128, A131, L133, C135, L136, M137, F140, Y141, L145, V147, W149, A151, A174, A175, L179, L181, Y192, C194, V196, H198, V203 |
| 341 | Arylsulfatase B | P15848 | L47, V48, F49, L50, L51, A52, L55, V60, L72, V80, Y85, Y86, L98, I105, V122, L128, L132, L133, M142, V143, W146, L148, C155, Y168, L169, Y175, H178, I184, A193, F196, F215, A219, L232, F233, L234, L236, A237, L238, V241, Y255, Y266, A267, M269, V270, M273, V277, V280, L284, V294, F295, I296, F297, L321, V326, V329, F331, V332, I348, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | H349, I350, L354, L357, A361, V376, I380, I389, L391, L392, A431, A432, I433, L440, L441, C447, L474, F475, L498, L502, W529 |
| 342 | Beta-galactoside alpha-2,6-sialyltransferase 1 | P15907 | L109, L144, F160, W165, A178, C184, A185, V187, L193, I202, A207, V208, L209, A214, V223, I229, L231, M232, F243, L254, I255, V256, W269, F277, Y281, Y284, F293, I295, L296, M300, L304, L308, M325, L326, I328, I329, I330, M331, M332, C335, V338, I340, Y341, L344, Y369, L378, V379, L382, I390, L392, A396, L398 |
| 343 | Desmoplakin | P15924 | C191, M195, V214, I228, L235, A247, L251, Y255, L258, I275, F312, A343, I347, I364, C367, I368, H371, F381, A385, Y403, L414, L421, V446, L463, C467, V476, C482, W493, V495, V508, L510, I512, A519, I526, M544, L547, C553, I560, A562, L568, V623, V1975, A1977, L1980, C1983, V2004, I2018, A2019, A2021, L2031, A2034, L2048, A2051, A2053, A2054, I2058, V2069, A2072, I2086, A2089, A2092, A2110, M2122, L2124, L2125, A2127, V2134, V2141, F2142, L2143, A2148, F2172, Y2183, L2186, L2201, V2217, L2222, I2250, I2260, A2261, I2263, A2277, A2288, L2292, A2294, A2296, A2297, I2301, V2312, A2315, L2329, A2332, V2336, Y2339, A2353, L2367, L2368, A2370, I2377, H2384, L2386, A2391, F2415, L2424, Y2426, L2429, L2443, L2444, I2619, A2621, I2622, I2631, L2650, L2651, A2653, C2656, I2660, L2671, A2674, V2679, L2688, A2691, A2694, A2709, A2712, F2726, F2729, L2736, V2737, A2750, L2774, I2783, Y2785, A2788, A2805 |
| 344 | Mucin-1 | P15941 | I1049, F1054, L1058, Y1065, Y1066, L1069, F1086, F1094, V1099, F1107, L1134, V1141 |
| 345 | P-selectin | P16109 | W42, W53, C60, L67, V68, A69, L79, Y90, W91, I92, I94, A114, A118, C131, V132, I134, I136, W145, A156, L157, C158, C168, C194, C226, C244, C288, F290, C306 |
| 346 | Integrin beta-4 | P16144 | L1544, V1546, Y1560, V1562, I1577, V1587, F1598, V1600, A1602, I1618 |
| 347 | Toxin A (EC 3.4.22.—) | P16154 | L9, A13, Y23, I26, L27, L30, L36, Y45, L48, L51, I55, F58, M59, L71, L74, I78, V82, L97, H98, F99, V106, A110, Y113, W117, L128, W129, A134, F135, L136, V137, L140, A143, I144, A152, L156, F170, Y171, M175, I178, Y179, F185, I201, I204, I205, H208, L209, I231, I239, L244, F245, I253, Y254, L258, L259, A266, A267, I270, V271, L273, L274, A275, L276, V282, Y283, L284, M288, L289, I314, L316, A318, I319, F334, F345, I349, I358, F359, L362, V367, L370, I372, I374, A375, A385, L386, I387, L394, V398, V402, Y406, L409, L413, A416, F423, F430, L434, F445, L446, I449, L453, F457, A461, L467, A472, Y473, A476, Y477, F480, L483, L497, F500, A526, L561, V580, Y582, I583, I584, C597, F600, I608, I609, I610, Y636, I638, L642, V648, V650, F652, I653, F665, L673, I677, F680, I684, I688, V693, V695, L697, C700, M702, F703, Y713, L717, L718, I721, I725, L729, V732, I737, I739, A741, L756, I764, A769, I770, I780, A791, I806, L857, V867, L871, L885, I886, F888, V900, F902, I903, F920, Y923, I927, L961, F965, I967, V987, V989, L991, A993, L1000, I1003, L1009, A1016, L1050, V1068, A1078, I1084, V1122, Y1125, F1126, L1129, L1152, V1153, I1154, C1169, I1171, A1173, I1204, M1222, L1224, A1227, F1232, L1253, I1256, F1264, I1276, L1279, I1288, I1290, F1299, I1304, F1317, Y1324, L1326, L1328, I1333, I1337, L1339, W1345, I1346, F1347, V1353, L1383, I1390, L1405, I1413, L1415, I1416, I1417, I1419, L1430, L1441, I1448, L1451, I1458, A1473, I1474, I1482, L1493, F1503, F1516, M1517, I1524, I1538, F1540, I1542, V1550, V1552, L1555, L1557, V1561, Y1565, V1569, M1582, F1585, L1586, F1591, L1594, F1608, L1610, V1611, F1621, F1633, F1646, V1653, V1654, V1655, L1671, Y1675, L1678, V1688, L1689, I1690, Y1695, I1701, I1714, I1728, L1730, W1739, F1746, I1768, L1769, F1782, L1790, I1793, F1864, L1872, F1883, F1905, A1906, F1936, F1956, A1961, A1963, A1964, V1965, F1977, F1998, F2006, F2017, F2039, A2040, F2070, F2090, A2095, A2097, A2098, Y2109, Y2110, F2111, F2132, F2151, F2153, I2158, I2161, F2173, A2174, F2204, F2224, A2229, A2231, A2232, Y2244, F2245, F2263, F2265, F2287, A2288, F2318, F2338, A2343, A2345, A2346, I2352, Y2357, F2359, F2380, F2399, F2401, I2406, I2409, F2421, A2422, L2445, F2452, F2472, A2477, V2478, A2479, V2480, Y2492, F2493, F2512, F2514, F2534, A2535, F2565, F2585, A2590, A2593, I2599, F2604, Y2605, F2606, F2625, A2626, F2656, F2676, A2681, A2683, A2684, A2685, I2691, F2697, F2698 |
| 348 | Beta-galactosidase (EC 3.2.1.23) | P16278 | F41, I51, I55, H56, Y57, W65, L69, M72, A75, A79, I80, V84, W86, H89, V104, F107, L108, A111, H112, L116, V118, I119, L120, Y125, I126, A128, W130, M132, L135, A137, L139, L140, L146, L147, Y154, V158, W161, L162, L165, L166, M169, L172, L173, V180, I181, V183, Y189, Y199, L200, L203, F207, V215, F218, L228, L236, Y237, V240, A251, F269, V289, L293, I296, A301, V303, L305, M307, F308, I309, A320, L337, A340, Y347, L350, I353, I354, A387, A388, L392, F406, F415, V416, Y418, C426, L432, V439, A443, V447, L455, I465, A471, L473, L475, V477, V483, I489, L495, L499, L501, W509, I511, A519, L524, A550, F551, I558, I571, F573, V581, W582, I583, L588, Y591, L601, V603, I616, V618, A624, A635, V636, F638 |
| 349 | Histone H1.5 | P16401 | I47, L65, I83, L87, I90, L96 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 350 | Cytotoxic T-lymphocyte protein 4 | P16410 | V40, A48, A54, F56, C58, Y60, A66, V69, V71, V73, C85, A86, A87, L95, V112, L114, I116, Y127, C129, V131, I149, V151 |
| 351 | Epithelial cell adhesion molecule | P16422 | Y32, C48, C66, V68, A122, I144, H150, L162, L176, F180, L185, I191, L195, V207, I209, A213, Y215 |
| 352 | Histo-blood group ABO system transferase | P16442 | A92, I94, I116, L118, V120, A122, I123, L130, F133, L134, A137, F141, M142, H145, V147, H148, Y149, Y150, V151, F152, M189, M191, I192, F195, C196, F200, V204, Y206, L207, V208, C209, V210, V212, M214, F216, V220, V222, I224, L225, L228, F229, L232, A254, I256, Y264, Y265, L266, G268, F269, F270, V274, V277, L280, C284, M288, V290, A298, H305, L306, L310, V318, L319, Y323, L324, W325, L336, L339, F341 |
| 353 | Thyrotropin receptor | P16473 | C41, L57, L59, L64, I67, F72, I78, I81, V83, L89, L92, F97, V103, I106, I108, L114, A121, L122, L125, L128, L131, I133, L144, V147, F154, L156, I158, M164, I167, L175, L180, L182, L184, F189, V192, A196, F197, V205, L207, L213, A220, L231, V233, L252 |
| 354 | Interleukin-7 receptor subunit alpha | P16871 | L55, C57, I73, Y92, I107, V109, L123, V127, F146, V148, V160, V167, A168, I203, V205 |
| 355 | Fumarylacetoacetase | P16930 | L17, V21, F22, I32, V34, A35, I36, I40, L41, L43, I46, F50, L55, F62, L67, F70, M71, A77, A81, L85, L89, L96, L102, A106, L196, M198, L200, M202, A203, F204, F205, V206, A221, M228, V229, L230, M231, W234, A236, V259, V263, V264, A268, L269, L287, F295, I297, V301, L303, C315, W324, M326, L327, L330, L345, L346, A347, I351, M362, L375, V390, I392, C396, I403, F405, C408, V412 |
| 356 | Alpha-N-acetylgalactosaminidase (EC 3.2.1.49) | P17050 | W30, A32, C49, I50, L54, F55, M58, A59, M62, W67, Y72, L75, I77, C80, W81, L91, I102, L105, A106, V109, L116, I118, Y119, A120, M122, V138, A142, F145, V150, L153, L155, Y169, M172, A184, F185, C187, L205, C209, L211, W212, I218, V225, I228, L229, L239, V242, W248, M253, L254, L255, I256, A268, M270, A271, L272, W273, V275, L276, A277, A278, L280, M282, I296, L297, M302, I305, I324, V326, Y327, A337, L338, V339, F340, F341, L355, I365, A368, F386, I390, M397, L400 |
| 357 | Aspartate aminotransferase, cytoplasmic | P17174 | V34, L36, L51, V53, V54, V57, F80, A84, A88, A95, V104, A112, L113, I115, A117, L120, A121, V134, V136, H144, F148, F174, L178, A181, I186, V187, V188, L189, A193, H194, I209, A210, M213, F221, F222, A238, A240, I241, F244, F251, C253, A254, F257, F261, V268, L271, M288, V292, A304, I306, V307, A308, W320, V324, M327, A328, L338, L342, I354, M360, F361, L374, I380, L382, I388, V390, L393, L398, V401, A402, A408 |
| 358 | HLA class I histocompatibility antigen, alpha chain G | P17693 | M29, Y31, A34, A35, F46, A48, V52, F57, V58, F60, M69, A73, W75, V76, Y83, A95, L102, L105, L119, W121, M122, C125, L127, Y140, Y142, Y147, L148, L150, L154, W157, A163, A164, V176, A177, L184, C188, V189, L192, Y195, L196, L203, V213, A223, L225, C227, A229, F232, Y233, L239, W241, A269, A270, V271, V272, V273, Y281, C283, V285, H287 |
| 359 | Neuronal acetylcholine receptor subunit beta-2 | P17787 | V56, L60, L83, W87, L119, A135, V137, I143, W145, A149, F173, I183, L185 |
| 360 | ATP-dependent 6-phosphofructokinase, liver type | P17858 | I18, V20, L21, A27, M30, A32, A33, V34, A36, V37, A46, V48, I51, L58, V59, V73, I77, A101, A102, L105, L113, C114, V115, I116, L122, F128, L135, A159, L161, V162, I165, F169, I176, A181, I185, M186, I189, A196, F203, V204, L205, V207, C212, L215, A216, L217, F229, I230, M243, C244, L247, I260, I261, I262, A263, A266, V279, V283, V284, V293, L296, A307, L312, A320, V321, L324, L325, A333, V335, V336, L348, V358, A370, A389, A403, I404, L405, V407, A411, A412, M414, A416, A417, V418, V422, V432, Y433, V434, V435, F439, V455, I480, L493, V494, V495, A500, Y501, L505, A510, C518, M521, C522, V523, I524, A526, V532, L539, A544, M549, C552, A559, V566, F567, I568, V569, C576, L579, A580, I585, A586, V594, L604, V608, M611, M615, L623, V624, L625, L639, Y643, L678, A682, M683, L686, L690, A701, V709, I710, V722, L725, W741, L744 |
| 361 | Ganglioside GM2 activator | P17900 | L80, C106, C136, C183 |
| 362 | Complement receptor type 1 | P17927 | C43, A52, L69, I84, C86, C99, I121, I127, Y129, A143, C145, V152, I164, C166, V191, Y193, I213, C215, C238, F256, V262, V278, C280, C493, I534, I571, I577, C595, V641, C665, C688, F706, V712, V728, C730, C943, I984, C986, C1004, I1021, I1027, A1043, C1045, A1052, I1064, C1066, V1091, Y1093, C1095, I1113, C1115, C1138, F1156, V1162, V1178, C1180, C1396, I1437, V1480, C1498, V1544, C1568, C1591, F1609, I1615, V1631, C1633 |
| 363 | Vascular endothelial growth factor receptor 1 | P17948 | F135, M148, L154, I156, C158, V160, V167, L169, F192, I194, A197, L205, C207, A209, Y220 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 364 | TFIIH basal transcription factor complex helicase XPD subunit (EC 3.6.4.12) | P18074 | L40, M42, L53, A54, M57, A58, L70, Y72, C73, I80, V83, I84, L87, L102, L107, A108, L109, L115, A139, L170, L177, C190, Y192, L194, A195, A202, Y209, V231, V232, A236, I239, C243, L251, L256, C259, L263, A298, V309, C375, L382, A404, L406, C437, A443, I444, I455, I456, L461, L471, F473, M493, I494, Y520, A537, F539, I561, Y584, A594, L596, L597, V599, A617, I619, M620, F621, V623, A635, A656, A660, V664, A667, M677, V678, F684, W696, A704 |
| 365 | Toxin B (EC 3.4.22.—) | P18177 | L9, A13, Y24, I27, L28, L31, M37, Y46, L49, I52, Y59, L72, F75, L79, V83, L98, H99, F100, I107, Y114, W118, V129, F130, A135, F136, L137, I138, L141, V145, A149, F171, F172, M176, I179, F186, I202, I205, V206, L210, I232, V240, F246, L254, Y255, L259, V260, W263, A267, A268, I271, L272, I274, A276, L277, M283, Y284, L285, M289, L290, L317, A319, I320, F335, F346, L350, I359, F360, L363, A368, L371, V373, I375, A376, L387, I388, C395, I399, I403, Y407, L410, L414, A417, F431, I435, M447, L450, L454, F458, V462, L468, A473, Y474, A476, A477, Y478, L481, F484, L498, F501, A527, L562, I578, Y580, I581, V582, A594, C595, F598, A599, V606, L607, F608, A618, Y634, I640, I646, L648, F650, F663, L671, I675, A678, A682, I686, I691, I693, L695, M700, F701, Y711, L715, L716, V719, I723, M727, I730, I735, V737, A739, L754, I762, I778, V789, F1866, F1888, F1908, A1909, F1938, H1956, F1958, F1979, F1999, F2019, F2039, A2040, F2069, F2090, A2095, F2305, A2306, F2335, F2355, A2360 |
| 366 | Vinculin | P18206 | F4, H5, I9, L13, A17, I20, L70, M74, A77, V81, C85, A91, A92, L95, A104, I109, L116, L124, A129, V131, I134, C138, L145, A148, Y160, L164, M171, I175, L182, L191, V192, V198, L201, L205, A208, M209, V213, I223, A226, M237, I241, I244, V247, L248, A269, I273, A280, W283, A298, I299, I302, A306, I321, V335, A353, L360, L363, V367, I384, I388, A391, I408, A411, A415, A419, I431, I438, L445, V466, L470, L473, A480, A500, A518, C545, V548, L551, L576, L580, L609, A613, F626, F633, A644, A679, L683, F695, L734, A760, I763, V766, V783, A786, L790, V828, V831, A909, M956, I966, A970, L973, A977, I987, I988, A990, A991, M994, A995, M998, M1001, L1015, C1018, A1019, I1022, A1023, A1025, V1029, A1033, A1037, C1040, L1049, V1052, C1053, I1056, L1063, A1071, A1087, L1091, A1095, L1098, M1099, V1102, V1106, A1109, A1112 |
| 367 | Interleukin-1 receptor antagonist protein | P18510 | F38, I40, V56, A57, V73, A80, L81, F82, L83, C91, L92, C94, L103, F123, F125, F136, C147, A149, V156, L158, F171 |
| 368 | Cytidine deaminase/strain 168 | P19079 | L6, A10, A13, A28, A29, L30, L31, A54, A58, L59, A62, L73, A74, V75, A76, A77, C89, I93, V101, V103, V104, V117 |
| 369 | Erythropoietin receptor | P19235 | A39, L41, L42, L50, C52, F53, L60, C62, F63, W64, F79, Y81, L83, F105, C107, L120, L122, V124, I139, V142, V143, L144, L145, V152, V162, L164, W166, I178, Y180, V182, V184, L207, F218, A219, V220, A222, M224 |
| 370 | Lymphocyte function-associated antigen 3 | P19256 | F43, V54, W56, V63, A64, L90, I92, L95, Y103, F116, L118, L121, L129, C131, V140, M156, M163, C166 |
| 371 | Vascular cell adhesion protein 1 | P19320 | A37, V43, L45, C47, L80, M82, V85, Y93, C95, A97, I108, F115, I133, V135, C137, V139, V142, F145, I150, L152, L178, L193, C195, A197, L199, A325, V331, L333, C335, L368, L370, V373, Y381, C383, V385, I396, F403, V421, V423, C425, V427, V430, L433, I438, L440, L466, L481, C483, A485, L487 |
| 372 | Tumor necrosis factor receptor superfamily member 1A | P19438 | C59, C62, C72 |
| 373 | Hemagglutinin [Cleaved into: Hemagglutinin HA1 chain; Hemagglutinin HA2 chain]/strain A/Budgerigar/Hokkaido/1/1977 H4N6 | P19694 | I25, C26, M27, V38, V48, L54, V55, L63, C64, L70, C76, I78, I79, A82, L83, C88, L91, V98, F99, I100, V106, C109, Y110, F112, Y117, L120, L124, A125, F130, F137, A150, C151, F159, F160, L163, L166, Y191, W193, V195, H196, H197, Y208, V215, V217, I243, F245, Y246, I249, V250, L255, I256, F258, L264, I265, A266, Y271, I288, C295, H296, V302, V323, L330, A331, A348, W357, Y365, A387, A439, L461, L469, C480, F481, I483, H485, C487, C491, I492, I495, A509 |
| 374 | Nuclear factor NF-kappa-B p105 subunit | P19838 | F57, L69, V84, A93, V95, I96, V97, L99, V100, H109, A110, H111, L113, I122, C123, A127, V133, V134, L139, L153, M157, A160, C161, L170, L175, I196, A199, A200, V212, L214, F216, A218, A238, I239, A247, L250, V262, I268, L270, L271, I282, F284, I311, V312, F313, V329, V331, L333, F347, Y349, Y350, M808, L819, Y820, L823, L835, A836, F848, L858, M859, L872, A875, L876, A884, I888 |
| 375 | C-X-C motif chemokine 3 | P19876 | C45, I52, C69, V74, A76, L78, C85, L86, V93, I96, L101 |
| 376 | Complement receptor type 2 | P20023 | I47, I58, L63, C65, V96, Y108, V114, V130, C132 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 377 | HLA class II histocompatibility antigen, DP alpha 1 chain | P20036 | M54, F55, F63, V65, F83, A87, A92, I94, L136, I137, C138, I140, F143, W152, F179, L182, V185, Y192, C194, V196, H198 |
| 378 | Myeloid cell surface antigen CD33 | P20138 | V82 |
| 379 | Kallikrein-2 (EC 3.4.21.35) | P20151 | I25, C31, V40, A41, V53, L54, V55, V60, L61, A63, A64, C66, V73, L75, V90, V92, L121, L123, L124, L126, I132, V135, V136, C152, A154, F165, C173, V174, L176, C184, C198, A199, L217, C219, L223, I226, A241, V242, Y243, V246, I253 |
| 380 | B-cell receptor CD22 | P20273 | W24, W35, C39, V40, I42, C44, L53, L76, F94, L95, C102, L117, L119, W128, M129, L134, V136, I145, C161, C167, Y170, I172, W176, V198, L204, F206, W210, C219, L229, L236, V238, V255, C265, W279, L294, L296, Y307, C309, L325, V327, Y329, V349, C353, A357, W366, Y394, C396, L413, V415, V422, I426, I432, V438, L440, C442, V451, W456, L470, I472, V475, W477, C484, A486, C491, L499, V501, Y503, A504, V508, V510, L527, C529, V539, W543, L556, I561, Y569, C571, I577, V589, Y591, L596, V598, V606, L614, C616, A620, Y627, W629, F630, L644, L646, Y657, C659, V677, Y678, Y679, I684 |
| 381 | Integrin alpha-L | P20701 | F45, I57, V58, L70, C73, L109, A110, C111, C119, C129, Y130, V155, L157, V158, F159, L160, F161, L167, I175, F178, M179, V182, M183, L186, Y191, F193, A194, A195, V196, F198, F206, F208, Y211, A236, I237, V240, V244, V258, L259, I260, I261, I262, I273, A276, I279, Y282, I283, I284, I286, F290, L299, F302, A303, F310, F317, L320, L323, F324, L327, V364, V365, A367, A370, A374, F377, L378, L404, L411, L420, A421, V433, L434, L435, V467, L477, L478, L479, I480, A482, V494, L510, F521, L528, I531, V539, A540, V541, A543, A550, Y552, I553, F554, L561, I569, I578, F581, A597, A600, A603, M607, I608 |
| 382 | Integrin alpha-X | P20702 | F30, F37, V49, V50, V51, A53, L66, C69, A87, M90, L92, L105, L106, A107, C108, C126, F127, I152, V153, F154, L155, I156, M170, F173, V174, V177, F188, L190, M191, F193, F201, F203, F206, L216, A229, A231, I232, V235, L239, I253, L254, I255, V256, I257, V272, I273, A276, I282, A285, I286, V288, A291, F292, L301, I304, A305, F314, V316, F319, L322, L329, I333, F334, A352, V366, L367, A369, A379, I391, M400, L405, A412, L420, V421, L422, A424, A433, V434, I435, F436, V465, V467, L475, V476, L477, I478, A480, V492, V494, C495, L510, F521, L528, V531, V539, V540, I541, A543, A552, V553, Y554, L555, F556, I572, A573, L581, F584, L602, A603, V604, A606, V610, L613, V618, L619, I632, V650, I658, L671, V675, L681, A690, F692, L700, F715, L717, L719, I730, L732, L734, L749, L765, L793, V795, L801, A803, V805, V807, I819, F821, H823, C863, A880, F882, A888, L894, L896, A898, V924, A951, H953, Y955, V957, L965, V967, I969, F971, V973, L977, V982, W983, I1014, L1020, A1025, C1027, C1032, F1037, V1039, L1043, F1045, L1047, L1051, W1055, I1059, V1064, V1066, A1070, I1072, L1097 |
| 383 | B-cell lymphoma 3 protein | P20749 | L139, V143, V151, F158, L176, H177, A179, V180, V188, L191, A208, H210, A212, C213, C220, L221, A223, L224, A245, L246, H247, A249, V250, V258, L260, L261, L280, I281, A283, V284, M291, V292, L294, L295, A312, L313, A316, V325, L328, V354 |
| 384 | Calpain-3 (EC 3.4.22.54) | P20807 | L138, L145, L189, F200, A210, L212, Y216, A218, F239, A335, V363, F404, F658, A662, I668, L673, L677, V681, C697, M700, M704, L712, F717, L720, I724, F731, I742, M747, A750, V751, A754, Y763, I777, F779, F782, I783, C785, F786, L815 |
| 385 | Collagen alpha-1 | P20849 | L59, V65, A86, F113, L114, F117, M119, W128, I130, W131, I133, I144, I146, V153, F155, F169, I183, M184, I185, V187, A192, L194, A218, V219, V231, L235, M238, I240 |
| 386 | Nebulin | P20929 | A6617, F6631, I6637 |
| 387 | N(4)-(beta-N-acetylglucosaminyl)-L-asparaginase (EC 3.5.1.26) | P20933 | I91, L105, I108, A111, I112, V114, A115, V118, A132, A136, A243, A253, A254, A256, L263, A272, V273, A285, C286, I290, I293, F300, A303, V304, C306, C317 |
| 388 | Filamin-A | P21333 | F49, C53, L57, I64, L67, L71, L77, I78, L80, L81, V107, V109, A110, L111, F113, L114, I129, I137, L138, L140, I141, L144, I145, I150, L172, I176, L180, I185, F188, W192, A197, L198, A200, L201, V202, A206, C210, A225, A228, M229, A232, L236, I238, V241, I242, I247, V257, M258, Y260, L261, F264, A284, A302, V306, A311, V318, V344, H354, V356, V358, F360, I365, V372, V495, A501, V505, A510, V519, F540, Y542, Y550, V552, I554, I561, V568, A595, F597, V598, V599, V633, Y635, Y643, A644, V647, I654, A661, V675, V697, H743, A745, V747, V761, V1070, F1088, I1090, A1095, V1124, Y1126, Y1134, I1136, I1138, I1145, A1152, V1154, V1163, C1165, F1181, V1183, A1188, I1197, I1219, Y1221, Y1229, V1231, I1233, Y1235, L1247, V1258, V1270, F1278, V1280, V1297, Y1317, V1319, Y1321, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | H1329, V1331, V1333, V1347, V1358, F1376, V1378, A1383, V1412, Y1414, Y1422, L1424, V1426, V1433, V1440, V1451, V1463, V1473, A1478, V1487, V1509, I1521, V1523, Y1525, V1530, V1537, V1539, V1548, V1560, A1562, F1568, I1570, A1572, A1575, I1584, V1606, Y1608, Y1616, I1618, I1620, Y1622, I1627, V1634, A1636, A1642, C1645, I1672, V1674, A1679, V1684, V1688, I1710, A1714, Y1720, I1722, V1724, V1731, V1738, A1740, F1791, I1795, I1799, V1808, V1828, V1830, H1840, M1842, I1844, I1851, L1856, F1858, V1860, V1868, A1870, L1875, F1886, V1888, I1902, V1922, Y1924, Y1932, I1934, V1936, V1943, F1948, A1950, V1952, V1987, I2009, F2011, H2019, V2021, V2023, I2039, A2047, V2050, L2057, F2068, I2070, A2075, L2080, L2082, I2084, V2104, Y2106, Y2114, I2116, I2118, F2120, V2125, V2132, V2134, A2176, V2178, Y2198, I2200, H2210, V2212, V2214, V2230, A2238, V2241, A2257, F2259, I2261, A2268, I2273, V2275, V2295, Y2297, V2299, Y2305, V2307, V2309, F2311, I2316, V2323, V2325, A2326, A2332, L2335, L2345, V2355, L2357, A2360, I2364, V2368, V2390, Y2400, I2402, V2404, F2406, I2418, V2432, L2439, F2450, V2452, A2457, V2485, Y2487, A2491, Y2495, I2497, I2499, Y2501, I2507, A2514, A2557, V2560, A2570, V2580, C2582, V2616, Y2618, L2620, L2628, V2630, W2632, I2637, V2644 |
| 389 | Neurofibromin | P21359 | I1592, I1605, F1606, Y1607, V1609, F1613, L1623, V1642, A1670, Y1680, L1715, I1719, A1743, I1755, A1761, V1762, V1772, A1785, I1788, F1799, L1801, I1803, F1812, C1817, I1820, I1824 |
| 390 | Phosphatidylcholine translocator ABCB4 | P21439 | A64, M81, L109, M113, Y120, V127, A131, F137, A141, A142, I146, I149, F153, F154, A156, I157, L158, I162, L173, L177, I181, I184, I188, A200, V208, L216, I220, A235, A252, A256, A259, A262, V266, A268, F269, Y279, L283, A286, A294, I303, A304, A310, A313, A315, F316, M334, V336, F337, I340, A350, A360, A364, I367, I371, I377, L394, V399, L412, L415, V419, V425, A426, L427, V428, C433, L441, I442, I453, I460, F463, V465, L468, I472, V475, L481, F482, I486, I490, I502, V506, A509, A511, I515, V526, I541, A542, I543, A544, A546, I553, L555, L556, A559, V571, A574, L575, A578, I585, I587, V594, I600, A601, F603, L617, Y624, V700, C717, A718, I735, I736, I753, I757, F758, L761, A779, L783, L787, A791, F792, M795, L796, L817, A821, V824, A827, A833, A840, L856, A896, A899, I900, I903, V906, F915, A934, C955, A960, L975, V976, F982, A1000, A1004, H1006, L1007, I1034, F1036, V1039, F1041, L1052, L1055, V1059, L1065, A1066, L1067, V1068, V1078, V1079, L1081, L1082, V1093, A1107, L1110, V1112, L1115, L1119, V1122, F1129, A1134, I1137, I1151, A1154, A1155, A1158, I1160, Y1171, V1175, A1191, I1192, A1193, L1196, L1204, L1205, V1220, A1223, C1233, I1234, I1236, I1243, I1249, V1250, V1251, L1266, Y1273 |
| 391 | Tumor necrosis factor alpha-induced protein 3 | P21580 | L10, A18, I21, I37, H38, H39, F40, M43, H44, L48, F51, I64, A67, L68, L77, L83, A94, L104, M105, H106, A107, Y111, M112, W113, V115, L122, A125, L126, F138, A175, H195, I196, F197, V198, L199, C200, I202, L203, I207, I208, V209, V229, I232, Y233, L234, I248, V249, L250, V258, L260, V261, A272, V273, V288, H289, F290, L291, L302, L307, V314, I325, A327, A328, L330, I339, L341, Y345, V349, C404, C624, C779 |
| 392 | Kit ligand (Mast cell growth factor) | P21583 | V40, L43, L55, I70, M73, V74, L77, L81, I100, I101, L104, I107, V108, F140, F141, F144 |
| 393 | Ephrin type-A receptor 1 | P21709 | L81, A92, V95, H96, V97, L99, F101, V103, F122, L124, V148, L181, L183, A184, F185, A190, V192, L194, V197, V199 |
| 394 | Fibroblast growth factor 7 | P21781 | L69, C71, L77, I79, V85, M98, I100, V108, I110, L119, A120, M121, C137, F139, Y151, V165, A166, L167, A186, F188 |
| 395 | Fibroblast growth factor receptor 2 | P21802 | M162, V169, V175, F177, C179, A181, F198, L216, M218, V221, Y229, C231, V233, Y244, L246, F276, C278, W290, I324, C342, A344, A355, L357 |
| 396 | Ryanodine receptor 1 | P21817 | L13, V19, V20, L21, C23, A25, L34, C35, L36, A37, A38, I63, C64, F66, L68, L77, L100, Y102, A105, I106, L108, H110, L117, A131, V134, L136, C145, W147, M149, V162, I168, L170, L179, V190, A192, W199, M201, V213, L219, L221, H223, C229, L230, I232, V244, Y246, V251, A255, L258, W259, L261, L273, L279, V281, H283, V284, Y289, L290, A291, V299, V300, A306, F313, F315, I338, C345, V347, L356, A375, L387, L389, A399, A400, M402, I403, Y410, F413, L435, V440, L444, L447, I448, F451, L470, L476, F477, M482, V486, C489, I490, L493, F502, A506, I517, V518, L521, L524, L528, W685, A686, V706, C745, I754, V779, V780, A874, F909, V984, A988, H992, L1038, V1042, A1093, V1101, W1103, A1104, L1114, A1120, V1122, F1123, V1148, C1150, I1152, I1159, F1161, I1181, V1190, A1449, W1451, V1452, L1465, V1471, V1473, M1475, I1515, M1526, F1528, A1550, F2754, A2759, Y2761, H2763, A2767, L2813, A2815, M2816, L2862, M2874, L2878, A2879, A2923, L2926, L2927, L2930 |
| 397 | Receptor tyrosine-protein kinase erbB-3 (EC 2.7.10.1) | P21860 | L52, Y53, C56, V58, V59, L63, I65, L77, I80, V83, V87, L88, V89, A90, F94, L97, L99, L102, V104, V105, A116, I117, F118, V119, L121, A130, L131, L134, L136, L139, I142, V147, I149, L155, M158, I161, I166, V167, C190, C194, W195, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | C231, A232, A245, C255, C259, V295, V296, C331, V343, I348, F351, C354, I357, L361, F363, I376, L384, F387, V390, I393, L397, I399, F409, V411, F412, L415, I418, F428, L430, I432, V438, L441, F443, L446, I449, I454, I456, L462, C463, H465, V473, L474, C493, C504, C509, W510, C529, C533, C552 |
| 398 | Succinate dehydrogenase [ubiquinone] iron-sulfur subunit, mitochondrial (EC 1.3.5.1) | P21912 | F42, I44, V63, V72, A75, L76, I79, L87, C101, M103, L111, A112, I127, F146, L183, A190, C191, Y199, Y206, A210, V211, L212, A215, L234, L240, A262, I263, I266 |
| 399 | Tenascin-X | P22105 | C435, C466, L3669, L3671, A3679, F3683, L3685, A3716, L3718, L3729, L3731, A3859, L3861, Y3873, V3875, V3877, L3898, A3909, V3911, A3947, L3949, Y3961, L3963, L3977, L3986, Y3995, A3997, L3999, A4001 |
| 400 | Cadherin-3 | P22223 | V116, L131, I141, V157, F158, L167, L169, L173, L183, A187, I201, I203, V224, V237, A254, M269, I279, V281, Y294, L296, I298, A300, A312, A314, V316, I318, L349, L390, L396, L406, V408, V410, A425, I427, V429, Y462, V495, L501, Y514, V516, V518, A520, L534, L536, I553, L565, V602, L604, V617, L619, L621, I633, A635 |
| 401 | Interleukin-10 | P22301 | L41, L44, A47, V51, F55, L66, L70, A82, L83, M86, Y90, V94, A98, V109, L112, L116, C126, L130, V139, A157, M158, F161, F164, I165, I168 |
| 402 | C-C motif chemokine 1 | P22362 | I47, L62, F64, A74, V81 |
| 403 | Ectonucleotide pyrophosphatase/phosphodi-esterase family member 1 | P22413 | C164, C166, C170, A392, I507, I632, F638, L826 |
| 404 | Potassium voltage-gated channel subfamily A member 5 | P22460 | I124, I126, L138, L146, F165, F172, I175, Y179, V191, F196, I200, Y203, I260, V445, A451, V452, A455, A470, A474, C500 |
| 405 | Protein-glutamine gamma-glutamyltransferase K (EC 2.3.2.13) | P22735 | V709, I711, L721, V724, F726, L728, I744 |
| 406 | Carbonic anhydrase 4 (EC 4.2.1.1) | P22748 | Y25, I54, I56, Y75, W81, V83, V90, M92, L94, I100, Y109, A111, L114, L116, W118, H128, M137, M139, H140, I141, H143, A164, L166, A167, F168, L169, V170, F180, L187, I190, Y217, C229, V233, V237, F238, I242, L244, F252, L256, M266 |
| 407 | Peptidyl-prolyl cis-trans isomerase B | P23284 | V42, V44, V46, Y47, F48, L50, I52, V60, I61, F62, L64, F65, V69, V73, F76, A78, L79, A80, F86, Y88, F93, V96, I97, M101, I102, I118, F123, L130, H132, W137, V138, M140, F152, F153, I154, V167, V168, F169, V172, V178, V179, V182, L194, V197, I198, I199, I205 |
| 408 | Glycine receptor subunit alpha-1 | P23415 | V65, V67, C69, I71, I73, Y86, V88, I90, L92, W96, L101, L111, L146, I148, V154, I160, L162, L164, C166, L170, F173, C180, M182, L184, L194, F196, C237, I238, A240, F242, L244 |
| 409 | Receptor-type tyrosine-protein phosphatase delta | P23468 | A41, F43, C45, W57, F69, V81, L82, I84, L87, Y96, C98, A100, L113, V115, A143, M145, C147, A148, A149, W159, L192, I194, Y205, C207, A209, A221, L223, I255, C257, A259, V267, W269, V294, C302, A304, A315, I317, I339, L341, I356, V373, V380, F391, V393, V394, A395, I434, V436, V453, V463, I479, V490, V492, A494, I532, L534, Y547, L549, I564, L575, F583, L585, A586, A587, I626, V628, I647, A651, L674, I685, V687, A689, L937, L956, L981, V992, V994, A996 |
| 410 | Tumor necrosis factor ligand superfamily member 4 | P23510 | V64, F66, M86, V93, I95, C97, Y101, I103, L105, V113, I115, L117, V135, V149, L151, L170, L172 |
| 411 | Brain-derived neurotrophic factor | P23560 | C141, A150, V164, V166, V170, C196, A217, I226, I231, I233 |
| 412 | Follicle-stimulating hormone receptor | P23945 | F30, C32, V37, A48, L51, F53, L58, I61, F66, F69, L72, I75, I77, L83, I86, V90, F91, L94, L97, I100, I102, A105, L108, L109, A115, F116, L119, L122, L125, I127, I132, L135, V138, I141, V147, L149, I151, I157, I160, F165, L168, V173, L175, L177, I182, A189, F190, L195, L198, L200, L206, V213, L223, I225, I230, L238, L241, L244, A246, L261, A267 |
| 413 | Sodium-dependent noradrenaline transporter | P23975 | L95, L109, A145, I156, L238, F272, L284, I291, A305, I309, L319, V325, Y367, V379, L386, V387, F388, I389, L390, Y391, A394, A405, I428, F459, I466, L469, L472, A477, L486, I490, F495, F540, I549, A554, W556, V569 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 414 | Protein kinase C eta type (EC 2.7.11.13) | P24723 | V360, M370, L371, A372, V383, V390, I406, L407, A410, F415, L416, L429, F430, F431, V432, L441, A456, Y459, A460, A461, I463, I464, A466, L467, L470, I475, Y477, V485, L487, C493, L495, F498, W537, M540, L543, L544, M547, A581, I584, L585, F588, I608, F613, F614, V641, F644, F671, F674 |
| 415 | Deoxyribonuclease-1 (EC 3.1.21.1) | P24855 | I25, A26, A27, F28, I30, F33, M38, V44, I47, V48, I50, L51, Y54, I56, A57, L58, V59, V62, A69, V70, L73, L77, Y102, L103, F104, V105, V111, F131, I137, V138, F140, V147, F150, A151, I152, V153, L155, A157, A162, I166, L169, V172, V176, V185, M186, L187, M188, F191, A193, I206, L208, I218, C231, A232, I236, V237, V238, A239, L243, A246, F257, A268, I271, V277, V279, L281 |
| 416 | C-X-C chemokine receptor type 1 | P25024 | L37, C110, C187, V190 |
| 417 | C-X-C chemokine receptor type 2 | P25025 | L155 |
| 418 | Adenomatous polyposis coli protein | P25054 | L137, L204, I224, C344, L356, A383, A386, L387, I391, V406, L407, L410, I413, Y416, C417, C420, I446, V450, L453, A465, M466, L469, L472, A474, I475, A476, L478, L479, V481, L497, A501, A504, L505, L508, L519, C520, C525, M526, L529, L540, I544, A545, V547, L548, L551, L563, V569, L572, M573, C575, A576, V588, L589, A591, L592, L595, I606, A612, L613, L616, I631, I638, L639, V642, I646, L656, C661, L665, I676, A680, C681, L684, L687, A703, L707, I718, A725, L729 |
| 419 | Myelin protein P0 | P25189 | L48, C50, F64, W66, F80, F95, I112, I114, F125, C127, L144 |
| 420 | Tumor necrosis factor receptor superfamily member 6 | P25445 | C63, C73, C85, C119 |
| 421 | Integrin beta-7 | P26010 | C54, I55, C61, W63, C64, L86, L123, A124, V128, V130, L132, V142, F144, V152, L154, Y155, Y156, L157, M158, L160, M164, I191, F193, F196, V197, F204, V205, C216, F229, F242, V246, V251, A264, I265, L266, A268, A269, C271, I275, L283, L284, V285, F286, Y327, L337, A340, I345, A347, V348, Y356, A367, V378, A385, L395, Y408, C428, V431, V437, F439, V441, L443, A445, L455, L457, A459, L466, V468, L470 |
| 422 | Hemagglutinin [Cleaved into: Hemagglutinin HA1 chain; Hemagglutinin HA2 chain]/strain A/Mallard/Astrakhan/263/1982 H14N5 (Influenza A virus (strain A/Mallard/Gurjev/263/1982 H14N5)) | P26136 | I29, C30, L31, A35, V42, V52, L58, V59, L67, C68, L74, C80, L82, I83, A86, L87, C92, L95, V102, F103, I104, V110, C113, Y114, F116, Y121, L124, L128, A129, L134, F141, A154, C155, F163, F164, L167, L170, I181, Y195, W197, V199, H200, H201, Y212, V219, V221, I247, I249, Y250, L253, V254, I260, F262, L268, I269, A270, Y275, I292, C299, L300, I306, V327, L334, A335, A352, W361, Y369, A391, A443, L465, L473, C484, F485, I487, H489, C491, C495, I496, I499, A513 |
| 423 | Hepatocyte growth factor-like protein | P26927 | C157, C169, Y199, W215, C240, W250, C251, Y252, C263, L265, C391, W394, H400, L414, C419, C431, C443, V484, W494, V496, L498, L511, I517, L518, A520, V536, L538, V555, L569, V570, L571, L572, V584, C602, I604, A605, L624, C632, M645, C646, L665, A666, C667, L675, I678, I679, V697, I704 |
| 424 | Serum paraoxonase/arylesterase 1 | P27169 | L28, I48, A63, F64, I65, I85, M88, L129, L130, V131, V132, V141, L143, F144, L153, I159, L167, I170, F178, Y179, G180, V205, F220, A223, I226, V235, I237, A238, I245, V247, L267, V268, L280, V282, C284, H285, V304, I307, A322, L328, V333, A334, L341, L342, I343, A350, L351, C353 |
| 425 | Dipeptidyl peptidase 4 (EC 3.4.14.5) | P27487 | Y43, Y68, L69, A81, L90, I114, L116, A130, Y132, I134, L142, L164, A165, V167, I172, V174, I198, W201, V202, Y203, V207, A213, L223, A224, Y225, A226, F228, I236, Y238, Y241, A259, A261, F268, V270, V271, I287, M293, Y299, L300, C301, V303, I311, L313, W315, V324, M325, I327, C328, C339, L340, I346, W353, V354, F371, H383, I384, C385, I389, V404, L415, Y416, Y417, I418, L431, I434, V442, L445, C447, C454, Y468, L470, C472, L482, L500, V507, L514, L519, M528, L530, L542, L543, L544, V546, A548, C551, A555, L567, A568, I573, I574, V575, A576, F578, M591, A593, I594, L598, V603, I607, A609, A610, F613, V619, I624, A625, I626, Y631, Y634, V635, M638, V639, L640, C649, I651, A652, V653, A654, V656, W659, Y661, Y662, V665, Y666, Y670, M671, Y683, V688, A692, F695, Y700, L701, L702, I703, H704, V711, I719, L723, V724, V726, F730, Y735, H740, I742, I751, M755, F758, I759, C762, F763 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 426 | Genome polyprotein [Cleaved into: Capsid protein C/strain Brazil/97-11/1997 (DENV-1) | P27909 | L29, M48, M126, V128, C148, C167, C180, C182, V189, Y191, A251, A255, M281, C283, V301, V303, V304, L305, C310, V311, M314, A315, L321, I323, L325, V330, L339, C340, I341, A360, C385, L394, C396, A397, F399, L405, V410, L415, Y417, V419, V421, I444, I453, L455, L461, L463, C465, L471, V477, L478, L479, M481, V488, F493, L517, V518, L544, H562, L563, C565, L567, M569, L572, C582, F586, V592, V600, V602, V604, Y606, C613, I615, I632, V638, I647, I658, V660, W671, I963, I993, L1396, L1398, I1497, Y1498, I1500, V1513, V1515, F1516, V1520, F1521, H1522, M1524, L1533, M1534, V1547, L1551, I1552, Y1554, W1558, F1560, V1570, V1572, I1573, A1574, V1575, V1584, F1591, A1600, I1601, I1614, V1615, V1622, L1624, Y1625, V1630, Y1636, V1637, A1643, L1680, I1683, V1684, A1687, L1695, I1696, L1697, A1698, V1703, A1704, M1707, A1708, L1711, V1733, L1735, M1736, H1738, F1741, Y1754, M1756, I1757, I1758, M1759, A1762, I1770, A1771, A1772, I1776, A1785, A1786, A1787, I1788, F1789, M1790, I1827, V1835, W1836, F1837, V1838, I1847, A1848, C1850, L1851, I1859, L1861, F1866, W1878, Y1880, V1881, V1882, A1891, V1898, I1899, V1917, V1925, A1928, A1930, A1931, I1937, Y1948, V1949, L1955, A1962, A1967, L1970, L1971, I1974, L1984, F2009, V2010, L2012, L2018, W2021, L2022, V2026, A2027, W2038, C2039, V2048, I2057, L2067, A2074, F2086, F2089, A2090, W2506, Y2521, I2526, V2529, L2538, A2547, V2548, A2553, L2555, F2558, V2559, V2564, V2570, I2571, L2573, C2575, C2584, A2585, V2590, V2593, Y2596, V2625, C2633, L2636, L2637, C2638, I2649, L2655, V2657, L2658, V2661, W2664, L2665, C2671, I2672, I2674, L2675, Y2678, V2682, L2686, M2689, M2696, L2697, H2708, M2710, Y2711, W2712, V2713, I2720, V2724, M2730, L2731, I2769, I2776, V2817, L2820, W2824, I2865, M2866, A2870, L2873, V2904, A2914, A2917, F2923, C2939, C2942, V2943, Y2944, M2969, L2971, A2973, L2976, A2980, F2983, M2984, W2989, F2990, V2999, L3007, Y3009, L3011, I3014, I3017, M3022, I3034, A3057, I3060, Y3065, V3069, V3070, V3072, V3081, V3084, I3085, L3101, F3104, M3107, V3109, L3111, I3112, M3115, L3126, V3135, L3139, L3147, M3150, A3151, I3152, V3158, V3159, F3166, A3169, L3170, A3172, L3173, M3176, V3198, F3200, F3205, I3216, V3217, V3218, C3220, V3227, A3230, A3236, A3244, A3251, W3254, L3256, F3259, H3260, L3264, A3267, A3268, A3270, I3271, A3274, V3275, V3277, H3290, L3302, W3305, V3308, W3309, W3315, V3328, L3331, A3352, I3355, I3359, L3365, L3372, M3375, M3378 |
| 427 | Interleukin-1 receptor type 2 | P27930 | V46, L48, W69, A92, L93, L95, A98, C108, I121, L150, W169, L192, V194, Y205, C207, I220, I224, C258, V260, L262, A276, I281, V328 |
| 428 | Genome polyprotein [Cleaved into: Core protein p21/genotype 1a (isolate H) (HCV) | P27958 | V194, V203, C207, C226, C229, V230, C238, W239, V240, L258, I262, L265, A269, C272, L275, C281, L286, F291, W353, V355, A426, L427, W437, F442, C459, F465, C486, C494, A499, V502, C503, V506, C508, F509, F537, L539, W549, C552, W554, C564, A566, C569, C581, C585, F586, A592, Y594, C597, I603, C607, M608, V609, Y611, V629, M631, A642, A643, C644, C652, L665, V674, A684, I690, L692, V699, Y701, V720, L724, L725, L754, C922, V949, L964, A1004, I1061, L1070, A1071, C1073, I1074, V1077, C1078, W1079, V1081, A1085, V1097, L1108, V1109, L1120, L1130, L1132, I1140, V1142, I1158, L1161, L1169, C1171, A1176, V1177, L1179, F1180, A1190, A1192, V1193, F1195, I1196, V1198, L1201, L1228, V1251, L1252, V1253, L1254, M1268, I1291, Y1293, Y1296, A1301, I1312, I1314, C1315, C1318, I1326, I1329, V1332, A1336, L1343, V1344, V1345, L1346, A1347, I1362, I1373, F1375, I1380, V1384, I1385, L1391, I1392, F1393, C1394, C1400, L1403, L1407, I1412, V1432, V1433, V1434, V1435, L1440, F1444, F1448, V1451, I1452, F1470, A1481, Y1499, L1517, C1518, C1520, Y1521, A1526, Y1528, L1539, Y1542, L1555, F1557, W1558, V1561, L1565, I1568, F1572, L1586, V1587, A1588, A1591, C1594, A1599, L1611, H1619, L1624, L1625, L1628, I1641, I1645, V2128, L2441, L2450, L2451, V2457, Y2458, A2465, Y2484, V2487, V2491, A2493, A2494, A2495, V2498, A2500, A2508, C2509, Y2523, A2525, V2528, A2532, A2535, I2539, L2546, L2547, I2558, C2566, A2577, L2579, V2581, L2585, V2587, V2589, C2590, A2594, L2595, V2598, V2599, L2602, A2605, V2606, Y2611, V2621, L2624, A2627, M2635, L2637, Y2639, V2648, I2653, I2659, Y2660, C2662, C2663, A2669, A2672, I2673, L2676, L2680, Y2681, L2686, C2694, C2699, A2701, V2704, L2705, C2709, L2713, A2719, A2721, A2722, C2723, A2726, L2728, M2733, L2734, V2735, L2740, V2741, V2742, I2743, C2744, A2754, L2756, F2759, A2762, M2763, Y2766, A2768, I2783, V2790, A2793, Y2802, L2804, L2812, A2813, A2815, A2816, L2829, I2832, I2833, A2836, L2839, W2840, A2841, I2844, L2845, M2846, H2848, F2849, F2850, L2859, A2862, C2865, I2867, A2870, C2871, Y2872, I2874, L2877, L2879, I2882, I2883, L2886, A2891, F2892, V2905, A2906, C2908, L2909, L2912, V2914, A2919, W2920, A2924, V2927, L2931, L2932, A2938, A2939, C2941, L2945, F2946, A2949, A2961, A2962, F2971, A2973, Y2975, I2980 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 429 | Proteasome subunit beta type-8 (EC 3.4.25.1) | P28062 | L76, A77, F78, F80, V84, I85, A86, A87, V88, A92, A94, V106, I107, L113, L114, M117, C124, L131, C135, L137, I146, V148, A150, A151, L155, M159, M169, M172, I173, C174, L183, V186, A207, M211, A224, L227, A231, I232, A233, A235, V245, V246, M248, Y249, H250, M251 |
| 430 | HLA class II histocompatibility antigen, DM beta chain | P28068 | L51, M61, A73, L90, C97, V117, V119, M132, L133, A134, C135, V137, F140, W149, C192, V194 |
| 431 | Gamma-aminobutyric acid receptor subunit beta-3 | P28472 | V63, M65, I67, I69, Y82, L84, M86, W92, L97, I141, V149, A159, L165, C175, L177, I179, I189, A199, L233, L235, F237 |
| 432 | Mitogen-activated protein kinase 1 | P28482 | A9, V14, F19, V21, Y25, I31, A35, Y36, M38, C40, A42, V49, V51, A52, I53, I56, C65, L69, I72, I74, L75, I83, I84, I86, I89, I95, M98, V101, Y102, I103, V104, L112, L115, L116, L121, H125, I126, C127, F129, L130, I133, L134, L137, I140, H141, A143, V145, L146, H147, L150, L155, L156, L157, L163, I165, F168, L170, A171, L184, A189, W192, Y193, A195, I198, M199, L200, Y205, I209, I211, W212, V214, C216, I217, L218, A219, M221, L222, I227, F228, L234, L237, I240, L241, L244, L252, I255, A260, L264, L267, F279, A286, L287, L289, L290, M293, L294, A307, L308, L313, F329, M333, L335, L338, L343, I347 |
| 433 | Granulins (Proepithelin) (PEPI) [Cleaved into: Acrogranin (Glycoprotein of 88 Kda) (GP88) (Glycoprotein 88) (Progranulin); Paragranulin; Granulin-1 (Granulin G); Granulin-2 (Granulin F); Granulin-3 (Granulin B); Granulin-4 (Granulin A); Granulin-5 (Granulin C); Granulin-6 (Granulin D); Granulin-7 (Granulin E)] | P28799 | C133, C157, C215, C239, C290, C314, C372, C396 |
| 434 | ADP-ribosyl cyclase/cyclic ADP-ribose hydrolase 1 (EC 3.2.2.6) | P28907 | F59, V63, C67, Y70, M77, V85, F89, A92, F93, I101, Y106, L109, M110, C119, I122, L123, L124, A132, F135, L145, L149, L150, L153, A154, W159, C160, V187, F188, V192, A197, A199, A200, V204, V206, M207, L208, I215, F216, F222, V225, V227, L230, V235, L238, A240, V242, L253, I259, L262, I266 |
| 435 | Tumor necrosis factor receptor superfamily member 8 | P28908 | C44, C45, C48, C58, C65, C69, Y74, C81, A83, C84, V85, C87, L92, V93, C98, V105, C106, C108, F113, C114, C122, A123, C125, C131, I136, V137, C233, C240, C244, Y249, L250, C256, C259, V260, C262, L267, V268, C273, W275, C281, C283, C289, C297, A298, C300, C306, V311 |
| 436 | Gap junction beta-2 protein | P29033 | W44, F51, C60, C64, H73, C169, A171, C180 |
| 437 | Neuroendocrine convertase 1 | P29120 | C319, A393, V411, A511, L525 |
| 438 | Amyloid beta A4 protein | P29216 | C49, C53 |
| 439 | Ephrin type-A receptor 3 (EC 2.7.10.1) | P29320 | L33, Y68, V70, L82, V87, A92, I95, Y96, V97, L99, F101, L103, V112, F120, L122, I146, M155, V171, F179, Y180, L181, A182, F183, A188, V190, A191, L192, V195, V197, A436 |
| 440 | Ephrin type-B receptor 2 (EC 2.7.10.1) | P29323 | W43, V61, W72, L73, I78, A83, I86, V88, M90, F92, V94, V103, F111, L113, I141, V150, I159, F166, V169, F174, Y175, L176, A177, F178, L187, V190, V192, A435 |
| 441 | Collagen alpha-5 | P29400 | I1464, L1490, Y1491, L1503, Y1537, W1538, L1539, I1561, C1564, A1565, V1566, C1567, A1569, F1599, H1602, C1620, F1629, I1630, C1632, C1638, C1678, V1680, C1681, M1682 |
| 442 | Interleukin-12 subunit alpha | P29459 | V48, M51, A55, I105, C123, L131, M141, M159, I163, C196, L199, I209 |
| 443 | Interleukin-12 subunit beta | P29460 | V30, V32, V33, V46, I58, W60, V79, A85, C90, L102, L104, I116, A133, F140, C142, W144, V191, C193, I208, V210, V212, A214, Y220, Y223, I229, I233, V252, V254, L271, F273, C274, V275, V277, A304, I306, V308, A310 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 444 | Protein PML | P29590 | C57, C66, L73, H74, L76, C129, C140, C148 |
| 445 | Non-receptor tyrosine-protein kinase TYK2 (EC 2.7.10.2) | P29597 | L28, V30, A53, V56, I60, A61, V64, L73, L76, A81, L91, L101, F103, F109, Y151, L152, F153, F160, A165, L184, M186, A187, L191, H193, C214, I215, F219, Y259, L260, L263, A267, V277, L280, L283, V316, V318, I324, C378, F380, V393, I395, C402, L403, L405, L407, A413, F416, V417, L419, V420, Y423, L426, V438, H452, Y471, L472, L483, L485, V487, I507, V526, L529, I563, V639, L641, L644, F655, A659, V676, C677, I684, M685, V686, L695, L699, V714, A715, L718, A719, A721, L722, L725, V735, I740, L742, I755, L757, V762, V773, I776, A780, W798, F800, A802, L804, L805, I807, C838, L841, L844, C848, F859, I862, L866, L913, V927, V929, A934, W944, I948, L951, H958, I959, I960, C966, L974, L976, V977, L986, L990, L1000, L1001, F1003, A1004, I1007, C1008, M1011, L1014, I1020, H1021, L1024, A1025, A1026, V1029, L1031, V1037, I1039, F1042, L1044, A1045, A1069, C1072, F1078, V1084, F1087, V1089, L1091, Y1092, L1094, L1124, L1127, L1128, L1134, C1140, V1144, M1148, C1151, W1152, L1165, L1169 |
| 446 | CD40 ligand | P29965 | A124, V126, L138, V153, L161, V163, Y169, I171, A173, V175, F177, F189, A191, L193, L231, A235, V237, V239, V241, F256, L258 |
| 447 | Peroxiredoxin-5, mitochondrial (EC 1.11.1.15) | P30044 | V67, V76, L78, F82, V88, L89, F90, V92, F96, C100, H104, L105, F108, A112, L115, A117, V123, A124, C125, L126, V128, A131, W137, A140, A143, L150, A151, F157, L178, F181, M183, V184, V185, V190, A207, I210 |
| 448 | T-cell differentiation antigen CD6 | P30203 | V58, V60, A78, A79, A81, V82, C83, A126, A151, V153, A171, V174, M176, V185, C186, A195, V197, V198, C199, A255, A257, V278, V280, F282, V289, C290, A299, V301, L302, C303, C308, M326, Y328, L337, A355, V358, C360 |
| 449 | Lens fiber major intrinsic protein | P30301 | A12, A15, A19, Y23, V24, L28, L32, V44, A45, F48, A51, V67, A70, V71, A74, A86, Y89, A97, A101, V112, L116, V127, A130, V142, I145, F146, A161, V164, L168, H172, A181, M183, A186, A190, A192, V203, Y204, I209 |
| 450 | HLA class I histocompatibility antigen, B-8 alpha chain | P30460 | M29, Y31, A35, F46, V52, F57, V58, F60, A73, W75, I76, Y83, F91, L102, L105, L119, M122, C125, V127, Y140, Y142, Y147, I148, L150, L154, W157, A163, A164, V176, A177, L184, C188, V189, L192, Y195, L196, L203, V213, A223, L225, C227, A229, F232, Y233, L239, W241, A269, A270, V271, V272, V273, Y281, C283, V285, H287 |
| 451 | Tyrosine-protein kinase receptor UFO (EC 2.7.10.1) | P30530 | L54, C56, L58, V98, L102, C117, V119, V133, C160, W173, F203, C205, A207, A219, I221 |
| 452 | Type-1 angiotensin II receptor | P30556 | I27, C101 |
| 453 | Fibroblast growth factor 9 | P31371 | L66, C68, L74, I76, I94, L95, V105, I107, L116, M118, C134, F136, Y148, V164, A165, L166, F184, F187, V197, L200 |
| 454 | Cytokine receptor common subunit gamma | P31785 | C62, V64, M70, C72, W74, L85, L87, C102, L106, C115, L117, L124, F128, V129, V130, L132, L146, L148, V152, L162, L165, L170, L172, W174, L183, H185, V187, F221, V223, F227, A234 |
| 455 | Low affinity immunoglobulin gamma Fc region receptor II-b | P31994 | A50, L62, V67, L69, W84, A103, Y111, C113, L126, L129, L133, V134, L135, L140, F142, I148, L150, C152, L160, V163, F165, F166, F181, A186, Y194, C196, I212, V214 |
| 456 | Low affinity immunoglobulin gamma Fc region receptor II-c | P31995 | A50, L62, V67, L69, W84, A103, Y111, C113, L126, L129, L133, V134, L135, L140, F142, I148, L150, C152, L160, V163, F165, F166, F181, A186, Y194, C196, I212, V214 |
| 457 | Carcinoembryonic antigen-related cell adhesion molecule 8 | P31997 | L36, A45, V51, L52, L53, V55, Y65, W67, I79, I80, A105, L107, M109, V112, Y120, L122, V124, F138 |
| 458 | Neuronal acetylcholine receptor subunit alpha-3 | P32297 | A139, L140, A153, I187, L189 |
| 459 | 4-hydroxyphenylpyruvate dioxygenase (EC 1.13.11.27) | P32754 | V22, F24, A29, A33, M40, F42, V61, I62, I67, V68, F69, L71, I96, F98, C103, V107, A110, V131, A134, L136, H144, L146, V147, C176, I184, V185, Y200, V217, L224, V228, V229, A230, I236, M238, I240, I252, I267, A268, L269, I274, A277, I278, L281, Y296, L317, I322, Y331, L332, L333, I335, L346, F347, L348, V350, I351, F368 |
| 460 | T-lymphocyte activation antigen CD80 | P33681 | A46, L48, C50, I64, W66, V73, L74, L99, I101, I103, Y114, C116, V118, I160, C162, W175, V200, L204, F214, C216, I218 |
| 461 | Surface antigen S/isolate Human/India/Ind3/1967 (VARV) (Smallpox virus) | P33795 | F36, A66, L83, I210, V238 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 462 | N-acetylgalactosamine-6-sulfatase (EC 3.1.6.4) | P34059 | I33, L34, L35, L36, L37, M38, M41, L46, M62, F69, F72, Y73, A75, A84, A85, L86, L87, L91, F97, A104, I113, I117, L123, L124, L128, I137, V138, W141, L143, H154, W159, H166, V180, Y190, A203, Y209, A213, F216, I217, F226, F227, L228, Y229, W230, A231, V232, A234, Y240, A241, Y254, A257, V258, I261, I265, I268, L272, V283, F284, F285, A291, I294, C308, F314, M318, A322, L323, A324, W325, I342, F346, L350, L368, Y384, M391, A392, A393, A400, H401, V427, I441, F442, A464, I468, L486 |
| 463 | Neurotrophin-4 | P34130 | V118, V120, A179, I193 |
| 464 | Catenin alpha-1 | P35221 | A128, L141, L150, V157, I161, L164, L173, L187, A191, L198, M207, A208, L221, L229, L243, I244, L248, V252, I255, A258, A259, F285, L305, I312, A316, M319, I333, A339, V340, L344, L347, L348, M371, L378, L382, A385, V386, H389, V390, L395, L401, L404, A407, A408, V416, F423, A427, L430, V433, A434, A437, C438, V450, M452, L457, A459, L460, V464, A468, L471, A480, W491, V497, L498, A501, V502, F511, L512, V514, I519, C526, A529, L530, L538, A542, I545, A549, V552, V556, V572, L573, L579, V583, F587, A594, F611, A614, V618, I622, I625, F691, L698, I712, A716, M719, M723, M726, V742, A745, A746, I749, A752, M756, L759, I763, L776, L780, I783, L790, C793, A815, L818, I819, A821, A822, L825, M826, A828, V829, V833, A839, A896, A902 |
| 465 | Catenin beta-1 | P35222 | A149, I153, L160, V168, A171, A172, V175, I188, M194, V195, A197, I198, V199, M202, C213, A215, L218, L221, L228, I231, I237, A239, L240, V241, V251, L252, A255, I256, L259, L262, L263, A269, V273, L279, M282, L285, F293, L294, A295, C300, L301, L304, A305, I315, A317, L324, V325, I327, M328, L336, L337, V343, L344, L347, C350, I357, V358, A360, M363, A365, L366, L368, L370, L377, V378, C381, L382, L385, L388, A391, A392, M398, L401, L402, L405, V406, L408, L409, V417, C419, A420, A421, I423, L424, L427, V438, I444, L447, V448, V451, A454, I460, A464, I465, A467, L468, L471, A481, A484, V485, L491, V494, V495, L497, L498, L506, I507, A509, V511, L513, I514, L517, A518, L519, A522, A525, L527, A532, I533, L536, L539, L540, A543, V564, M566, I569, V570, C573, A576, L577, L580, A581, V584, I590, I596, L598, F599, V600, L602, L603, I610, V613, A614, A615, V617, L618, L621, A622, A627, A628, A630, I631, A633, A636, L640, L643, L644, V651, A652, A655, A656, V658, L659, L781 |
| 466 | Interleukin-13 | P35225 | L43, L46, I47, L50, C62, V67, M76, Y77, A79, A80, L81, L84, I93, L100, C104, V125, F128, V129, L132, L136 |
| 467 | Thrombospondin-2 | P35442 | I600, C619, A639, C707, C715, C720, C756, C779, C815, C838, C876, A882, C912, C932, C948, F959, V965, L967, L988, I998, A999, V1000, F1005, F1010, V1016, Y1024, A1025, F1027, V1028, F1029, Y1031, F1037, Y1038, V1039, M1041, A1057, L1065, V1067, V1068, L1078, A1081, L1082, W1083, V1092, L1114, H1116, I1123, V1125, Y1145, L1150, L1152, F1153, V1154, F1155, V1160, F1162, L1165, Y1167, C1169 |
| 468 | D(3) dopamine receptor (Dopamine D3 receptor) | P35462 | C103 |
| 469 | Alpha-L-iduronidase (EC 3.2.1.76) | P35475 | V32, V34, W47, F52, A61, V65, L72, L74, A75, Y76, V77, A79, V88, W92, L93, L94, L96, V97, L114, Y117, L120, L121, F130, L132, M133, A136, F140, F143, V149, W152, L155, V156, L159, A160, Y163, V172, W175, F177, W180, F198, Y201, Y202, A204, C205, L209, L216, L218, F225, L237, L238, Y258, I259, L261, I272, V279, I283, A300, A314, V316, Y318, A319, A320, M321, V322, V323, V325, I326, A327, H329, L333, A340, L346, A351, L353, F360, L365, A367, V371, L381, L382, V386, L387, A389, L393, A394, L396, L401, V418, L421, A422, A436, A437, V438, L439, I440, Y441, A442, A448, V456, L460, V472, L476, C481, F501, M504, A507, L530, L535, L537, V538, H539, V540, C541, V551, L564, V565, L566, V573, C577, L578, Y581, I583, L604, V614, Y618, V620, A622 |
| 470 | Fibrillin-1 [Cleaved into: Asprosin] | P35555 | C67, C80, C100, C134, C145, C853, C875, A882, I911, C1526, C1534, C1562, C1564, A1569, I1607, L1613, L1616, C2061, C2083, C2084, C2085, I2110, C2111, C2137, C2164, C2190, C2363, C2364, C2365, W2371, C2378 |
| 471 | Myosin-9 | P35579 | V34, A44, A54, V56, L58, M86, L89, A95, V97, L98, L101, Y105, L109, I110, Y111, Y113, F117, C118, V119, V120, I121, I129, I134, V135, Y138, M146, H149, I150, Y151, I153, A157, M161, I170, L171, C172, A178, V187, I188, Y190, L191, A192, V194, A195, A214, I217, L218, A220, F221, A224, F235, F238, I239, I241, F243, V250, A252, Y257, L258, A264, F274, I276, F277, Y278, Y279, L280, L288, L292, L293, F302, L303, I310, F319, A325, M326, M329, L339, L340, V342, I343, V346, L347, L349, I352, F354, A363, A370, A371, V374, L377, L378, F385, I389, L390, A410, F412, A413, I414, A416, L417, A418, A420, Y422, M425, F426, L429, V430, I433, L437, I448, I450, L451, F456, F464, L467, C468, Y471, L479, F480, Y492, I497, F504, L508, C511, I512, L514, I515, I524, L525, L527, L528, F542, V546, F556, F568, C569, I570, I571, H572, V577, Y579, A581, W584, M589, I596, A597, L600, F607, V608, W612, V646, Y650, L654, L657, M658, L661, F668, V669, C671, I672, I673, V688, L689, L692, V697, I701, I703, F708, F714, F717, Y721, I729, A739, C740, M743, I744, V761, F762, F763, V767, L771, I783, F786, M809, M871 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 472 | Alpha-actinin-2 | P35609 | F44, C48, L70, L75, L76, V100, L114, A119, I122, V123, I134, I138, A142, I143, I146, L157, C161, I173, W180, L184, L186, C187, A188, L189, I190, L203, I209, I212, A215, M216, A219, A231, V235, A244, I245, M246, Y248, V249, F252, Y253, A262, L289, A290, I297, L304, A315, M316, L348, L378, A381, L389, A403, F406, A410, H413, A417, L424, V437, H444, I461, A465, L468, V479, I486, L493, L504, M507, H518, F521, A525, M532, A535, I551, L565, I575, V582, I593, L607, V614, L625, A646, I649, I667, L678, H683, L695, V707, M717, I720, L727, I731, M798, A839, Y844, I845, L850, A859, I863, A878 |
| 473 | Metalloproteinase inhibitor 3 | P35625 | I40, I42, A44, V46, L60, I64, V79, I82, L104, M113 |
| 474 | Copper-transporting ATPase 2 (EC 3.6.3.54) | P35670 | V145, L147, V149, I161, V165, A183, I185, Y187, L197, V201, F206, C271, I279, V285, A297, V299, L311, I315, I363, I365, I377, I381, V401, L413, I417, C490, L492, I494, V503, I506, L510, V516, V519, L520, A528, I530, Y532, I542, A543, I546, A553, I566, L568, I570, I582, L586, A595, A604, V606, F608, I618, I619, I622, A629, V820, C1079, V1106 |
| 475 | Myosin-11 | P35749 | V38, A48, V58, V60, L62, M90, L93, A99, V101, L102, L105, Y109, L113, I114, Y115, Y117, F121, C122, V123, V124, V125, I133, I138, V139, Y142, M150, H153, I154, Y155, I157, A158, A161, M165, I174, L175, C176, A182, V191, I192, Y194, L195, A196, V198, A199, A221, I224, L225, A227, F228, A231, F242, F245, I246, I248, F250, V257, A259, Y264, L265, A271, F281, I283, F284, Y285, Y286, M287, M295, L299, L300, F309, L310, I317, F326, A332, M333, M336, I346, L347, V349, V350, V353, L354, L356, I359, F361, A370, A377, A378, V381, C382, L384, M385, F392, I396, L397, A417, F419, A420, V421, A423, L424, A425, A427, Y429, L432, F433, I436, L437, V440, L444, L455, I457, L458, F463, F471, L474, C475, Y478, L486, F487, Y499, I504, F511, L515, C518, I519, L521, I522, V531, L532, L534, L535, F549, L553, F563, F575, I577, I578, H579, V584, Y586, A588, W591, M596, V603, L607, F614, V615, W619, V653, Y657, L661, L664, M665, L668, F675, V676, C678, I679, I680, A692, V695, L696, L699, V704, I708, I710, F715, F721, F724, Y728, I736, A746, C747, M750, I751, I768, F769, F770, V774, L778, F806, W832, L885 |
| 476 | Glutaredoxin-1 | P35754 | V6, I10, V15, V16, V17, F18, I19, C26, A29, I32, L33, I48, I57, L61, V73, F74, I75, L86, L95, L99, A104 |
| 477 | Vascular endothelial growth factor receptor 2 | P35968 | V136, I148, C150, L161, C162, A163, F185, I187, I192, A195, V198, C200, A202, I223, L244, C246, A248, V254, L292, I294, V297, Y305, C307, A309, V322 |
| 478 | Tyrosine-protein kinase BTK (EC 2.7.10.2) | P35991 | V219, A221, L233, L235, Y241, A254, I264, A291, V427, I429, I432, F442, M449, L457, V458, Y461, V463, C464, I470, I472, I473, L482, L486, L498, C502, V505, C506, A508, M509, L512, H519, L522, A523, A524, C527, V529, V535, V537, F540, V568, I580, W581, F583, V585, L586, M587, W588, I590, I610, A622, I629, M630, C633, W634, F644, L647, I651 |
| 479 | Chitinase-3-like protein 1 | P36222 | L24, V25, C26, Y27, Y28, C41, L46, L50, C51, I54, I55, Y56, F58, A59, L76, Y77, L80, L90, L93, L94, V96, F101, F106, I109, A110, F119, I120, V123, L127, F132, L135, L137, A138, W139, F150, L153, I154, M157, F161, L172, L173, L174, A176, A177, L178, A180, I185, I191, I194, L198, F200, I201, I203, H218, H219, L222, A240, V241, M244, L254, V255, M256, I258, F265, V274, A276, A295, Y297, I299, V316, Y318, A319, W325, V326, Y328, V334, V338, L341, A349, M350, V351, A353, L354, F359, F370, L372, A375, I376 |
| 480 | Phosphoglucomutase-1 | P36871 | L22, V26, Y35, A36, F39, I40, I43, I44, A55, L57, V58, V59, A70, I71, I74, A75, I77, A78, A79, I83, L86, I88, L94, A98, V99, I103, I106, I112, I113, L114, A116, F127, I129, I147, C160, L163, V165, F184, V186, V192, Y195, L199, L208, L212, L218, I220, I222, A224, V228, Y232, V233, I236, L237, L241, F257, A269, L272, M276, F283, A285, A286, F287, M295, I296, L297, V304, V310, A311, V312, I313, I320, F323, F331, A332, M335, L341, A345, F362, L371, L373, C374, I386, L392, W393, A394, V395, L396, A397, W398, L399, I401, V409, I412, L413, F424, V433, A438, M441, L445, M449, F454, V468, L490, L492, F494, I500, V501, F502, I514, L516, Y517, I518, I528, L536, L539, A543, L549 |
| 481 | Receptor-type tyrosine-protein kinase FLT3 (EC 2.7.10.1) | P36888 | L143, L182, C231, A233, L268, I270, C272, A274, C330, F369, F418, A420, A443 |
| 482 | Bone morphogenetic protein receptor type-1A | P36894 | A428, I437, V450, V473, V496, L499, W504, A509, L515, L521, M524, V530 |
| 483 | Activin receptor type-1B (EC 2.7.11.30) | P36896 | A401, Y410, H423, V446, M469, M472, W477, A482, L488, L494, L497, V503 |
| 484 | TGF-beta receptor type-1 | P36897 | A399, F408, H421, V444, M467, I470, W475, A480, L486, L492, L495, I501 |
| 485 | Guanine nucleotide-binding protein-like 1 | P36915 | I363, C365, V366, F368, L376, I377, L380 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 486 | Tumor necrosis factor receptor superfamily member 3 | P36941 | C80 |
| 487 | Pigment epithelium-derived factor | P36955 | L54, A55, A57, F61, L65, Y66, V78, L80, V85, A86, A88, L89, L92, A96, I104, L108, Y122, L125, V129, V143, F144, F154, L158, V184, M188, I205, L207, L208, V210, A211, F213, F231, M244, C261, A264, I274, I275, L293, I298, A310, V314, L317, V325, L329, L337, I346, L353, H358, A360, F362, Y388, L390, F394, I395, F396, V397, L398, L407, F408, I409, I412 |
| 488 | Serine/threonine-protein kinase receptor R3 | P37023 | L405, V418, V441, L464, M467, W472, L483, L489, I492 |
| 489 | TGF-beta receptor type-2 | P37173 | C51, C61, C84, V85, A86, V87, V100, C121, F133, C136, C138, I147 |
| 490 | Electron transfer flavoprotein subunit beta | P38117 | V6, L7, V8, V13, A45, V46, A49, V61, I62, A63, V64, I75, A78, L79, A83, I87, H88, V89, V91, A105, V107, L108, L111, A112, L119, V120, A139, A150, L160, V162, A179, V180, V181, A183, A201 |
| 491 | 40S ribosomal protein S19 | P39019 | V6, F14, L18, A19, F53, A57, A58, A61, L64, V99, A100, V103, L104, V113, L131, A135 |
| 492 | 60S ribosomal protein L3 | P39023 | A45, F46, L47, I56, V76, I78, V79, M84, V87, I89, V105, C114, M153, I160, V162, A164, H165, M168, A178, V185, L194, A197, V207, I217, V219, I220, V222, V231, I284, I314, F320, F330, V331, M332, L333, L345, L347, I368, M382 |
| 493 | Collagen alpha-1 | P39060 | M1454, V1461, I1467, V1469, L1581, L1583, V1584, A1585, L1586, A1600, C1604, A1608, A1619, F1620, L1621, L1628, I1631, V1632, I1642, W1654, L1657, V1679, W1685, V1690, W1691, H1692, C1706, W1709, A1720, L1723, L1728, L1729, C1736, I1741, V1742, L1743, C1744, I1745 |
| 494 | Glial cell line-derived neurotrophic factor | P39905 | V127, F190, A205 |
| 495 | Thrombopoietin | P40225 | L33, L56, V60, L62, A81, I84, L85, V88, L91, V95, A98, L111, L114, V118, I148, F149, F152, L156 |
| 496 | Thrombopoietin receptor | P40238 | L30, L31, C40, F41, F45, L48, C50, F51, W52, L65, Y67, C77, C93, F95, V101, L103, F104, L107, L109, V111, V127, V130, L132, A134, I139, A141, L150, I152, W154, F164, L165, Y167, L234, L246, Y252, W269, W272, L396, I401, L406, L408, W410, A418, Y423, Y427, W435, V437, L438, A444, L449, L451, Y457, A463, Y470, W474, W477 |
| 497 | B-cell antigen receptor complex-associated protein beta chain | P40259 | V61, M63, C65, W76, A105, L107, I109, Y120, C122 |
| 498 | Alcohol dehydrogenase class 4 mu/sigma chain (EC 1.1.1.1) | P40394 | A24, A25, V26, L27, F34, I39, V41, V49, I51, I53, A55, I58, H64, V65, V76, I77, V78, H80, A82, V96, V102, I103, L105, L107, C116, C124, L135, A136, F142, C144, V149, H151, F152, F158, V163, V164, V169, A170, I172, A176, V181, C182, L183, I184, F188, Y192, A194, A195, C207, V208, V209, F210, L212, L217, V219, I220, C223, I231, I232, I234, A244, I253, V265, L266, V274, F278, A290, L291, C294, V302, V303, F331, V340, L343, V344, L354, L357, F364, I367, F371, V383, L384 |
| 499 | Leptin | P41159 | I35, I38, L72, M75, L79, Y82, I85, I97, L101, L104, L108, A112, A146, L150, L154, M157 |
| 500 | Extracellular calcium-sensing receptor | P41180 | A46, V115, I135, F320, A321 |
| 501 | Aquaporin-2 | P41181 | I112, L116, A127, C181, M183, A186, A190, A192 |
| 502 | Glycine--tRNA ligase (EC 3.6.1.17) | P41250 | M124, L128, F133, A137, L157, I161, W165, F169, L189, V203, A214, L218, L222, M239, L254, L280, A301, I304, F305, F308, A323, A324, A349, I351, F354, V368, A369, L373, A380, A387, L392, A395, I401, V405, L406, F409, I410, I413, Y416, L417, V420, L427, F429, W445, A447, I458, V459, C461, C466, L469, L480, A482, A503, I504, V515, I521, I542, L551, V574, I575, F579, L581, I584, M585, Y586, V588, F589, F593, F605, F607, V611, A612, C616, V618, L619, F627, L634, L638, V643, Y658, V666, A667, F668, V670, I672, A684, L686, I695, A697, L702, I705, V706, V719 |
| 503 | T-lymphocyte activation antigen CD86 | P42081 | A36, L38, C40, L53, V54, V55, L95, L97, L100, C110, I111, I112 |
| 504 | Glutamate receptor 1 | P42261 | I25, I27, L30, F31, A41, F42, L46, L55, M70, F74, V82, A84, I85, F86, V94, L97, C101, V106, F108, I109, F113, F121, V122, L123, L125, L129, A132, L133, I136, I137, F145, V146, Y147, V161, A165, I177, L192, V200, V201, V202, C204, L209, L213, I216, I217, Y228, I229, L230, A231, L233, F235, F243, A248, V250, F253, V256, I266, W270, V281, A291, L292, V297, V299, M300, A303, F304, L307, A320, I337, A340, L341, L349, V353, L366, V368, Y409, I410, V411, Y419, V420, L422, F429, Y435, Y438, C439, V440, L442, A443, A444, I446, A447, L456, A466, M477, V478, L481, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | A486, V488, A489, V490, A491, L493, I495, I503, F509, L512, I514, I516, M517, I518, I647, L653, A654, Y661, F672, F673, M684, Y687, M688, V695, V697, M704, V707, Y714, A715, Y716, L717, L718, Y725, Y746, I748, A749, V760, A763, V764, L765, L767, L772, L773, L776, W780, W781 |
| 505 | Glutamate receptor 3 | P42263 | I34, I36, L39, F40, A50, F51, V55, F69, L71, V86, F90, V98, A100, I101, F102, M110, L113, C117, F124, V125, F129, F137, V138, I139, M141, L145, A148, I149, L152, L153, F161, V162, Y163, I177, A181, V193, M209, Y217, L218, I219, C221, I226, L230, V233, V234, Y245, M246, L247, A248, L250, F252, V260, A265, I267, F270, V273, V280, F283, W287, A298, A301, L303, A308, L309, A313, I314, V316, I317, A320, F321, L324, A337, I354, A357, L358, M366, I370, I383, V385, I425, V426, V427, Y435, V436, Y438, L445, Y451, Y454, C455, V456, L458, A459, Y460, I462, A463, L472, A482, M493, V494, L497, A502, I504, A505, V506, A507, L509, I511, I519, F525, L528, I530, I532, M533, I534, I665, L671, Y679, F690, F691, M702, Y705, M706, V713, V722, V725, F732, A733, F734, L735, L736, Y743, Y764, V766, A767, V778, A781, V782, L783, L785, L790, L791, L794, W798, W799 |
| 506 | Phosphatidylinositol 4,5-bisphosphate 3-kinase catalytic subunit alpha isoform | P42336 | M16, L21, V22, C24, L25, L26, M30, I31, V32, C36, L42, I45, L49, A53, L61, I69, F70, V71, V73, F82, F83, L89, L92, L94, F95, L99, V101, I117, A120, I121, V125, F128, V136, F139, I143, L144, C147, A150, A163, Y165, I181, I190, V192, V193, I194, L209, I211, V220, I221, A222, A224, L239, L244, L252, V254, C255, C257, Y260, F261, L262, L267, Y270, Y272, I273, C276, L285, L293, L327, I330, L334, I336, I338, A341, I354, Y355, V356, I360, Y361, V376, L387, Y389, I393, L396, A399, A400, L402, C403, L404, I406, C407, V409, C420, L422, A423, L429, F430, L443, L445, L452, L456, V461, L473, L475, V484, I492, A496, L531, I534, L540, L551, C558, V559, I564, L565, L568, L569, L570, V580, A581, M583, V587, I593, A598, M599, L601, L602, V611, F614, A615, V616, C618, L619, L628, Y631, L632, L635, V636, V638, L639, L648, L649, V650, L653, L654, A657, L658, I663, H665, F667, F668, W669, L671, V680, F684, L686, L687, L688, Y691, C692, A694, C695, Y698, L699, L702, V706, A708, M709, L712, L715, I718, L719, L735, M739, F744, A747, L748, F751, L755, L761, L764, C769, I771, L779, L781, W783, I788, M789, L792, L793, I799, F801, L807, L812, L814, I816, I817, M820, W824, L831, M833, L834, L839, L847, I857, I860, L877, H878, L881, A893, L896, F897, C901, A902, Y904, C905, V906, A907, F909, I910, L911, I913, I921, M922, V923, L929, F930, H931, F934, F937, L938, F954, F960, L961, I962, V963, I964, C971, F977, F980, C984, A987, Y988, A990, I991, A995, F998, I999, L1001, F1002, M1004, M1005, M1010, L1013, F1016, I1019, Y1021, I1022, L1026, A1035, F1039, M1043, W1051 |
| 507 | Protein AF-9 | P42568 | V7, L11, L13, H15, A17, V34, V36, F47, V48, V51, V52, F53, Y71, I82, L83, I85, V87, F89, Y102, L104, F131, L135, I522, I526, I530, V555, L558 |
| 508 | Dipeptidyl aminopeptidase-like protein 6 | P42658 | V131, V133, F156, V165, A201, L202, V220, L242, A245, I255, F256, I257, I262, W291, L292, Y293, A303, A314, I318, L328, L356, H357, V358, L361, L368, M370, Y382, I383, V394, A395, V396, W398, I407, C411, A413, W429, F447, H462, I463, V487, I500, F502, L514, A517, V520, L528, C536, F550, C554, V564, H565, L606, M608, I610, L624, L625, M649, V650, A655, V656, V657, L672, V676, M689, V692, M695, V706, A707, V708, Y716, L717, I721, F733, C735, A738, I742, F745, A749, A751, L757, Y767, V772, V776, L785, I786, I787, H788, I795, F797, H799, L807, I839, F843 |
| 509 | Leukemia inhibitory factor receptor | P42702 | V81, I112, L134, L153, V170, V176, L211, H216, V218, I220, V254, F269, C270, C271, V277, A280, I299, V314, F316, I327, A329, I349, C351, W353, L371, F397, Y406, F408, L410, A412, I427, V431, L451, F459, C466, I468, V494, I509 |
| 510 | Wiskott-Aldrich syndrome protein | P42768 | F258, L267, L270, F271, L281, I290, F293, I294, V303, L326, I438, L470 |
| 511 | Growth/differentiation factor 5 | P43026 | C400, F409, C433, A447, I476, C498, C500 |
| 512 | Platelet-activating factor acetylhydrolase IB subunit alpha | P43034 | V111, M123, V124, A126, I132, L146, V153, L165, A166, C168, I174, L176, W177, M188, V195, V198, I207, V208, A210, I216, W219, V237, V240, I249, A250, C252, V258, V260, L272, V279, C281, L311, L312, I320, L334, V341, I353, L354, C356, A357, L362, W365, Y367, V383, V396, V404, V406 |
| 513 | Cathepsin K (EC 3.4.22.38) | P43235 | I44, L48, Y126, V130, C136, C139, W140, A141, A147, L148, L159, L162, L167, V168, V171, A185, F186, V189, I195, Y201, M211, A219, C221, I227, L235, A238, V239, V242, V245, V247, A248, I249, A251, F256, F258, Y264, Y265, L274, H276, A277, V278, L279, A280, V281, Y283, W292, I294, W302, I308, M310, A311, A317, C318, I320, A321, L323, A324 |
| 514 | Hemagglutinin [Cleaved into: Hemagglutinin HA1 | P43258 | A11, L13, C14, L15, A19, V26, V36, L42, V43, I51, C52, I58, C64, L66, I67, L70, L71, C76, F79, L86, F87, V88, F94, C97, Y98, Y100, Y105, A106, L108, V112, A113, L118, F125, A138, C139, F147, F148, L151, L154, L164, Y178, W180, |

TABLE 5-continued

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | TARGETS | | |
| | chain; Hemagglutinin HA2 chain]/strain A/Duck/Hong Kong/64/1976 H3 | | V182, H183, H184, Y195, V202, V204, I230, I232, Y233, I236, V237, V242, L243, I245, L251, I252, A253, F258, I274, C281, I282, I288, V309, L316, A317, A334, W343, Y351, A373, A425, L447, L455, C466, F467, I469, H471, C473, C477, I478, I481, A495 |
| 515 | Hemagglutinin [Cleaved into: Hemagglutinin HA1 chain; Hemagglutinin HA2 chain]/strain A/Duck/Hong Kong/231/1977 H3 | P43259 | A11, L13, C14, L15, A19, V26, V36, L42, V43, I51, C52, I58, C64, L66, I67, L70, L71, C76, F79, L86, F87, V88, Y94, C97, Y98, Y100, Y105, A106, L108, V112, A113, L118, F125, A138, C139, F147, F148, L151, L154, L164, Y178, W180, I182, H183, H184, Y195, V202, V204, I230, I232, Y233, I236, V237, V242, L243, I245, L251, I252, A253, F258, I274, C281, I282, I288, V309, L316, A317, A334, W343, Y351, A373, A425, L447, L455, C466, F467, I469, H471, C473, C477, I478, I481, A495 |
| 516 | Hemagglutinin [Cleaved into: Hemagglutinin HA1 chain; Hemagglutinin HA2 chain]/strain A/Goose/Hong Kong/10/1976 H3 | P43260 | A11, L13, C14, L15, A19, V26, V36, L42, V43, I51, C52, I58, C64, L66, I67, L70, L71, C76, F79, L86, F87, V88, F94, C97, Y98, Y100, Y105, A106, L108, V112, A113, L118, F125, A138, C139, F147, F148, L151, L154, L164, Y178, W180, V182, H183, H184, Y195, V202, V204, I230, I232, Y233, I236, V237, V242, L243, I245, L251, I252, A253, F258, I274, C281, I282, I288, V309, L316, A317, A334, W343, Y351, A373, A425, L447, L455, C466, F467, I469, H471, C473, C477, I478, I481, A495 |
| 517 | Neuronal acetylcholine receptor subunit alpha-4 | P43681 | A141, H142, A155, V165, I189, L191 |
| 518 | 2-C-methyl-D-erythritol 2,4-cyclodiphosphate synthase/strain ATCC 51907/DSM 11121/KW20/Rd | P44815 | H11, L19, I20, I21, V26, F32, I33, A34, V40, A41, L42, H43, A44, L45, A48, I49, L50, A52, A53, I58, L77, L78, A81, V85, I92, V95, I97, I99, M106, I110, M113, A115, I117, A118, L121, I125, V128, A132, I147, A148, C149, A151, A153, L154, L155, I156 |
| 519 | Aspartoacylase (EC 3.5.1.15) | P45381 | I11, V14, A15, I16, F17, V31, I41, A57, L69, F73, A93, I96, F100, I111, I112, F113, M122, C124, L126, L128, L136, I137, M139, F140, I143, V154, L156, I170, V175, I177, V179, M195, M198, A202, L203, F205, I206, F209, I220, V222, I225, A241, L247, V281, V283, A294, F295, A296, I308 |
| 520 | Short/branched chain specific acyl-CoA dehydrogenase, mitochondrial | P45954 | A72, I76, M83, V93, L97, M103, I105, V107, V122, L123, V124, I125, L128, A129, A133, V135, A136, C139, I146, L149, I150, L163, L166, C175, A181, A192, L201, I208, A211, A214, L216, F217, L218, V219, M220, A221, I232, F235, L236, V237, L244, C261, L263, V268, V270, L276, A286, I295, I297, A298, A299, M301, L302, L304, A305, C308, I316, L332, L343, A346, A353, A354, A367, A370, A374, A378, C385, V400, A407 |
| 521 | Chemokine XC receptor 1 | P46094 | A26, W27, V28, F29, A30, L32, A33, V36, L37, C39, L40, F42, L46, V47 |
| 522 | Large proline-rich protein BAG6 | P46379 | V19, V21, A35, V39, F42, I46, V50, L59, L72, V77, I82, L84 |
| 523 | Vesicle-fusing ATPase (EC 3.6.4.6) | P46459 | V23, I74, F121, V514, A551, A554, L623, L627, L677 |
| 524 | Neurogenic locus notch homolog protein 1 | P46531 | C423, C438, C449, C456, C461, C487, C525, C942, C1056, C1180, C1454, C1467, C1496, C1509, L1515, C1536, L1574, V1575, V1576, V1577, V1578, L1585, F1592, L1596, L1600, I1616, V1676, L1678, I1680, C1685, A1696, V1699, A1700, L1703, A1705 |
| 525 | 40S ribosomal protein S10 | P46783 | L15, F16, M21, A23, V45, A48, M49, L79 |
| 526 | E3 ubiquitin-protein ligase NEDD4 (EC 6.3.2.—) | P46934 | G451, Y463, L499, L529, L563, Y785, F858, F948, M964, I979, L988, A990, L992, F996, A1008, W1011, F1012, I1015, M1019, F1027, F1054, F1056, I1057, V1060, A1061, M1063, A1064, V1065, L1071, F1075, Y1080, M1083, L1084, M1093, L1104, F1119, I1121, V1143, Y1151, V1155, M1168, F1171, F1175, L1178, I1179, I1184, F1187, L1192, M1196, C1197, W1207, V1223, I1224, F1227, W1228, A1230, V1231, L1242, L1243, V1246, F1257, L1260, F1269, V1271, L1290, L1292, L1301, L1305, I1309 |
| 527 | 3-hydroxyanthranilate 3,4-dioxygenase (EC 1.13.11.6) | P46952 | L32, I48, L64, V66, L85, V89, V100, V104, L116, Y119, L194, V211, A213, L230, L248, L255, A272 |
| 528 | F-actin-capping protein subunit beta | P47756 | A9, L25, L39, L60, V119, Y120, A129, V131, L133, I134, H152, V154, V156, A165, Y167, L169, V173, M174, V217, M220, I224 |
| 529 | Tumor necrosis factor ligand superfamily member 6 | P48023 | A147, L149, L160, L181, I183, Y189, V191, V195, F197, L207, H209, V211, L257, V259, F276, L278 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 530 | Stromal cell-derived factor 1 | P48061 | I59, A61, I72, I79 |
| 531 | Glycine receptor subunit beta | P48167 | V80, V82, V84, I86, Y101, V103, I105, W111, L116, L128, L163, I165, V171, I179, L181, C183, L187, F190, C197, M199, L201, L211, F213, C255, V256, V258, F260, L262, V273, I280, V281, F288, L309, A328, L329, L333, C336, V350, M353, A370, A470 |
| 532 | Transcription factor SOX-9 | P48436 | V114, A116, L123, L135, L139, F154 |
| 533 | G protein-activated inward rectifier potassium channel 4 | P48544 | W108, A139, L168, A206, V207, I208, L217, V221, I234, A236, L238, L252, I257, L274, M289, V301, V303, L305, A318, Y322, F351, A368 |
| 534 | T-complex protein 1 subunit epsilon | P48643 | A33, A41, M48, A75, I77, I87, M91, V109, V110, A113, L116, L123, I133, A140, A144, A169, L173, A186, A189, A192, V204, I229, M239, A246, I248, A249, I250, L251, F255, I289, I292, A297, L299, A300, I301, C302, A310, L314, L319, A321, I330, I333, A356, V359, V373, I374, I385, F386, I387, L402, A405, V408, I409, L412, V419, A424, A425, I427, A430, V433, A437, F451, A452, A454, A461, V477, L510, A520, I527 |
| 535 | Protein ERGIC-53 | P49257 | V64, I80, V82, A83, V93, W94, A99, V106, V108, F110, V112, A120, L123, A124, W126, Y127, A128, V137, F138, V147, F150, F151, I165, I167, I168, I174, F194, V201, A203, I205, L212, V214, I216, A231, F244, I246, A248, H257, V259, F262, F265 |
| 536 | Alpha-aminoadipic semialdehyde dehydrogenase | P49419 | L33, L42, Y55, C70, I77, A78, V80, V92, A95, A98, W102, V114, I117, L121, I125, L128, L131, V132, L134, M136, V147, Y150, V151, I153, C154, A157, I179, L187, V188, I190, I191, V198, A199, V200, Y201, A206, I207, A208, M209, I210, C211, V214, C215, L216, W217, L225, I226, V228, A229, V230, I234, L238, A246, I247, L250, C252, I257, A260, M261, A262, V267, L269, L270, V286, L294, A302, I303, I304, A305, V314, A318, A321, A326, A333, L336, F337, I338, V346, L350, Y369, L372, F381, A384, V385, A388, Y408, V409, I413, V414, A424, A430, I432, L433, V435, F436, F438, V444, L455, I459, F460, W470, Y516 |
| 537 | Alanine--tRNA ligase, cytoplasmic (EC 6.1.1.7) | P49588 | I10, F14, F17, F18, A42, A44, M46, F49, A69, A70, C75, I76, F97, L101, W104, C115, M117, A118, L121, L122, Y134, V135, F138, C152, W156, C184, C187, I190, H191, A200, L212, W215, L217, F219, I220, I238, M242, L244, L247, V248, Y258, F263, Y266, I270, A288, A294, Y295, V297, L298, A299, H301, A302, I305, V307, A308, L309, L324, I327, L328, A331, V332, A335, L339, F346, A347, L349, V350, V353, L357, F361, I375 |
| 538 | Prolactin-releasing peptide receptor | P49683 | A44 |
| 539 | Cartilage oligomeric matrix protein | P49747 | C287, C292, C328, C351, C387, C410, C448, C484, C504, F531, L539, L570, A571, V572, F577, F582, H587, V588, Y596, A597, I600, F601, F609, Y610, V611, M613, A629, A631, I635, L637, A639, V640, L650, A653, L654, W655, V664, W684, L686, H688, Y694, I695, V697, M717, L722, V724, F725, C726, I732, W734, A735, L737, C741 |
| 540 | Presenilin-1 | P49768 | V89, C92, M93, V96, A136, I213, L226, A231, A234, L235, A246, V261, A285, V379, L381, F386, Y389, V391, L392, V393, A396, C410, I414, I439, M457 |
| 541 | Bis(5'-adenosyl)-triphosphatase (EC 3.6.1.29) | P49789 | F23, A24, V36, L37, V38, C39, L58, V65, V69, H94, V99, A139, L142 |
| 542 | Presenilin-2 | P49810 | V95, C98, M99, V102, I219, L232, A237, A240, L241, A252, V267, A291, L362, F367, Y370, L373, V374, A377, C391, I395, I420 |
| 543 | Glycine amidinotransferase, mitochondrial (EC 2.1.4.1) | P50440 | V66, W72, V78, I79, V80, A83, A86, C87, V88, V95, A97, Y107, F115, A123, I127, M130, C131, L134, L163, Y164, A166, M167, I171, L172, I173, V174, I179, I180, A182, M184, A185, W186, A195, Y196, I200, Y203, M218, L222, I229, V245, C252, F253, A255, A256, I259, A261, I265, F266, A267, V272, M281, I294, I304, F308, I310, I311, V316, L317, F330, M353, M360, V362, L363, M364, L365, V370, M371, V372, I379, F383, V393, I395, A398, L401, F405, H406, W408, C410, V412 |
| 544 | Serpin H1 | P50454 | L102, V107, A109, A203, V226, M271, L324 |
| 545 | Dynamin-2 (EC 3.6.5.5) | P50570 | V13, L16, F20, L29, I34, A35, V36, V37, A42, V47, L48, F51, V52, F56, L57, L69, L71, L73, I74, A81, F83, F91, V97, I120, L122, V124, V129, L132, L134, I135, L137, I140, I152, I156, I160, I164, I171, L172, A173, V174, A177, A186, A190, V193, I201, V203, I204, L207, A216, I232, V234, F259, Y265, A269, L277, L281, L285, I289, L293, L300, L304, L305, F336, F340, F370, L374, L384, I388, I392, A408, F409, V413, V417, C424, C427, V428, V431, L435, V439, C442, L452, I459, V460, I475, I479, L526, I528, Y541, F543, L545, L550, W552, I572, F586, A587, I588, F589, I603, L605, C607, V613, W616, F620, V625, V664, M675, I679, M683, I691, L695, L699, L729, A732 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 546 | Palmitoyl-protein thioesterase 1 | P50897 | V36, V88, V95, L99, L105, F120, A123, V124, H143, F147, C160, I163, V181, A183, Y195, F201, L202, A203, I205, Y215, L222, V228, F230, L258, L263, L269, L283 |
| 547 | Sodium/potassium-transporting ATPase subunit alpha-2 | P50993 | H42, L44, L49, A66, L102, A106, C109, V133, V138, V169, I170, V183, V184, L188, V189, A199, L201, I203, C209, V211, C241, F242, C247, A252, I255, V256, A272, I286, A297, A318, I320, F321, I325, L334, V340, A346, C354, V362, C372, L379, M384, A387, M389, W416, A418, L419, I422, A423, L425, C426, A429, V440, A453, L454, V465, L488, I490, H491, H500, V501, L502, V503, M504, I511, L519, Y539, L542, F552, C553, L557, L580, C581, F582, V583, L585, M588, A594, V596, A599, V600, C603, A606, I608, I611, M612, A621, A623, A625, I630, I631, A642, A643, A657, A659, I685, V686, F687, A688, I698, V699, C702, V709, V716, A721, L722, A725, I727, I729, A730, M731, I746, L747, F752, V759, L764, I765, Y775, L777, F790, L799, I807, A816, L819, L841, V842, L846, A850, I854, Y866, I869, L870, F875, L880, W887, C915, A918, F919, F920, A921, I923, V924, V925, V926, L931, I933, C934, L951, L955, A962, L975, M977, A988, I995, L1006, Y1020 |
| 548 | Ras-related protein Rab-7a | P51149 | L9, V11, I12, I13, L14, V19, L24, M25, Y28, V52, V57, M59, I61, A65, Y78, C83, C84, V85, L86, V87, F88, V90, L99, F106, F120, V121, V122, L123, V134, A139, C143, A156, V162, A165, F166, I169, A170, A173 |
| 549 | Ras-related protein Rab-27A | P51159 | L13, Y27, L96 |
| 550 | Transcription activator BRG1 (EC 3.6.4.—) | P51532 | M1462, I1465, V1466, V1469, I1501, F1507, I1510, I1514, L1525, V1529, C1533, A1536, L1553, F1557, V1560 |
| 551 | Galactokinase (EC 2.7.1.6) | P51570 | A16, V32, A34, L53, V64, V73, A107, V110, V113, A120, A127, V128, V130, V133, L139, A143, V147, A148, F152, L153, A167, C170, A173, V211, I222, C243, V246, L255, L263, A266, A278, H280, V281, A291, A292, A294, Y318, C322, L328, V329, A332, C351, L356 |
| 552 | Methyl-CpG-binding protein 2 | P51608 | L124, F132, L138, F142 |
| 553 | Fatty aldehyde dehydrogenase (EC 1.2.1.3) | P51648 | V8, L27, A29, L30, M33, V34, I41, I45, L49, V56, V61, V64, I68, M71, L75, V104, V105, L106, I107, F115, L117, I119, L122, I123, A125, I126, A127, A128, A131, V132, I133, I134, L150, L151, L159, Y160, L173, F182, V193, A196, A197, C214, I216, V225, C226, I229, Y234, C237, I247, L248, C249, I257, I261, I282, F288, I291, L294, I313, A314, V317, L318, V327, M328, I332, I336, L337, I339, A348, L359, A360, L361, Y362, V363, F364, M374, V388, Y410, F419 |
| 554 | C-C chemokine receptor type 5 | P51681 | Y187 |
| 555 | N-sulphoglucosamine sulphohydrolase (EC 3.10.1.1) | P51688 | A25, L26, L27, L28, L29, A30, L58, F60, A63, F64, V67, A75, L77, L81, M88, L107, L111, I120, I121, V126, V131, Y132, I152, I155, V159, F162, F171, F172, L173, Y174, V175, A176, F177, F193, C194, I207, A232, L236, Y240, V250, V253, L257, L267, I276, F278, L285, V296, A311, V313, L318, I322, L323, L348, A351, M376, V379, L386, F408, L411, L438, L464 |
| 556 | Arylsulfatase E | P51690 | M61, L163, L292 |
| 557 | Amyloid-like protein 1 | P51693 | F395, A398, V409, L413, L467, L477 |
| 558 | Potassium voltage-gated channel subfamily KQT member 1 | P51787 | W379, W392, I394, I396 |
| 559 | Chloride channel protein ClC-Ka | P51800 | V547, L558, A559, V567, Y579, V582, V594, L599, L618, L635, L641, A644, F648, V658, V668, M673, A676 |
| 560 | Ribosomal protein S6 kinase alpha-3 | P51812 | V85, A93, A98, I121, F129, V131, I146, L155, F165, V170, Y173, L174, A175, L177, A178, A180, L181, L184, L187, I189, I190, Y191, L194, I199, L201, H206, I207, L209, F212, A225, A236, H245, A249, W251, W252, F254, V256, L257, M258, M261, F268, I280, L281, L285, F290, A295, L298, L299, L302, A308, V318, I321, F327, L335, A347, C439, V450, I453, I464, I466, L467, Y470, I476, V491, V492, L501, L502, I505, L506, A516, L520, I523, V527, L530, V535, V536, H537, L540, I545, I557, I559, F562, M576, I601, L604, V606, L607, L608, Y609, M611, L612, F618, A619, I629, W645, A652, L655, V656, M659, L660, A670, V673, W678, V699, A702 |
| 561 | Cytoplasmic tyrosine-protein kinase BMX (EC 2.7.10.2) | P51813 | V442, V444, A461, L467, L472, V478, C479, V488, L497, L513, M516, C517, V520, C521, M524, L527, L537, A538, A539, C542, V544, V550, V552, V561, A580, V595, W596, F598, I600, L601, M602, V605, F606, V621, A637, M645, C648, F659, I666 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 562 | Spermine synthase | P52788 | L9, F11, L13, L26, F30, A36, L48, A49, Y51, A59, L61, I63, V69, L71, L73, I89, V93, Y134, I150, I152, I161, I163, I181, V194, L195, I196, L197, I204, L205, I208, V216, M218, V219, C229, V259, L260, Y263, V273, I274, I298, L299, M303, V305, L306, F313, V348, Y358, V360 |
| 563 | Ephrin-A5 | P52803 | V34, W36, I50, V52, L58, V60, Y77, L79, C102, F118, F130, Y138, I139, L154, V156, V158 |
| 564 | Biliverdin reductase A | P53004 | V11, V12, V13, V14, V16, F42, A62, V70, A71, Y72, I73, H80, I84, F87, L88, V94, L95, V96, M100, A107, L110, H122, L136, L150, A166, F167, I170, L173, W175, L176, M201, V203, L205, L213, W215, F231, F258, I278, C281, L282, A285, I288 |
| 565 | Collagen alpha-4 | P53420 | L1468, L1494, Y1495, L1507, Y1541, W1542, L1543, V1563, C1566, A1567, V1568, C1569, A1571, F1601, H1604, C1622, F1631, L1632, C1634, C1641, C1683, V1685, C1686, V1687 |
| 566 | Dipeptidyl peptidase 1 (EC 3.4.14.1) | P53634 | C30, L35, W39, F41, V66, L68, A74, F84, I86, I87, F92, I94, F102, A103, F105, H127, W134, C136, F137, Y259, A262, M264, M266, A269, I271, L283, V288, Y294, Y304, L305, I306, A307, A311, L316, V317, Y347, Y352, M360, L364, M370, A371, V372, F374, F380, V407, L408, L409, V410, W423, V425, F439, I441, I450, A454, A456, A457 |
| 567 | DNA polymerase subunit gamma-1 (EC 2.7.7.7) | P54098 | F139, A143, A153, L157, W175, Y178, A194, L195, V196, F197, C202, A212, V213, A214, I215, A219, W220, C224, A242, L244, A253, L265, V266, V267, A276, I278, Y282, M289, M297, H298, A300, I301, L304, V359, M393, A397, V400, V406, F407, V422, A425, M427, L428, V432, Y434, L435, V437, W441, A448, L463, A467, F610, I798, W801, A804, I808, A839, L841, A847, V870, L874, A876, V878, A880, V887, A889, V891, I898, A899, A900, L902, A908, A915, A936, A982, A1045, L1061, C1077, I1079, A1082, W1099, V1100, V1101, A1105, V1106, Y1108, H1110, L1111, L1113, V1114, A1115, M1116, L1119, C1130, Y1139, L1140, V1141, A1149, A1150, A1152, L1153, C1162, M1163, A1165, L1168, A1178, A1182, V1183, C1197, A1217, L1218 |
| 568 | Tyrosine--tRNA ligase, cytoplasmic (EC 6.1.1.1) | P54577 | I14, L27, L36, I38, Y39, F53, M56, I59, F62, C67, V69, I71, F73, H77, A78, A85, V94, Y96, Y97, V100, I101, M104, L105, Y129, L136, A171, L172, A181, F183, I191, F192, A195, L199, V208, H209, L210, M211, I232, L234, V241, L245, V260, L261, I264, V267, I277, Y289, L295, F299, V304, L309, V313, L317, L321, I324, L336, A339, A340, I370, V372, I375, I392, V394, V402, V403, L406, L415, V420, V421, V422, L423, L440, L441, C442, A443, L455, V469, L491, F495, I497, A503, F510, I517, C519, I527 |
| 569 | Ephrin type-A receptor 4 (EC 2.7.10.1) | P54764 | I67, V72, L84, I89, A94, V97, Y98, I99, I101, F103, L105, V114, F122, L124, I148, V157, V173, F181, Y182, L183, A184, F185, A190, I192, A193, L194, V195, V197, V199, C204, A212, F214, M245, C247, C273, C276, C325, V344, L346, V398, I400, Y409, F411, I413, A415, V419, V434, A440, V447, V457, L459, V476, I500, Y509, F511, V513, A515, A519 |
| 570 | Alpha-N-acetylglucosaminidase (EC 3.2.1.50) | P54802 | V32, L35, V36, L67, V75, V77, V83, A84, A85, A86, L89, Y92, C99, Y132, I154, M157, A158, I162, L164, A165, A167, I174, V178, A181, I189, A197, F198, A200, L230, M233, F236, V241, L242, F245, V253, F271, L281, I291, F295, L296, Y309, L327, V334, M338, A345, F354, A368, L378, L379, V380, V390, F397, F402, I403, W404, C405, M406, L407, L420, A430, A444, V453, V454, L457, V475, F478, A479, A490, A493, V501, L517, V518, V536, F537, A539, W540, L550, F556, L560, L561, L563, A567, V568, L571, V572, Y575, L584, L591, V597, L598, A599, L602, L603, L606, V609, L610, F616, L618, L622, A625, A635, Y638, L646, L648, W649, A659, L666, V667, Y670, Y671, W675, F678, L679, L682, V701, V709, V724, A727, Y734 |
| 571 | Galactocerebrosidase | P54803 | L83, L95, L98, F437, V576, V607 |
| 572 | Adenylate kinase 2, mitochondrial | P54819 | I16, A18, V19, L20, L21, A26, A32, L35, F39, V41, L64, V80, L82, I83, F96, L97, L98, F101, A108, L111, M115, L122, V125, I126, F128, L134, L135, I139, L143, H145, A182, L183, L187, L197, Y200, Y201, I210, A212, I223, F227 |
| 573 | Allograft inflammatory factor 1 | P55008 | L24, L47, F50, Y54, F57, L59, I65, L70, M73, L74, L86, I90, F101, Y103, F106, L107, A116, L118 |
| 574 | Transitional endoplasmic reticulum ATPase | P55072 | L26, V28, V38, V39, L41, M46, V57, L59, A67, V68, C69, V71, I82, M84, V88, L92, V94, I100, I102, C105, I114, V116, I119, Y134, L135, F139, L153, V154, V161, F163, V165, V166, C174, V176, A177, V181, C184, A214, I216, V220, I241, L242, L243, Y244, I254, A255, A257, V258, A259, I269, I274, L286, A289, F290, A293, A299, I300, I301, F302, I303, L306, I309, A310, I324, V325, L328, L329, M332, L335, V341, I342, V343, M344, A345, A346, I353, L357, F363, V367, I369, L381, V399, A400, H406, V407, L411, L414, C415, A418, A419, A422, A439, V447, F452, A455, L489, V493, V514, L515, F516, L527, A528, A530, I531, A532, F539, I540, I542, L547, L548, V559, F563, A566, C572, V573, L574, F575, F576, I582, V600, I601, M608, I619, I620, A622, L639, I645, L657, A676, L687, I690, A694, I731, H735, A739, V747, I752, L762 |
| 575 | Fibroblast growth factor 8 | P55075 | L74, V83, V85, A93, A95, A102, I126, C127, M128, I135, C145, F147, A158, M169, A170, F171, V190, F192 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 576 | Laminin subunit beta-2 | P55268 | C519 |
| 577 | Cadherin-8 | P55286 | V70, F109, I118, A120, L124, L134, A138, I154, I155, V157, V176, V189, A223, I224, I225, V242, I244, A246, L262, V264, A300, F324, L353, V355, A357, V378, I380 |
| 578 | Cadherin-15 | P55291 | L138 |
| 579 | FAD-linked sulfhydryl oxidase ALR (EC 1.8.3.2) | P55789 | A114, A115, A146, L153, F166, L170, C171 |
| 580 | Eukaryotic translation initiation factor 6 | P56537 | F7, I13, A17, Y23, C24, L25, V26, A27, F34, F38, V49, I53, I59, V64, L70, L71, V72, I84, V97, L104, V107, A115, L116, V117, L129, L133, V142, V148, V153, L160, V161, L173, L177, V179, V186, I193, A194, M197, V198, C203, A204, F205, C206, V218, F222 |
| 581 | Ubiquitin-associated and SH3 domain-containing protein A | P57075 | L28, A38, A41, L42, A53, L57 |
| 582 | Ras-related protein Rab-25 | P57735 | V15, V16, L17, I18, V23, L28, L29, V47, A60, V61, A63, I65, A69, Y74, A76, Y81, Y82, A85, A88, L89, L90, V91, F92, L94, V103, L110, V120, M121, L122, V123, V135, A140, A144, A156, L157, V162, A165, F166, V169, L170, I173 |
| 583 | Anthrax toxin receptor 2 | P58335 | F43, L45, Y46, F47, V48, L49, V55, I62, V66, L69, A70, L80, F82, I83, V84, F85, I91, I102, L109, I120, L124, A127, I131, I142, I143, I144, A145, L146, A159, A163, V173, Y174, C175, V176, V178, L186, I189, L206, I209, I213 |
| 584 | Spike glycoprotein/SARS-CoV (Severe acute respiratory syndrome coronavirus) | P59594 | V328, V337, I345, A350, L374, V382, A384, F387, V388, V389, I397, A398, I405, A406, Y410, L412, C419, V420, L421, A422, F483, V496, V497, V498, L499, V510 |
| 585 | CD81 antigen | P60033 | Y127, L131, A134, V147, H151, C156, V169, L174, C190, I194 |
| 586 | Phosphatidylinositol 3,4,5-trisphosphate 3-phosphatase and dual-specificity protein phosphatase PTEN (EC 3.1.3.16) | P60484 | L25, I33, A34, M35, A39, I50, V53, F56, L57, I67, Y68, L70, I101, F104, C105, L108, A120, A121, I122, H123, A126, V133, M134, I135, C136, A137, L139, A148, A151, Y155, Y174, V175, Y180, L193, F195, M198, F200, F206, V217, F241, V249, V255, F257, H259, M270, F271, F273, V275, F279, V317, L325, A328, F341, V343 |
| 587 | Interleukin-2 | P60568 | L34, L37, L38, L41, I44, L45, I48, M59, F62, F64, M66, L73, H75, L76, C78, L79, L83, L86, V89, L90, F98, L105, I106, I109, I112, V113, F123, I134, V135, F137, L138, W141, F144, C145, I148 |
| 588 | Proteasome subunit alpha type-6 (EC 3.4.25.1) | P60900 | A31, V40, A41, V42, C47, A48, V49, I50, V51, C78, V79, V91, A94, Y96, A99, L114, C115, I118, A119, C136, M138, I139, L140, I141, V151, C154, A165, A167, A168, V195, A198, I199, C201, L202, V217, V219, V220 |
| 589 | Cell division control protein 42 homolog | P60953 | I4, C6, V7, V8, V9, A13, V14, C18, L19, L20, F28, V36, F37, V42, V44, I46, Y51, L53, L55, A59, L70, Y72, V77, F78, L79, V80, C81, F82, V84, V85, F90, V93, W97, V98, I101, C105, F110, L111, L112, V113, I117, L129, I137, A142, L145, A146, L149, V155, C157, A159, L165, V168, F169, A172, I173, A175, A176 |
| 590 | Pterin-4-alpha-carbinolamine dehydratase | P61457 | L17, W25, A33, I34, F40, A46, F49, V53, A57, V73, I75, L77, L85, L92, A93, I96, V99 |
| 591 | Lysozyme C (EC 3.2.1.17) | P61626 | C24, L26, A27, L30, M35, L43, A44, W46, M47, C48, L49, A50, I74, F75, I77, C83, C95, C99, L102, I107, A108, A110, V111, C113, A114, V117, V118, I124, W127, C134, V139, C146 |
| 592 | Beta-2-microglobulin [Cleaved into: Beta-2-microglobulin form pI 5.3] | P61769 | V29, Y30, L43, C45, V47, F50, H51, L59, L60, F82, L84, Y86, F90, Y98, A99, C100, V102, H104, W115 |
| 593 | Transforming growth factor beta-2 | P61812 | C317, C318, L319, F326, C350, L388, I390, C413 |
| 594 | Epididymal secretory protein E1 | P61916 | V37, C42, C47, Y55, V59, F61, I101, Y109, L124, W128, L130, L138, F139, C140, W141 |
| 595 | Ras-related protein R-Ras2 | P62070 | Y15, L17, V18, V19, V20, V25, L30, F34, V40, C55, I57, A62, L64, I66, L67, A70, M78, M83, F89, L90, L91, V92, F93, V95, F101, I104, F107, I111, V114, F120, M122, I123, L124, I125, L131, V137, L145, A146, A156, A158, V164, A167, F168, L171, V172 |
| 596 | 40S ribosomal protein S7 | P62081 | L27, L30, L36, L40, L43, I51, A59, I61, V64, F72, L79, V93, I95, L130, L133, V134, V156, F173, V176, Y177, V185 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 597 | Actin, aortic smooth muscle | P62736 | A9, L10, V11, C12, C19, A21, A31, V32, F33, I36, V37, Y55, A60, L67, I73, M84, I87, W88, F92, L106, L107, A110, L112, M121, I124, M125, F126, F129, V131, A133, M134, V136, A140, V141, L142, L144, I153, V154, L155, V161, H163, V165, I167, L173, A176, M178, L180, L182, A183, L187, L191, I194, L195, A206, I210, V211, I214, C219, V221, A222, I250, I252, F257, C259, L263, F264, I276, I284, C287, I289, I291, L295, Y296, A297, V300, L301, Y308, I311, M315, I319, W342, I347, F354, W358, I359, I371, V372, C376 |
| 598 | 40S ribosomal protein S26 | P62854 | A78 |
| 599 | 60S ribosomal protein L11 | P62913 | L22, A36, L40, V70, V74, I82, L87, F105 |
| 600 | Guanine nucleotide-binding protein G | P63092 | L43, L44, L45, L46, I56, M60, I95, L99, A102, I103, I106, L113, I131, F146, A150, L153, V159, C162, C174, A175, F178, I182, I185, F219, M221, V224, A243, I244, F246, V247, V248, Y253, F273, L282, V287, I288, L289, L291, L296, L297, V301, A337, I341, F345, A351, I372, C379, I383, H387 |
| 601 | Inward rectifier potassium channel 2 | P63252 | V161, L245, I250, I267, L298, A362, F374 |
| 602 | Casein kinase II subunit beta | P67870 | F21, C23, V25, I30, L36, L39, A49, I53, A75, A76, L79, Y80, I83, H84, Y87, I88, I94, M97, F106, C114, M119, L120, V133, C137, F159, F163, L167 |
| 603 | Actin, alpha cardiac muscle 1 | P68032 | A9, L10, V11, C12, V19, A21, A31, V32, F33, I36, V37, Y55, A60, L67, I73, M84, I87, W88, F92, L106, L107, A110, L112, M121, I124, M125, F126, F129, V131, A133, M134, V136, A140, V141, L142, L144, I153, V154, L155, V161, H163, V165, I167, L173, A176, M178, L180, L182, A183, L187, L191, I194, L195, A206, I210, V211, I214, C219, V221, A222, I250, I252, F257, C259, L263, F264, I276, I284, C287, I289, I291, L295, Y296, A297, V300, L301, Y308, I311, M315, I319, W342, I347, F354, W358, I359, I371, V372, C376 |
| 604 | Ubiquitin-conjugating enzyme E2 L3 (EC 2.3.2.23) | P68036 | A3, L7, I14, F22, W35, I39, Y46, A50, F51, I53, I55, F70, H76, I79, V104, I105, L108, L111, V112, L125, F136, A140 |
| 605 | Actin, alpha skeletal muscle | P68133 | A9, L10, V11, C12, V19, A21, A31, V32, F33, I36, V37, Y55, A60, L67, I73, M84, I87, W88, F92, L106, L107, A110, L112, M121, I124, M125, F126, F129, V131, A133, M134, V136, A140, V141, L142, L144, I153, V154, L155, V161, H163, V165, I167, L173, A176, M178, L180, L182, A183, L187, L191, I194, L195, A206, I210, V211, I214, C219, V221, A222, I250, I252, F257, C259, L263, F264, I276, I284, C287, I289, I291, L295, Y296, A297, V300, M301, Y308, I311, M315, I319, W342, I347, F354, W358, I359, I371, V372, C376 |
| 606 | Hemoglobin subunit beta | P68871 | L4, V12, L15, V24, A28, L29, L32, L33, L49, V55, V61, L69, F72, L79, L82, F86, C94, L111, V114, L115, F119, V127, A130, Y131, V134, V135, A139, A141, A143 |
| 607 | Hemoglobin subunit alpha | P69905 | V11, A13, A14, W15, V18, A22, Y25, A27, A29, L30, M33, F34, V56, A64, A66, A70, V71, V74, M77, L81, A89, C105, L106, V108, L110, L114, A124, L126, F129, L130, V136 |
| 608 | Tyrosine-protein phosphatase non-receptor type substrate 1 | P78324 | A51, L53, C55, I66, W68, I106, I111, C121, V122, F168, C170, F175, W184, A213, V215, L217, V226, C228, V230, L246, I250, V271, C273, V275, F278, L285, W287, C331, V333 |
| 609 | Retinal-specific ATP-binding cassette transporter | P78363 | F1968, L1970, L1971, F1982 |
| 610 | Oxidized low-density lipoprotein receptor 1 | P78380 | C155, C172, L179, L180, I182, I191, I195, F202, W203, M204, L206, C243, A244, I246, V251, A260, I263 |
| 611 | Protein jagged-1 | P78504 | F35, L37, C71, F75, L79, Y132, L134, V136, A138, I161, A177, F179, I183, V185, C196, C200, C229, C262, C265, C293, C324, C333, C522, C560, C664 |
| 612 | Reelin (EC 3.4.21.—) | P78509 | C674, C700, C1772, C1794, C2485, C2507 |
| 613 | ETS-related transcription factor Elf-3 | P78545 | V72, W75, I76, C95, L102, L110, F114, L121, I279, F303, F305, V311, A312, L329, M333, L342, F354 |
| 614 | C-C motif chemokine 7 | P80098 | C34, C35, C59, A63, V64, I65, F66, I74, A76, V83, F86 |
| 615 | Protein crumbs homolog 1 | P82279 | C107, C221, C336, C1332 |
| 616 | Mothers against decapentaplegic homolog 3 | P84022 | V12, L15, A34, V35, L38, V39, L42, A54, I55, I65, I67, V77, Y88, C89, C109, A112, V120, C121, V122, H126, Y127, V130, C233, I235, Y237, V244, A250, M255, V257, L271, V283, I290, V294, L296, V303, A305, C307, I313, V315, C320, I334, I342, F343, F348, V363, C370, I372, M374, F376, W380, C394, I396, L398, L400, L407 |
| 617 | Disabled homolog 2 | P98082 | I124, A155, V168 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 618 | Basement membrane-specific heparan sulfate proteoglycan core protein | P98160 | A4204, F4206, F4214, F4219, I4230, L4232, V4234, L4242, L4243, L4244, F4259, I4260, L4262, L4264, L4269, V4270, Y4273, L4275, A4280, V4296, A4298, I4307, V4332, I4334, C4355, V4356, L4359, L4376 |
| 619 | Polycystin-1 | P98161 | A290, I294, W305, F307, H323, Y325, V333, A335, L337, V352 |
| 620 | Nuclear factor NF-kappa-B p100 subunit | Q00653 | L65, V80, A89, I91, V93, V96, H105, A106, H107, I119, C120, A131, L136, M150, L174, A178, V190, L192, F194, A196, I217, L228, V246, L248, L249, V260, F262, I287, V288, F289, V305, L307, L309, F323, Y325, Y326, H493, I496, I504, I511, V520, L531, H532, A534, V543, L546, A551, A563, M564, H565, A567, L578, H605, A607, V608, L619, A637, H639, A641, V650, L653, A675, L687, V742, L778, L782, L794, A795, L817, L818, L831, A834, L835 |
| 621 | Beta-1,4 N-acetylgalactosaminyltransferase 1 (EC 2.4.1.92) | Q00973 | I281, I299, V308, V309, I310, A311, V325, M330, L342, A343, V347, Y351, F361, V382, F426, C429, V449 |
| 622 | Ankyrin-2 | Q01484 | F35, A39, V47, L65, A67, H69, L70, A71, A72, V80, L83, A100, L101, H102, A104, V112, V113, L116, L134, Y135, A137, A138, V145, V146, L149, A168, V169, A170, A178, L182, H197, A199, A200, A208, L212, V226, L237, H238, A240, A241, V248, A249, L252, L270, H271, V272, A273, M281, V282, L285, L303, H304, C305, A306, A307, V314, V315, L318, L336, H337, M338, A339, A340, C347, V348, L351, V371, A372, V380, L384, L468, H469, A471, A472, V480, L501, H502, I503, A504, V513, L516, L534, H535, I536, A538, V545, A546, L549, L567, H568, V569, A570, A571, A579, L582, V602, A603, V611, L615, M839, V970, V974, I991, I993, V1004, C1006, V1009, A1027, I1031, V1033, V1077, V1079, I1081, A1085, F1147, F1151, A1152, V1153, V1154, I1164, V1179, A1181, A1187, V1194, L1196, V1220, L1222, I1233, M1235, I1237, L1260, L1261, V1289, A1297, W1300, L1301, I1302, C1304, A1314, V1317, A1328, F1330, V1332, A1334, A1342, L1344, C1346, F1347, C1348, L1389, F1403, L1413, V1415, L1428, F1430, L1503, L3573, I3576, A3577, L3587, A3588, I3601, L3616, L3617, W3620, A3628, L3633, L3637, I3645, M3649 |
| 623 | Collagen alpha-3 | Q01955 | F1448, L1474, F1475, L1487, Y1521, W1522, L1523, I1545, C1548, V1550, C1551, F1583, F1586, C1604, F1613, L1614, C1616, C1622, C1662, V1664, C1665, M1666 |
| 624 | Inositol polyphosphate 5-phosphatase OCRL-1 (EC 3.1.3.36) | Q01968 | C28, L30, L32, A33, L41, I42, I43, I56, I58, F62, C64, C82, I84, V86, F96, I98, C104, F107, L108, V111, A114, F242, F243, V244, W247, V249, L258, W261, L262, I271, Y272, C273, I274, F276, L279, A285, W297, V301, M322, M323, L324, L325, I326, F327, A328, V358, A359, V360, F362, F364, F369, C370, I371, V372, L376, I393, F399, I411, V417, W419, L420, L423, Y425, V435, L447, L453, Y479, A496, W497, C498, I501, L502, L519, V527, A529, F531, I533, V535, F572, F574, V577, I589, F599, W614, A617, L624, I632, L634, V636, V638, V643, L657, L659, L661, L669, C679, F680, L684, L687, C688, I738, L741, V742, L745, A749, L755, L765, I768, L772, V787, A788, A790, L791, F794, L795, V802, I803, C811, L812, V824, I825, L828, V835, F836, L839, F842, L843, L846, V855, I860, A861, F864, L868, F890, L891 |
| 625 | Tumor necrosis factor receptor superfamily member 17 | Q02223 | C24, C37, C41 |
| 626 | Pro-neuregulin-1, membrane-bound isoform | Q02297 | C196, C221 |
| 627 | Collagen alpha-1 | Q02388 | C2876, C2925 |
| 628 | Desmoglein-1 | Q02413 | C58, I70, A71, I73, V83, Y85, F100, I109, I111, V115, F123, I125, C127, A129, L143, V145, V147, L179, I218, L225, L235, V237, C255, I257, I259, I290, A305, L331, V333, L337, L347, I349, V351, I372, V374, V376, V394, A409, Y423, L433, L442, Y460, I464, I479, I481 |
| 629 | Desmocollin-2 | Q02487 | L185, L195, V201, F209, I211, I231, I233, I252, I304, L311, Y319, L321, I323, V325, C341, I343, V376, F404, L417, V419, L433, I435, V437, V458, V460, A495, I506, W517, L533, Y545, I547, A551, L563, I565, I584, C585, A633, L635, V648, I650, V652, L664, V666 |
| 630 | Aminoacylase-1 | Q03154 | Y19, L20, A34, F38, A42, V52, V60, V62, L63, H80, V83, A98, M114, L122, M141, F158 |
| 631 | Trefoil factor 2 | Q03403 | C31, C52, C58, C69, F70, L73, C81, C101, C118, F119 |
| 632 | Mevalonate kinase | Q03426 | V8, A10, V14, H20, A21, V27, L29, V31, L33, L39, L41, V49, L51, L91, V109, A111, F112, L113, L115, Y116, L117, I119, C120, L129, L143, A147, A148, V151, C152, L153, A154, A155, A156, L157, L158, I185, A189, A206, V207, A213, L214, L233, L234, V250, I268, C275, M282, L305, V310, L315, L318, L331, C339, V353, L360, A374, V377, I379 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 633 | Complement factor H-related protein 1 | Q03591 | Y53, I70, C87, V110, I127, C129, I249, C251, C266, A296, C317 |
| 634 | 1,4-alpha-glucan-branching enzyme (EC 2.4.1.18) | Q04446 | L31, L38, F45, I59, F69, C88, A92, A95, V98, L100, V136, L142, V144, V145, I146, I157, A161, V164, L197, I199, Y200, H203, V204, I206, Y216, F219, V223, L224, I227, L230, Y232, C234, I235, L237, M238, I240, M241, H243, F249, I253, F256, F257, A258, A259, L269, L272, V273, A276, I281, V283, L284, L285, V287, V288, H289, A292, L300, F303, Y310, F311, H319, I334, L335, F337, L338, L339, I342, W345, L346, Y349, F351, F354, F356, V359, M362, L363, Y364, A389, L390, Y392, L393, M394, L395, A396, L399, V400, I410, A411, M417, A419, L420, I439, W443, L446, W455, M457, I460, L464, I474, A475, Y476, A477, H480, L490, A491, M503, I513, I517, L519, H520, M522, I523, L525, I526, H528, L530, Y535, L536, F538, M539, F543, L549, F551, A563, L580, F583, M587, L590, W596, L597, I613, I614, A615, F616, L621, L622, F623, I624, F625, V638, F646, L650, A654, L683, V685, I687, V691, A692, L693, I694, L695, V698 |
| 635 | Glutamate carboxypeptidase 2 (EC 3.4.17.21) | Q04609 | F61, I70, L74, F77, L83, A84, A93, V108, L110, Y113, V115, L117, I128, I130, V158, F161, A163, F164, L174, V175, Y176, V177, A180, L188, C196, I200, V201, I202, A203, V214, A217, V225, I226, L227, Y228, Y234, A236, V253, I258, L259, A264, L268, A274, V287, V294, I297, A302, L305, L306, M309, A313, W319, V329, V342, M344, I346, I355, V358, L362, V372, I373, L374, H377, V382, F383, I386, A393, V394, H396, I398, V399, F402, L405, I416, L417, F418, A419, W421, A423, F426, L428, L429, A435, L442, V447, A448, Y449, I450, A452, I456, Y460, L462, V464, C466, L469, M470, V474, L477, W93, W497, L515, F521, V523, F524, F525, I530, A531, A535, Y537, Y549, L551, H553, V555, L561, V562, F565, F570, H573, V576, A577, V579, M583, V584, L587, A588, C597, Y600, A601, V603, L604, Y607, A608, I611, V627, L632, V636, F639, A643, F646, L661, M664, L668, M669, L671, F675, L679, F686, Y687, H689, I691, Y692, A693, F705, I708, L712, V728, I732, Y733, A735, A736, V739, A742, A743, L746 |
| 636 | Copper-transporting ATPase 1 (EC 3.6.3.54) | Q04656 | V10, I12, V14, M17, C22, V23, I26, I30, A48, I50, Y52, L62, I66, L173, M175, V177, I189, I193, A211, I213, Y215, V222, M225, I229, F234, F281, I283, V292, I295, L299, A317, V319, L331, I335, I381, I383, M386, C391, V392, I395, I399, V419, Y421, L431, I435, C490, I492, V503, I506, L510, I516, L520, A528, V530, Y532, I542, I546, L566, L568, V570, I582, L586, C595, A604, I606, Y608, I618, I619, I622, A629, V837 |
| 637 | Neurogenic locus notch homolog protein 2 | Q04721 | C315, C491, C642, C1184, C1443, C1455, C1484, L1490, C1509, C1522, W1529, L1547, I1549, V1551, L1558, F1565, L1573, V1623, L1625, I1627, C1632, F1640, A1646, A1647, L1649, L1650, A1651 |
| 638 | Activin receptor type-1 (EC 2.7.11.30) | Q04771 | V402, L411, V424, V447, L470, L473, W478, L489, L495, I498 |
| 639 | Acetylcholine receptor subunit epsilon | Q04844 | V49, I51, L53, V55, I61, V74, I76, I78, W80, V105, W106, V111, L112, A123, V128, V130, V136, W138, A142, C148, V150, W159, F166, V176, F178, V230 |
| 640 | Focal adhesion kinase 1 | Q05397 | V39, H58, V64, I67, I68, V72, C82, L87, L124, Y128, F137, F146, F147, Y148, A160, A168, L171, C173, L174, L188, Y194, L203, F207, A217, F228, L241, F243, F244, L247, F258, L272, A273, I274, I280, A294, I302, L316, L318, A323, V329, A331, A337, M340, A341, L343, I344, C348, A369, I373, V436, V451, A452, I453, C459, F468, A472, M475, I483, V489, I490, V495, I497, I498, M499, C502, L507, L511, I524, Y526, A527, L530, A533, L534, L537, I547, A548, A549, V552, L553, V554, V560, L562, F565, L567, A579, M589, A590, V605, M607, F608, C611, M612, I615, V631, I635, L651, L654, M655, C658, W659, F669, L672, L676, V928, L931, V932, M938, I942, Y950, V957, L961, L964, V968, I983, L990, L997, A1004, M1020, A1024, L1027, A1028, A1031, L1034, I1038, A1041 |
| 641 | External core antigen/genotype F2 (isolate Brazil/w4B) (HBV-F) | Q05495 | Y35, F38, L44, L45, F53, A63, H81, L84, A87, A98, V118, L129, L130, F132, H133, V144, L148 |
| 642 | Glutamate receptor ionotropic, NMDA 1 | Q05586 | A71, V107, Y109, A111, Y158, I163, A236, L269, A279, A284, I301, V309, I314, I400, V401, F408, V409, C436, C454, C455, F458, C459, I460, L462, L463, L466, V479, M501, M502, L505, A510, M512, I513, V514, A515, L517, L538, I540, L541, V542, L672, Y681, A682, V689, F693, M702, Y703, M706, A717, V721, L726, A728, F729, I730, W731, V735, L736, F738, L746, F758, I760, M762, V772, I776 |
| 643 | Tyrosine-protein phosphatase non-receptor type 11 (EC 3.1.3.48) | Q06124 | W6, F7, H8, A16, L19, L20, F29, L30, A31, L43, V45, I54, I56, Y63, L65, F71, A72, L74, A75, L77, V78, Y81, L88, I96, L98, L102, A122, L125, L126, F135, L136, V137, F147, V148, L149, V151, I172, L190, L193, V194, V209, L210, L212, L216, I221, A223, I226, V230, L233, F247, L254, I282, L283, F285, V290, Y304, A307, I309, I310, Y327, I328, A329, C333, V338, F341, W342, M344, V345, V352, I353, V354, M355, C367, Y370, W371, Y380, M383, V385, L401, L403, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | V419, Y422, H423, F424, W427, V439, F442, L443, V446, I453, V459, V460, V461, H462, C463, A465, I467, G468, F473, I474, V475, I476, I478, L479, I480, I482, I483, V488, I492, V494, I498, V501, M508, V509, Y515, F517, I518, Y519, A521, V522, I526 |
| 644 | Tyrosine-protein kinase BTK (EC 2.7.10.2) | Q06187 | L31, V427, I429, I432, F442, A446, M449, M450, L452, L457, V458, V463, C464, I470, I472, I473, L482, L486, L498, M501, C502, V505, C506, A508, M509, L512, H519, L522, A523, A524, C527, V529, V535, V537, F540, L542, V568, I580, W581, F583, V585, L586, M587, W588, I590, Y591, Y598, I610, L616, A622, V626, M630, C633, W634, F644, L647, I651 |
| 645 | Acetylcholine receptor subunit delta | Q07001 | V52, V54, L56, L58, I79, W83, V108, W109, L115, V131, V133, V139, W141, A145, C151, I153, W162, F169, I179, L181, I253, V330 |
| 646 | Early activation antigen CD69 | Q07108 | Y97, A109, C113, L120, A121, I123, L132, W142, V143, L145, C173, V174, L176, I193, C194 |
| 647 | Neuraminidase (EC 3.2.1.18)/strain A/Duck/Ukraine/1/1963 H3N8 | Q07599 | M83, A92, F95, I104, I112, V114, I115, F119, V120, F130, F131, L132, L156, V159, A174, A176, W177, A179, A181, C182, M189, V191, V193, A200, V201, A202, I204, V214, L222, C231, I232, C236, Y237, W238, V239, M240, A249, Y251, I253, A256, I261, H273, I274, C277, C279, Y280, V286, C288, V289, C290, L302, I304, L315, C316, A317, I319, V346, F349, F351, V357, W358, M359, I363, F371, I373, L374, I376, V393, V394, L397, F406, L418, C421, F422, W423, V424, M426, W437, I443, V444, M445 |
| 648 | Prolow-density lipoprotein receptor-related protein 1 | Q07954 | F859, C861, C879, C895, F900, C902, I908, C914, C920, C936, C943, C955, C961, F982, C984, C1002, F1020, C1022, C1040, F1067, C1069, C1088, F1110, C1112, C1131, C1152, V1158, L1160, C1172, C2679, C2696, C2715, F2739, C2741, C2759, C2781, V2786, V2788, L2793, C2794, C2800, A2804, C2812, C2818, C2837, F2863, C2865, C2884, C2912, C2930, F3379, C3381, C3399, C3453, F3458, C3460, I3467, C3473, C3479, C3494, F3499, C3501, I3508, C3514, C3520, C3536, C3543, V3549, C3555, C3561, C3575, F3580, C3582, I3588, C3594, C3600, C3613, C3620, C3632, F3659, C3661, C3679, C3703, C3749, C3767 |
| 649 | Hemagglutinin [Cleaved into: Hemagglutinin HA1 chain; Hemagglutinin HA2 chain]/strain A/China: Nanchang/11/1996 H1N1 | Q07FI5 | V7, I20, C21, I22, A26, V33, V36, V43, L49, L50, L58, C59, L61, L67, L69, C72, V74, A75, W77, I78, L79, C84, L87, W93, Y95, I96, V97, Y108, L118, L122, V125, F128, F134, A150, C152, H154, L164, L165, W166, L167, L173, L177, V189, L190, V191, L192, W193, V195, H196, H197, Y208, Y214, V215, V217, V218, I243, Y245, Y246, L249, L250, I256, F258, A260, L264, I265, A266, Y269, A270, F271, A272, L273, F277, I281, I282, C291, C295, A301, I302, H312, I316, V323, L328, M330, V331, A348, M360, Y365, A387, I388, A439, L451, V458, L461, V465, L469, C480, H485, C487, C491, M492 |
| 650 | Hepatocyte growth factor | Q08048 | F43, C71, A72, C75, C85, A87, F88, V89, C97, W99, L119, W153, C178, C190, F191, C207, C233, W236, C261, C272, C284 |
| 651 | Interleukin-10 receptor subunit beta | Q08334 | L38, A54, L57, C74, F76, L87, V89, A91, V108, L127, M145, V156, V189, V191, L195, V208 |
| 652 | Epithelial discoidin domain-containing receptor 1 | Q08345 | M37, A72, W73, L87, V89, V97, V100, I141, M159, A161, V164, F166, L178, V180, L182, L191, Y194, A196, V208, L210, L231, F241, Y255, V256, W258, V268, M270, F274, F280, M283, V285, C287, A295, V301, C303, F305, V336, L338, A343, L346, C348, F350, L357, L358, F359 |
| 653 | Tyrosine-protein kinase ITK/TSK (EC 2.7.10.2) | Q08881 | I358, V388, I390, I393, A397, F403, A407, L418, V419, V424, C432, V434, L443, L447, L459, M462, C463, V466, C467, M470, L473, H480, L483, A484, A485, C488, V490, I496, V498, F501, V522, V541, W542, F544, V546, L547, M548, W549, V551, V567, I571, A583, I590, M591, C594, W595, F605, L608, L612 |
| 654 | ATP-binding cassette sub-family C member 8 | Q09428 | I701, I703, L708, M710, I711, V712, C717, L722, L723 |
| 655 | Potassium voltage-gated channel subfamily A member 1 | Q09470 | A347 |
| 656 | Neuraminidase (EC 3.2.1.18)/strain A/Chicken/Victoria/1/1985 H7N7 | Q0A2R1 | L86, V93, A104, I105, I113, V115, Y120, V121, C123, M130, Y131, A132, L133, L157, I158, C175, V176, C183, M190, I192, C193, V194, A201, A203, V205, Y207, A219, L223, C230, V231, C232, A238, V239, V240, M241, V254, M255, Y256, F257, I275, C278, C280, Y281, I287, C289, V290, C291, A298, I302, I303, I305, Y316, V317, C318, V321, L322, V349, F352, F354, W361, L362, F374, M376, L377, I379, A382, I396, V397, F409, I410, Y420, F424, Y425, V426, L428, V439, L446, I447, A448, L449, A465, I467 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 657 | Hemagglutinin [Cleaved into: Hemagglutinin HA1 chain; Hemagglutinin HA2 chain]/strain A/Duck/Germany/1949 H10N7 | Q0A448 | A26, V50, L58, C59, M60, Y65, L68, C71, V74, M76, I78, C83, W91, L94, I95, I101, C104, L115, I119, I125, M128, I138, C147, Y156, L159, L162, Y178, H186, L187, I188, I189, W190, I192, H193, Y205, I212, V214, I240, F242, V247, I253, F255, H257, L261, I262, A263, V267, L270, I277, C287, C291, F292, A345, Y362, A384, L458, L466, H482, C484, C488, A506 |
| 658 | Endogenous retrovirus group K member 13-1 Env polyprotein | Q0ED31 | A54, H65, A69, M94, M99, V100, M103, L110, W111, L115, V119, V154, I165, Y193, C220, V226, I227, L228, C230, C241, V244, I253, L261, I272, I286, I287, V288, H289, L290, V294, I296, C298, I327, A330, C332, I334, W339, L343, V346, L350, I359, I360, F361, H374, C378, F382, F383, Y384, C385, L390, F391, L410, C412, I414, I417, I418, A427, M428, I437, I443, I446, L447, L448, F462, W473, L477, Y480, V483, I485, V499, I542, L549, A552, I553, A555, L559, L560, V564, I567, L570, V574 |
| 659 | Carcinoembryonic antigen-related cell adhesion molecule 8 | Q0Z7S6 | L36, A45, V51, L52, L53, V55, Y65, W67, I79, I80, A105, L107, M109, V112, Y120, L122, V124, F138 |
| 660 | Spike glycoprotein/isolate N5 (HCoV-HKU1) | Q0ZME7 | F67, F103, V106, V125, I137, V138, A150, C151, C156, V162, L198, H201, F209, A211, Y212, A214, F222, Y236, V237, M238, C242, Y256, Y266, L267, L268, A279, C282, L333, C352, F383, V388, F391, A392, L409, C423, Y427, Y458, A477, I588, F589, L624, F633, A680, C719, C743, V765, I943, A1025, A1070, A1084, L1085, L1098, A1103, A1106, F1143, I1144 |
| 661 | NS3 protease | Q0ZNA6 | C16, V33, V35, V36, L44, A45, C47, V48, V51, C52, W53, V55, A59, L64, I71, L82, V83, W85, L94, L104, L106, V107, V113, I114, V116, V132, L135, L143, L144, C145, A150, V151, I153, F154, A164, A166, V167, F169, V170, V172, M175 |
| 662 | Calcium-activated potassium channel subunit alpha-1 | Q12791 | F815, L907, M922, C923, C943, A946, F955, L1026, A1037, I1060, A1104 |
| 663 | Potassium voltage-gated channel subfamily H member 2 | Q12809 | I30, A32, C44, F48, C49, L51, C52, A57, V59, C64, C66, A78, I82, A83, I96, A97, F98, C105, V110, V112, L127, A763, A778, I782, I787, I804, F805, V822, A824, L830, V841 |
| 664 | Glutamate receptor ionotropic, NMDA 2A | Q12879 | M112, I116, A136, M162, F170, F177, V187, V191, V203, V217, L248, L260, V292, L307, I408, V409, F416, V417, V419, C436, V440, C455, C456, F459, C460, I461, I463, L464, L467, L479, W493, M496, I497, V500, A505, V506, M507, A508, V509, L512, V522, V529, V535, M536, V537, V662, L665, F670, F682, I694, M701, M705, A716, A727, F728, I729, A732, A733, V734, L735, Y761, I763, A764, L765, I775, A778, L779, F782, M788, L791, V807 |
| 665 | Unconventional myosin-Ie | Q12965 | A1058, F1072, I1078, F1100 |
| 666 | Glutamate receptor ionotropic, kainate 2 | Q13002 | L36, F38, I41, A56, F57, A60, V61, I64, L71, I83, A91, A95, L99, V103, A104, A105, I106, F107, A115, V118, C122, V127, H129, I130, V147, L149, F153, L156, A159, I160, L163, V164, V172, V174, V175, L185, L188, A191, L197, L204, A211, L215, M218, V226, I227, F228, A235, A236, I238, L239, A242, M247, Y254, I255, F256, L259, L261, L264, M276, F279, L282, W296, M316, A320, A321, L322, M323, A326, V327, V329, V330, A333, M340, L345, W353, F359, I363, A366, I375, F387, L389, V391, I392, W405, L433, I434, V435, Y443, V444, F446, L453, F459, Y462, C463, I464, L466, L467, L470, I480, A490, M501, V502, L505, A510, L512, A513, V514, A515, L517, A518, I527, F533, L536, I538, I540, L541, Y542, L674, A675, I680, Y682, A684, M691, F694, M705, M709, V716, V718, V728, Y733, A734, F735, L736, M737, I742, L752, Y764, V766, I778, A781, I782, L785, L791, M794, W799 |
| 667 | T-lymphoma invasion and metastasis-inducing protein 1 | Q13009 | M40, A441, L446, V454, V467, L469, L474, F476, V497, I501, V502, V514, F515, C516, L517, A524, F527, L535, W538, I542, H543, A545, C546, A547, A551, L563, M616, C623, Y624, L639, M651, F662, A664, V666, A667, A668, I848, Y858, L873, A884, I895, I898, A903, L906, L920, V924 |
| 668 | Secretory phospholipase A2 receptor | Q13018 | F182, C204, C219 |
| 669 | Platelet-activating factor acetylhydrolase | Q13093 | I56, C67, M71, F80, L81, Y84, Y85, W97, I98, Y103, L111, L116, M117, L124, F125, A132, Y144, L146, V147, V148, H151, F156, I165, A168, F172, I173, A175, H179, A184, A186, Y189, V222, A226, C229, A232, L233, I239, I267, A268, V269, I270, A277, V279, I280, L283, F289, C291, I293, A294, A297, M299, V306, I310, L314, F315, F316, I317, I328, M331, C334, I344, F354, F357, A380, A387, L389, A390, F391, L392, F402, I422 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 670 | S-methyl-5'-thioadenosine phosphorylase (EC 2.4.2.28) | Q13126 | I12, I14, I15, L26, L45, C55, V56, L57, L58, A76, I78, A80, L81, H88, V89, I90, V91, C95, L98, I107, V108, I109, I110, A132, L152, A156, M169, V170, F186, A191, V193, V199, V202, L204, A205, I210, C211, Y212, A213, I215, A216, M217, A218, L250, I255, I258 |
| 671 | Glutamate receptor ionotropic, NMDA 2B | Q13224 | I35, I37, A38, V39, I40, V65, I81, I85, V97, V98, F99, A100, I108, A109, I111, L112, I115, A117, I123, L124, I126, A135, F146, A154, V156, M157, I160, M161, F169, I171, V172, F176, F182, I186, I190, V202, L205, I216, L220, L223, I228, L229, L230, Y231, C232, A237, I240, F241, A244, L249, W256, I257, V258, L261, V262, A263, L277, I278, V280, V293, I299, I300, A303, A304, M307, L308, I329, L335, L339, V342, V363, I364, I365, L367, V376, I408, V409, F416, V417, V419, C436, I440, C456, C457, F460, C461, I462, I464, L465, I468, L480, W494, M497, I498, V501, A506, Y507, M508, A509, V510, L513, V523, I530, V536, M537, V538, V663, L666, F671, F683, I695, M702, M706, A717, A728, F729, I730, A733, A734, V735, L736, Y762, I764, A765, I766, V776, A779, I780, L783, M789, L792, V808 |
| 672 | Chitotriosidase-1 (EC 3.2.1.14) | Q13231 | L24, V25, C26, Y27, F28, A32, A39, F41, L46, L50, C51, L54, I55, Y56, A57, F58, A59, M61, Y77, F80, L90, L93, L94, A95, I96, F101, F106, M109, V110, F119, V120, A123, L127, F132, L135, L137, W139, F155, L158, V159, L162, F166, L178, L179, L180, A182, A183, V184, A186, V191, V197, I200, A201, L204, F206, V207, L209, A211, H224, L228, V243, A246, V247, W250, L260, I261, L262, M264, F271, V281, A283, A302, Y304, V306, V322, Y324, I325, W331, V332, F334, F340, V344, L347, A355, M356, V357, A359, L360, F365, Y375, L377, I378, L381, C420 |
| 673 | Noggin | Q13253 | L66, V173, C184, V202, L203 |
| 674 | Butyrophilin subfamily 1 member A1 | Q13410 | A40, A46, L48, C50, A58, L63, W65, A73, V74, Y91, L109, I111, V114, Y122, C124, F126, L136, V137, L139, I208, V364, V379, F452, F460 |
| 675 | Mesothelin | Q13421 | I311, L315, I316, L323, C326, V327, L332 |
| 676 | Alpha-1-syntrophin | Q13424 | L13, V31, L33, L40, V42, V88, V90, I112, I114, A122, A123, L129, A134, I135, V138, L143, A151, V162, V163, L164, V166, M215, L236, I238, A241, L247, L249, A251, A257, I264 |
| 677 | Interleukin-18 receptor 1 | Q13478 | I28, V31, L38, H40, W56, V82, L83, F85, V88, Y96, F98, W107, L109, F136, C140, L154, A175, C185, H187, L189, C237, A239, L241, A278, L282, I284, C298, V300, L313 |
| 678 | Myotubularin | Q13496 | I185, L321, Y329, I350, L385, L388, L393, F438, A455, F475, L479, I539 |
| 679 | Sequestosome-1 | Q13501 | A8, L10, L47, V51, F55, A65, F77, A86, I97, I99, L394, M401, L413, L417, A427, I431 |
| 680 | Polycystin-2 | Q13563 | L736, L745, L770 |
| 681 | Myotubularin-related protein 2 | Q13614 | A88, V91, L105, V107, L112, F114, A127, L129, V131, I132, L151, I158, L161, F163, A164, I175, L179, F184, A194, W225, I227, C237, Y240, L244, V245, V246, I250, L255, V258, I267, V269, L270, A279, I281, C284, Y302, L303, A305, I306, I316, I318, F319, A321, A327, I353, L363, L366, Y371, W388, I392, I395, L396, A399, I402, A403, V406, V413, V414, V415, H416, A425, L427, L430, A431, M432, L433, M434, L435, Y439, I442, F445, V447, L448, V449, W453, F456, H458, F460, H466, A472, F480, L481, F483, I484, C486, V487, M490, A497, F498, F504, L505, I508, L509, F517, F520, L521, L533, L540, W541, I544, F551, L564, W576, Y579, Y580, I581 |
| 682 | Cullin-4B | Q13620 | L220, A223, V224, A226, L240, A243, V244, L256, L260, C264, L286, I289, M300, I303, I306, F307, L310, V315, I324, M327, F332, I336, I337, V342, I347, I350, L351, I354, L368, L371, L372, M374, L375, L378, Y381, F385, F389, Y397, V410, Y413, L414, V417, L421, L428, L440, V444, L448, L449, I456, L457, L461, L464, L465, L473, L476, L479, F480, L490, W494, I498, I505, V506, M515, V516, L519, L520, V526, I529, I532, C533, F534, F540, A543, M544, A547, F548, F551, I552, A560, L562, I563, A564, V567, L571, L587, I590, I593, F594, I597, V602, F603, F606, Y607, L611, A612, M629, L633, L645, M648, F708, F711, A734, L743, V745, F748, V752, I767, L778, L782, L785, A786, F808, I823, I850, A853, I854, M858, L869, V873, L886, I890, L893, M899, Y909 |
| 683 | Interleukin-10 receptor subunit alpha | Q13651 | A36, F39, H41, L43, V59, A60, L83, A98, V100, A102, F118, V123, L125, V130, Y157, F161, Y167, I169, V203, V205, V209 |
| 684 | Voltage-dependent L-type calcium channel subunit alpha-1S | Q13698 | A603, V610, V1010, A1023, A1312, L1329 |
| 685 | Laminin subunit gamma-2 | Q13753 | C550, C570 |
| 686 | Ectonucleotide pyrophosphatase/phosphodi-esterase family member 2 | Q13822 | C59, C76, C80, F90, C94, C118, C120, C124, C130, C131, W144, L166, I167, F169, V171, F174, Y178, M186, I189, L192, M202, Y206, Y222, H226, I228, V229, M233, F242, W254, L260, A264, I280, I286, I289, L295, V303, Y304, F306, M325, L329, V336, L339, M340, L343, C351, V352, I355, F356, V357, H360, M362, V365, C367, F372, L373, L390, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | I393, I409, L412, Y424, I444, H445, L446, L447, V454, F477, M484, F488, V489, F495, V501, F504, I507, L509, Y510, M513, C514, L517, L534, M544, A603, V604, Y610, L613, F618, Y622, M628, W631, Y634, C652, V653, V659, A669, L681, F682, A692, A696, F697, V699, M702, V703, M705, A708, V712, W713, F716, V719, L720, V721, A725, V731, V733, I738, F739, V757, I762, V764, Y768, Y769, I771, I772, I795, L796, V816, M820, H823, A825, V827, I830, L833, L836, F838, I849, L850, L852 |
| 687 | Plakophilin-1 | Q13835 | A250, L254, A266, I269, C273, A279, V283, L292, V293, V303, A306, A307, A308, A310, L311, L314, V315, L338, I346, L350, L354, L367, A371, L372, L375, A376, V379, I380, V402, F403, A406, C409, L410, L434, M444, L450, I451, L454, M455, V458, V472, C475, M476, V478, L479, L482, L486, L543, A548, I549, Y552, L555, A567, C568, A569, A571, L572, L575, M582, M586, I590, L597, I600, V611, A616, L618, L619, M622, L628, M632, V636, F637, I657, A661, V665, L668, A670, A700, A704 |
| 688 | Bone morphogenetic protein receptor type-2 | Q13873 | L492 |
| 689 | Voltage-dependent L-type calcium channel subunit alpha-1C | Q13936 | I702, V1131, A1453, M1470 |
| 690 | Coactosin-like protein | Q14019 | C10, A12, A13, Y14, V17, W26, V27, F29, I36, F48, C52, L58, F59, A60, F61, V62, F64, A77, L78, I79, W81, I82, V101, V104, V105, I114, L120, I125, L129 |
| 691 | Heterogeneous nuclear ribonucleoprotein D0 | Q14103 | M99, I101, L104, L113, F117, L130, V143, V154, H160, I167, I184, V186, I198, F202, C226, I228, F230, V236, I239, H245, V247, I254 |
| 692 | Lysosome membrane protein 2 | Q14108 | V42, L43, F64, F66, F67, V69, I75, Y89, F102, I109, A111, I133, L136, I138, V140, V143, I156, L160, L167, V173, L177, I184, I188, L201, Y213, I228, C245, F256, F269, F273, C274, V287, A292, F293, Y295, A299, I301, L302, V323, V326, M337, F342, F349, V350, I353, I369, I376, L377, A379, I387, V389, F395, V396, F406, V408, M409, V415, A422 |
| 693 | Low-density lipoprotein receptor-related protein 8 | Q14114 | F52, C54, C72, C93, H97, I99, C111, C134, V142, C154, A158, F172, C174, L180, C192, F211, C213, A220, C234, C285, C340, I350, C351, C362, C374, L424, F426, I435, L437, I446, A454, A503, Y512, L570, V601, I634, A635, I651, C700 |
| 694 | Dihydropyrimidinase | Q14117 | L7, L8, I9, V14, V15, A23, V25, V27, V32, L35, A54, V59, L60, I64, H67, H69, M70, M75, I80, F83, A89, A90, L91, M97, I98, I99, F101, A102, L110, I111, A113, W117, A121, V125, C126, C127, Y129, L131, H132, V133, A134, V135, V142, M146, L149, V150, V155, F158, M160, M162, A163, Y168, V170, L175, A178, F179, C182, I185, A187, I188, A189, V191, H192, A193, H217, A229, A233, I234, I236, A237, L244, Y245, I246, V247, H248, V249, M250, A254, A255, I258, A261, V268, I273, A274, A275, L277, Y284, A292, A293, H295, V296, M297, L301, L311, M312, L314, L315, L320, C328, F330, F342, I345, V349, V352, M356, V358, I359, W360, V364, F374, V375, V377, A382, A383, I385, F386, I395, A401, I403, V404, I405, W406, I414, V423, F428, C433, V439, I441, V447, F462, I463, A469, I472, Y473, I476 |
| 695 | Desmoglein-2 | Q14126 | L58, L64, I85, Y87, I101, F102, L111, V113, L117, F125, L127, A131, L145, I147, I181, V210, I220, L227, L237, V239, A241, A256, V258, I260, I293, V295, A308, V334, L336, V340, V352, I375, V377, F413, A415, Y428, W437, I438, I447, Y465, V467, I469, A471, V485, I487, V515, W544, V554, L556, I568, F570, I572, L586, L588 |
| 696 | Cytoplasmic dynein 1 heavy chain 1 | Q14204 | L2837, V2838, M2953, L2956, I2993, L3115, V3352, V3472, L3645, I3669, V3780, V3790, I3811, L3856, L3947, V4031, L4158, L4331, F4482, L4514 |
| 697 | Filamin-C | Q14315 | F42, C46, L50, L57, L60, L64, L70, I71, L73, L74, V100, V102, A103, L104, F106, L107, I122, I130, L131, L133, I134, L137, I138, I143, L165, I169, V173, F181, W185, A190, L191, A193, L194, V195, A199, C203, A218, A221, M222, A225, L229, V231, V234, I235, I240, V250, M251, Y253, L254, A278, A296, V300, A305, V312, V338, H348, V350, V352, F354, I359, V366, A590, F592, V593, V594, C626, V628, Y630, Y638, V640, V642, A656, C665, A688, I692, A697, C728, I740, I741, I742, V756, V758, V1065, F1083, I1085, A1090, V1119, Y1121, Y1129, I1131, I1133, I1140, A1147, I1149, V1158, A1160, V1178, A1183, I1192, I1214, Y1216, Y1224, I1226, I1228, Y1230, V1242, V1253, V1265, F1273, V1275, V1292, Y1312, V1314, Y1316, H1324, V1326, V1328, V1342, V1353, F1371, V1373, A1378, V1407, Y1409, Y1417, V1419, I1421, I1428, V1435, V1437, V1446, V1457, V1467, A1472, V1481, V1503, V1515, V1517, Y1519, V1524, I1531, V1533, V1542, I1554, A1556, F1562, I1564, A1566, A1569, I1578, V1600, Y1602, Y1610, I1612, I1614, Y1616, I1621, I1628, A1630, A1636, C1639, I1666, V1668, A1673, V1678, V1682, I1704, A1708, Y1714, I1716, I1718, I1725, V1732, A1734, V1793, V1802, I1822, V1824, H1834, M1836, I1838, I1845, V1862, F1880, I1882, V1916, Y1918, Y1926, I1928, V1930, F1932, I1937, A1944, I1946, I2003, F2005, H2013, V2015, V2017, V2033, A2041, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | V2044, V2064, V2098, Y2100, Y2108, I2110, I2112, F2114, V2126, V2128, V2254, Y2274, V2276, H2286, V2288, V2290, V2306, V2317, F2335, I2337, V2371, Y2373, V2375, Y2381, V2383, I2385, I2392, V2399, V2401, A2402, A2408, L2411, L2421, V2431, L2433, A2436, I2440, V2444, I2466, H2476, I2478, V2480, F2482, I2494, V2508, L2515, F2526, V2528, A2533, V2561, Y2563, A2567, Y2571, I2573, I2575, Y2577, I2583, A2590, A2635, V2638, A2648, V2658, C2660, A2663, V2694, Y2696, V2698, L2706, V2708, W2710, V2715, V2722 |
| 698 | UDP-glucose 4-epimerase (EC 5.1.3.2) | Q14376 | V5, L6, V7, H17, V19, L20, L22, V30, V31, I32, L49, V52, V60, A72, L73, L76, F82, A84, V85, I86, H87, Y104, L115, I118, M119, V124, L127, V128, F129, A133, V135, Y136, L144, H148, I164, I168, W178, A180, V181, L182, L183, A191, I197, M209, V212, V225, I242, H243, V244, L247, A248, H251, A253, A254, L255, L258, Y267, L269, M280, V281, A283, M284, A309, L313, A314, L318, W320, M329, C330 |
| 699 | Semaphorin-3A | Q14563 | I110, L308, V373, I451, V475, L476, L494, L529 |
| 700 | Inositol 1,4,5-trisphosphate receptor type 2 | Q14571 | L9, I11, V15, A19, I27, C37, V38, V39, Y66, V115, L123, H125, L132, A146, F161, I176, L193, V209, W218, L242, H244, C253, L264, A280, W282, I284, H307, A315, A316, L354, F367, H391, V398, I417, F429, A448, L452, L476, V483, I514, V518, C556, H562 |
| 701 | Inositol 1,4,5-trisphosphate receptor type 3 | Q14573 | L8, I10, V14, A18, I26, C36, V37, V38, Y65, V116, L124, H126, L133, A147, L162, V177, L194, V210, W219, L243, H245, C254, L265, A281, W283, V285, H308, A316, A317, L354, F367, H391, I398, L417, F429, A448, L452, L476, V483, I514, V518, C556, H562 |
| 702 | ATP-sensitive inward rectifier potassium channel 11 | Q14654 | L149, L233, L255, L287 |
| 703 | Metabotropic glutamate receptor 4 | Q14833 | L83, L86, A328, V341, L353, A363 |
| 704 | Transmembrane glycoprotein NMB | Q14956 | L274, I279, W283, F285, V293, V299, Y303, F309, A317 |
| 705 | Importin subunit beta-1 | Q14974 | I6, L7, A21, L25, L40, L44, A53, A56, A57, L59, I61, L65, W80, V91, V95, A109, C112, V113, A114, I116, A117, L129, L133, V137, L151, A153, I157, I161, L166, I173, A176, I177, I178, V190, A194, A197, L198, L202, F209, I218, M219, V221, V222, V233, A236, A237, L241, I244, M245, M252, L260, A267, M268, V275, A276, I280, F282, W283, V286, C287, A300, A301, A315, A318, L319, L322, V323, L326, L330, C345, A347, A348, C351, L352, L355, A356, I363, V367, A385, A386, V387, A389, C392, I393, L394, L402, V406, L413, V424, A428, A429, V432, I435, C436, L439, A442, A443, L452, C455, L456, L460, A467, V470, C471, A473, F474, L477, A478, A481, L499, F503, I506, V507, L510, L524, A528, Y529, L532, M533, I535, V536, A540, C543, A546, V547, I554, L558, V561, L562, L584, C585, L588, V591, L592, V595, A600, I603, V607, M608, L611, M614, F615, V624, A628, L629, A631, V632, L635, V636, L639, F643, M647, F650, L658, V666, C667, A670, V671, L673, V674, L677, C678, L681, M693, L696, V709, I713, L714, V716, F717, I720, A721, F728, V735, L736, L739, A742, L758, C765, L766, A768, Y769, I772, V773, L776, V787, V790, V794, I797, L798, F800, I801, I804, V814, V815, A816, A818, A819, L821, I822, L825, A828, V833, V837, I843, L846, L847, A858, L861, A862, A865 |
| 706 | Arf-GAP with coiled-coil, ANK repeat and PH domain-containing protein 1 | Q15027 | V411, C421, C423, A431, V437, L439, C443, H447, L472, M473, I481, I484, I510, L575, M588, A591, A593, A614, A622, C623, L626, A647, L655, A656, F659, A680, I688, L691, L713 |
| 707 | Lysine--tRNA ligase (EC 6.1.1.6) | Q15046 | I84, L105, F108, V128, I132, Y145, L147, L154, V156, A158, L176, I182, V184, I198, I199, L232, V240, I250, I254, L258, F263, I266, I274, I298, H304, V308, V315, Y316, I318, C338, F340, L350, M357, V358, M361, V362, V385, F387, F391, I394, M396, V397, L400, F414, L423, C427, L443, L444, L447, V448, L452, C456, F461, I462, H465, L472, A473, F486, L488, F489, V490, M491, C496, A498, L502, L511, F533, C534, A545, W547, M549, I551, V554, A555, M556, F557, V567 |
| 708 | Advanced glycosylation end product-specific receptor | Q15109 | L36, W51, L53, W72, A76, L84, L86, V89, F97, C99, A101, V115, V117, L133, V141, C144, W157, L192, C208, F210, L214, V238, L257, W271, C301 |
| 709 | Programmed cell death protein 1 | Q15116 | A50, F52, C54, F56, L65, W67, A80, A81, F106, M108, V110, A113, Y121, C123, A125, A140, L142, V144 |
| 710 | Plectin | Q15149 | F185, W188, V189, L193, A196, L203, L207, L213, I214, L216, L217, V240, A243, L244, L247, L254, I262, A263, L271, L273, I274, I277, I278, I283, I286, L301, W304, V309, C317, F320, W324, L329, F330, A332, I333, I334, L341, V347, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | L353, L356, A359, F360, A363, V369, L372, L373, V378, I388, I389, Y391, V392, L395, Y396, Y421, V425, L428, M432, I451, L483, V503, L510, L521, C545, L549, A552, L556, V575, L579, A582, L589, V593, L596, V611, L618, L662, L665, W668, V669, V688, I702, F705, A712, Y727, L731, L734, L741, L752, L755, F758, V759, A762, L769, L798, A826, V830, L837, M844, L847, C850, I851, H854, F864, A871, L875, L918, L921, A925, L931, L946, C950, V988, V991, C992, F993, V995, A1002, V1006, L1009, A4418, I4420, I4431, A4434, L4448, L4449, A4453, C4454, I4458, I4459, V4469, A4472, I4486, A4489, A4492, A4507, A4508, A4510, A4520, F4524, L4525, A4548, L4562, A4567, L4572, A4586, L4600, A4603 |
| 711 | Nectin-1 | Q15223 | L49, C51, V65, W67, V78, A79, Y93, I109, L111, Y122, C124, F126, L138, V142, L168, A170, C172, L213, A219, L224, C226, I227, V228, L239, V243, L267, C269, L300, F302, Y314, C316, A318 |
| 712 | Receptor-type tyrosine-protein phosphatase kappa | Q15262 | Y77, M78, V80, A91, L93, L95, H104, F108, L123, I125, V127, I138, A152, L154, A155, V156, Y164, V166, F168, A170, I180, A181, I182, F214, C216, L230, A253, F255, Y268, C270, V271, V280, A284, L308, I310, L312, V328, I361, L365, I406, V408, C420, I427, V454, V463, L465, M467, L469, I507, L509, Y524, I526, F558, Y567, F569, I571, A573 |
| 713 | Receptor tyrosine-protein kinase erbB-4 (EC 2.7.10.1) | Q15303 | Y53, C56, V58, V59, L63, I65, I68, L77, V80, V83, V87, L88, V89, A90, F94, L97, L99, L102, I104, I105, A116, A118, I119, L131, L134, L136, L139, I142, V147, V149, A158, I166, V167, C197, C234, A235, A248, C258, V298, C334, I337, V348, I353, F356, C359, I362, L366, F368, L389, F392, V395, I398, L402, I404, F414, V416, F417, L420, I423, L434, I436, I442, L445, F447, L450, I453, I458, I460, L466, C467, L477, C496, C507, C512, W513, C532, V748, I750, A769, A773, M775, L780, V786, C787, V795, L804, V808, L820, L821, W823, C824, I827, A828, M831, L834, H841, L844, A845, A846, V849, V851, V857, I859, L864, A888, C891, V903, W904, Y906, V908, I910, L913, M914, I929, L933, L939, V949, M953, C956, W957, F967, L970, F974, M977, L985 |
| 714 | Sonic hedgehog protein | Q15465 | A58, A94, M98, C102, L106, L109, A110, V113, L122, V124, W128, L139, H140, A145, V146, I148, M160, L161, A162, A165, V173, I181, C183, V185, A187, A193 |
| 715 | Transforming growth factor-beta-induced protein ig-h3 | Q15582 | V505, M506, L509, F515, L518, A521, I522, L531, V539, F540, A541, A546, L565, H572, I573, L589, L597, V599, V606, V608, V624, V625, H626, V627, I628, L632 |
| 716 | Myosin light chain kinase, smooth muscle | Q15746 | M1536, I1688, L1714 |
| 717 | Neuronal acetylcholine receptor subunit alpha-2 | Q15822 | A163, H164, A177, I211, L213, V286, I314, V349 |
| 718 | Serine/threonine-protein kinase STK11 (EC 2.7.11.1) | Q15831 | V77, L80, M127, V128, M139, L140, A153, F157, I161, L164, L167, I172, V173, H174, I177, L182, L190, I192, C210, V236, W239, A241, V243, L245, F255, I267, L285, L286, M289, I303 |
| 719 | Syntaxin-binding protein 2 | Q15833 | L6, V10, I14, V18, I19, V22, V30, L31, I32, M33, I40, L41, I50, I57, I61, A73, I74, Y75, L77, V84, L87, F91, Y99, A102, I104, F105, F106, L114, L118, L123, L135, A136, F137, V144, F145, L147, A149, L169, L172, A173, I176, A177, L179, C180, A188, I189, L201, A202, V205, L209, L230, L231, I232, M233, A236, A237, V240, L243, L247, F249, M252, A253, L291, V299, V303, L326, H346, H348, L349, A350, C353, V361, L364, C365, L371, L388, I389, V392, L393, L394, I404, V406, L407, L408, L409, Y410, I411, L412, L422, L425, I426, A429, L437, I438, L441, L444, V448, M466, I479, V482, M483, A486, L534, I535, V536, Y537, V538, M539, V542, M544, M547, A549, A550, V553, V563, L564, I565, H569, L571, F576, L577, L580, L583 |
| 720 | Adiponectin | Q15848 | A6, L13, P25, V27, L29, G34, G38, I74, P76, I97, A114, F115, V117, F132, F150, L157, Y158, F160, A161, Y162, V166, V171, V173, L175, L183, V201, L202, L203, L205, V211, L213, F234, F237, L238 |
| 721 | NT-3 growth factor receptor (EC 2.7.10.1) | Q16288 | I71, L134, L157, L182, A298, V301 |
| 722 | Solute carrier family 15 member 2 | Q16348 | I653, V660 |
| 723 | Acid-sensing ion channel 2 | Q16515 | F99, L117, Y190, L217, I219, L221, I248, I257, I402, L428, I432 |
| 724 | Interleukin-17A | Q16552 | C94, C99, V121 |
| 725 | Calcium/calmodulin-dependent protein kinase type IV | Q16566 | C63, L74, V117, L126, F127, Y136, A141, A142, A144, V145, L149, A151, L165, L170, L181, I183, A209, V222, W225, V227, I229, I233, L234, C236, F241, I254, W266, L271, A273, L276, V277, L280, A294, W299, L317, F320 |
| 726 | Laminin subunit alpha-3 | Q16787 | L272 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 727 | Receptor-type tyrosine-protein phosphatase O | Q16827 | L920, F923, M930, F938, F942, L945, A957, Y974, V979, Y992, A995, I998, Y1007, I1008, A1009, F1021, W1022, M1024, V1025, I1032, I1033, V1034, M1035, L1036, C1047, Y1050, V1065, F1081, I1083, V1092, H1094, Y1097, W1100, I1114, F1117, V1118, V1121, M1132, I1133, I1134, H1135, C1136, V1140, F1146, I1147, A1148, L1149, L1152, V1162, I1164, L1165, V1168, M1171, M1178, V1179, Y1185, F1187, I1188, C1191, V1192 |
| 728 | Toxin B (EC 2.4.1.—)/strain 630 (*Clostridium difficile*) | Q189K3 | L562, I578, Y580, I581, V582, A594, F598, A599, V606, L607, F608, A618, L648, F650, F663, L671, I675, I686, I693, L695, M700, F701, Y711, L715, L716, V719, I723, M727, I735, V737, A739, I762, I778 |
| 729 | Toxin A (EC 2.4.1.—)/strain 630 (*Clostridium difficile*) | Q189K5 | L9, A13, Y23, I26, L30, L48, L51, I55, F58, L71, L74, I78, V82, L97, H98, F99, V106, Y113, W117, L128, W129, A134, F135, L136, A152, F170, Y171, M175, I178, I204, I205, L209, I231, I239, L244, Y254, L258, A266, A267, V271, A275, L276, V282, L284, M288, L289, I314, L316, A318, I319, F334, F345, I349, I358, F359, V367, L370, I372, I374, A375, A385, L386, I387, L394, V398, Y406, L409, L413, A416, F430, L434, L446, I449, F457, A461, L467, A472, Y473, A476, Y477, F480, L483, L497, A526 |
| 730 | Protein Dok-7 | Q18PE1 | V7 |
| 731 | Spike glycoprotein | Q1HLC5 | Y60, M70, L78, F83, F91, F96, A97, V99, F114, A116, I117, I119, F123, V130, V131, L147, I149, V151, C152, M156, C157, H161, I163, L200, H203, F204, F211, A213, F224, Y238, V239, L240, L242, C244, Y252, Y262, L264, C278, A520 |
| 732 | Lipoprotein, Lp | Q1HP67 | W1640, C1665, C1676 |
| 733 | Endogenous retrovirus group K member 113 Env polyprotein | Q1PHM6 | A54, F92, M94, M99, M103, I107, V119, V126, M145, L156, A220, I221, C235, V266, I281, L284, V288, I321, C326, I328, L337, V340, V341, I353, Y378, C379, F385, C417, I422, I423, V429, A432, M433, L452, L453, I469, F470, W481, L485, V491, I493, V507, I550, V551, L557, L558, A560, I561, A563, M567, L568, V572, I575, L578, V582, I637, I644 |
| 734 | CTLA-4 protein | Q28090 | A52, V67, V71, C101, V110, C127, V129, I147 |
| 735 | Hemagglutinin [Cleaved into: Hemagglutinin HA1 chain; Hemagglutinin HA2 chain]/strain A/New Zealand: South Canterbury/35/2000 H1N1 | Q289M7 | V7, I20, C21, I22, A26, V33, V36, V43, L49, L50, L58, C59, L61, L67, L69, C72, V74, A75, W77, I78, L79, C84, L87, W93, Y95, I96, V97, Y108, L118, L122, V125, F128, F134, A150, C152, H154, L164, L165, L167, L173, L177, V189, L190, V191, L192, W193, V195, H196, H197, Y208, Y214, V215, V217, V218, I243, Y245, Y246, L249, L250, I256, F258, A260, L264, I265, A266, Y269, A270, F271, A272, L273, F277, I281, I282, C291, C295, A301, I302, H312, M330, V331, A348, Y365, A387, I388, L461, L469, H485, C487, C491 |
| 736 | HLA class II histocompatibility antigen, DRB1-16 beta chain | Q29974 | F36, L37, F46, F47, V53, F55, L56, Y59, V67, F69, Y76, W90, L97, A103, C108, V120, V128, L138, L143, L144, V145, C146, V148, F151, W160, M171, L190, V199, Y200, C202, V204 |
| 737 | MHC class I polypeptide-related sequence B | Q29980 | L28, L32, V34, F45, L51, F56, L57, Y59, A66, A73, L96, L100, L113, C119, F133, F140, L141, L145, A158, A162, V165, L191, Y194, V223, C225, A227, F230, W239, V268, I272, C282 |
| 738 | MHC class I polypeptide-related sequence A | Q29983 | L28, V34, V49, L51, F56, C59, C64, A73, L96, L100, L113, C119, F133, F140, L141, A162, V165, L191, I221, V223, C225, A227, F230, W239, V268, I272, C282 |
| 739 | Kinesin-like protein KIF7 | Q2M1P5 | V18, A19, L20, V47, L49, V70, Y71, V75, A88, V90, F91, A92, M104, I119, V120, A123, V143, Y145, L146, V148, F153, L156, V192, V220, F221, V223, L225, F248, F250, V251, A281, L282, V285, I286, A288, I306, I309, L310, L314, A318, M322, I323, A324, C325, V326, L340, A343 |
| 740 | Endogenous retrovirus group K member 24 Env polyprotein | Q2N0S5 | A54, A69, M94, M99, V100, M103, L121, L124, L128, L145, C148, M152, F167, L192, A203, C217, A218, A223, I224, L225, C238, V241, L258, V269, F287, V291, I293, F314, A316, I324, C329, V331, L340, V343, V344, L347, I357, F381, C383, F389, L413, C415, I420, I421, I427, A430, M431, Y432, A433, I446, L449, I450, L451, F465, W476, L480, V486, I488, V502, I545, V546, L552, L553, A555, I556, A558, L562, L563, V567, I570, L573, V577, I632, I639 |
| 741 | Endogenous retrovirus group K member 8 Env polyprotein | Q2N0S6 | W44, F52, C53, A54, W68, A69, F92, M94, W95, M99, V100, M103, L110, C118, V119, L121, L124, C125, L128, C130, L145, C148, F150, M152, Y164, F167, L192, C195, I200, A203, C204, C217, A218, A223, I224, L225, C227, C238, V241, I250, L258, V269, V285, F287, V291, I293, C295, F314, A316, I324, C329, V331, W336, L340, V343, V344, L347, I357, F359, H372, C376, F381, Y382, C383, L388, F389, L413, C415, I417, I420, I421, I427, A430, M431, Y432, A433, C442, I446, L449, L451, F465, W476, L480, Y483, V486, I488, A494, V502, I545, V546, L552, L553, A555, I556, A558, L562, L563, V567, I570, L573, V577, I632, I639 |
| 742 | HLA class II histocompatibility antigen, DR beta 5 chain | Q30154 | F36, L37, F46, F47, V53, F55, L56, L67, F69, Y76, W90, L97, A103, C108, V120, V128, L138, L143, L144, V145, C146, V148, F151, W160, V171, L190, V199, Y200, C202, V204 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 743 | Hereditary hemochromatosis protein | Q30201 | L30, Y32, A49, V53, F58, V59, Y61, L87, L91, I105, L118, L122, C124, H145, L146, A162, A176, L183, C187, L191, L223, C225, A227, Y230, W239, I268, V272, C282, V284 |
| 744 | Genome polyprotein [Cleaved into: Protein C/strain Mr 766 (ZIKV) | Q32ZE1 | I291, C293, V311, V313, V314, L315, C320, V321, V323, M324, A325, V331, I333, L335, V340, Y349, C350, Y351, A370, V381, C395, L403, V404, C406, A407, F409, M415, I420, L425, Y427, I429, M430, L431, V433, V455, A464, L466, L472, L474, C476, L482, Y488, Y489, L490, M492, H496, W497, V499, F504, H512, L528, V529, V541, L555, H574, L575, C577, L579, M581, L584, C594, F598, V612, V614, V616, Y618, C625, I627, M631, A632, L644, I645, I651, M660, L662, L664, I673, V674, I675, I811, V978, I1008, V1536, M1539, H1545, M1547, V1570, L1574, V1575, Y1577, W1581, V1593, L1595, A1597, V1598, I1613, A1623, V1624, I1637, I1645, L1647, Y1648, V1653, V1660, L1703, I1706, V1707, A1710, V1718, I1719, L1720, A1721, V1726, A1727, M1730, L1734, V1756, L1758, M1759, H1761, F1764, Y1777, L1779, I1781, M1782, A1785, I1793, A1794, A1795, I1799, A1808, A1809, A1810, I1811, F1812, M1813, V1850, V1858, W1859, F1860, V1861, I1870, A1871, C1873, L1874, A1877, I1882, L1884, F1889, W1901, F1903, V1904, I1905, A1914, V1921, I1922, V1938, V1946, A1949, A1951, A1952, I1958, Y1969, M1970, A1976, A1983, A1988, L1991, L1992, I1995, L1997, A2003, L2005, F2030, V2031, L2033, L2039, W2042, L2043, A2044, V2047, A2048, W2059, C2060, I2069, V2078, L2088, A2095, F2107, F2110, A2111, W2528, Y2543, I2548, V2551, A2556, A2559, L2560, A2570, V2571, A2576, I2578, L2581, L2587, V2593, V2594, L2596, C2598, A2607, A2608, V2613, V2616, Y2619, V2648, C2656, L2659, L2660, C2661, V2672, L2678, V2680, L2681, V2684, W2687, L2688, F2695, C2696, I2697, V2699, L2700, C2701, Y2703, M2707, M2711, L2714, L2722, V2725, H2733, M2735, Y2736, W2737, V2738, I2745, V2749, L2755, L2756, I2794, I2801, V2842, L2845, W2849, V2880, V2890, M2891, L2898, I2929, A2939, A2942, F2948, C2964, C2967, V2968, Y2969, M2994, L2996, A2998, L3001, A3005, F3008, L3009, W3014, M3015, V3024, L3032, Y3034, L3036, M3039, A3042, M3047, I3059, A3082, V3085, Y3090, V3094, V3095, V3097, V3107, I3110, I3111, V3123, A3126, L3127, F3130, L3133, V3134, V3135, L3137, I3138, M3141, M3149, L3152, V3161, L3165, L3173, M3176, A3177, V3178, V3184, V3185, F3192, A3195, L3196, F3198, L3199, M3202, V3224, F3226, F3231, I3242, V3243, V3244, C3246, I3253, A3256, A3262, A3270, A3273, A3277, W3280, L3282, F3285, H3286, L3290, M3293, A3294, A3296, I3297, A3300, V3301, V3303, H3316, L3328, W3331, V3334, W3335, H3341, I3354, L3357, A3378, I3381, V3385, I3391, M3399, L3402 |
| 745 | N-acetylglucosamine-1-phosphotransferase subunits alpha/beta (EC 2.7.8.17) | Q3T906 | L139, L154, F161, V191, A228, L230, L243, L251, A267, L269, L271, A300 |
| 746 | Integrin beta-2-like protein | Q3UV74 | V127, L129, Y130, F131, L132, M133, V146, L149, L153, L154, L157, I166, F168, I171, F176, F189, L193, L209, A211, V212, V213, V215, A216, I222, L231, V232, L233, Y265, L279, I291, F292, V293, V294, Y302, I309, V324, I328 |
| 747 | Tyrosine-protein kinase (EC 2.7.10.2) | Q3ZC95 | F10, L11, F30, L31, L32, L37, I61, C63, V64, V67, F98, F102, V104, Y112, V113, F114, W124, L128, A384, V427, I429, I432, F442, A446, M450, L457, V463, C464, I470, I473, L482, L486, L498, L499, C502, V505, C506, A508, M509, L512, H519, L522, A523, A524, C527, V529, V535, V537, Y545, V561, V568, I580, W581, F583, V585, L586, M587, I590, Y591, I610, L616, A622, V626, I629, M630, C633, W634, F644, L647, I651, V654 |
| 748 | Envelope glycoprotein gp160 | Q3ZLH8 | A54, H65, A69, V94, V100, M103, V119, I150, L189, C214, A220, I221, C224, C235, V238, I247, L255, I266, I280, I281, V282, L284, V288, I290, A293, I321, C326, V328, W333, L337, V340, A341, I342, L344, I352, I353, F354, H367, C371, F376, C378, L383, F384, L407, C409, I411, I414, I415, V421, A424, M425, I440, L444, L445, F462, W473, L477, V483, I485, V499, I542, V543, L549, L550, A552, I553, A555, L559, L560, V564, I567, L570, V574, I629, I636 |
| 749 | Cytotoxin L | Q46342 | L9, V13, Y24, I27, L31, Y46, L49, I52, Y59, L72, F75, L79, V83, L98, H99, F100, Y114, W118, V129, A135, L137, I138, L141, I145, A149, F171, M176, I179, F186, I206, L210, L254, L259, V260, A267, A268, I274, L277, V283, Y284, L285, I289, L290, L317, A319, I320, F335, F346, I359, F360, L363, V368, L371, V373, I375, A376, A386, L387, I388, C395, V399, I403, Y407, L410, F431, I450, L454, F458, L468, V473, Y474, A477, Y478, L481, F501, A527 |
| 750 | Envelope glycoprotein | Q49DS8 | I13, V15, L17, V21, I23, I53, C58, I60, L69, V72, A74, L76, I84, V85, H99, F108, C110, L115, F116, I127, L129, C131, I136, I137, V143, A146, M147, I162, L165, L166, L167, F181, W192, L196, V202, I204 |
| 751 | Cell adhesion molecule-related/down-regulated by oncogenes | Q4KMG0 | V737, V739, W741, F754, V756, V782, Y791, F793, V795, A797, V815, I832, I843, L845, F862, I864, I891, Y900, I902, M904, C906 |
| 752 | Cordon-bleu protein-like 1 | Q53SF7 | V187, I189, L207, L210, I214, C215, L227, L228, L251, A253 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 753 | Receptor protein-tyrosine kinase (EC 2.7.10.1) | Q59FL8 | I611, V613, I615, A634, M637, V640, V645, C646, I651, L659, I660, L669, V673, L685, L686, W688, C689, I692, A693, L699, V705, H706, L709, A710, A711, V714, V716, V722, I724, F727, A753, V768, Y771, V773, V775, L778, I794, L798, L804, V814, M818, C821, W822, F832, L835, F839, M842, L850 |
| 754 | Integrin beta | Q59H50 | C81, C88, C91, C107, L113 |
| 755 | Filaggrin-2 | Q5D862 | L33 |
| 756 | Guanine nucleotide-binding protein G | Q5JWF2 | L686, L687, L688, L689, I699, M703, I738, L742, A745, I746, I749, L756, I774, F789, A793, L796, V802, C805, C817, A818, F821, I825, I828, F862, M864, V867, A886, I887, F889, V890, V891, Y896, F916, L925, V930, I931, L932, L934, L939, L940, V944, A980, I984, F988, A994, I1015, C1022, I1026, H1030 |
| 757 | MAGUK p55 subfamily member 7 | Q5T2T1 | A73, L96, L108, V164, A173, L185, V188, I201, I212, F214 |
| 758 | Dyslexia-associated protein KIAA0319 | Q5VV43 | L354, A356, W372, L393, L395, Y403, F405, V407, V409, V422, V424, A629, L644, W660, A679, V681, L684, F691, L693, V695, V709 |
| 759 | Disabled homolog 2-interacting protein | Q5VWQ8 | L653 |
| 760 | Renalase (EC 1.6.3.5) | Q5VYX0 | L5, I6, A9, L15, C16, A17, A31, V32, W33, A56, L58, L80, V106, A107, I111, I114, I115, I135, W142, V144, F154, I157, V158, L159, V163, I166, I173, L185, Y194, A195, L198, F199, I221, V224, V243, V262, V266, F311, L312, A313, C314, F319, I328, A331, V334 |
| 761 | Hemagglutinin [Cleaved into: Hemagglutinin HA1 chain; Hemagglutinin HA2 chain]/strain A/Singapore/1/1957 H2N2 | Q67333 | I7, I18, C19, I20, Y22, A24, V31, I34, V41, I47, L48, L56, C57, L59, L65, L67, C70, I72, A73, W75, L76, L77, C82, L85, W91, Y93, I94, M95, Y106, L116, L119, L120, V123, F126, L132, A148, C149, V151, M161, V162, W163, L164, A174, M186, L187, I188, I189, W190, V192, H193, H194, Y205, Y211, V212, V214, L219, L236, M240, F242, L246, L247, I253, F255, L261, I262, A263, Y266, F268, I270, I278, M279, C288, C292, A298, I299, H306, H309, I313, V320, L325, L327, A328, L331, A345, M357, Y362, A384, F385, A436, L448, H451, V455, L458, V462, L466, C477, H482, C484, C488, M489 |
| 762 | Envelope glycoprotein gp160 | Q69994 | A52, H63, A67, M92, M97, V98, M101, W109, V117, V124, I172, Y239, C240, A246, I247, C250, C261, V264, I273, L281, L282, V292, I306, I307, I308, L310, V314, I316, C318, I346, C351, I353, W358, L362, I365, V366, A367, L369, I378, V379, F380, H393, F395, F402, C404, L409, F410, L430, C432, I434, I437, I438, V444, A447, M448, I463, L466, L467, L468, I483, F484, W495, L499, V505, I507, V521, I565, V566, L572, L573, A575, I576, A578, L582, L583, V587, I590, L593, V597, I652, I659 |
| 763 | Hemagglutinin/A/Viet Nam/1203/2004(H5N1) | Q6DQ33 | F8, I19, C20, I21, A25, V32, I35, V42, I48, L49, L57, C58, L60, L66, L68, C71, V73, A74, W76, L77, L78, C83, F86, W92, Y94, I95, V96, A99, C106, Y107, L117, L120, L121, I124, F127, I133, A150, C151, Y153, V163, V164, W165, L166, I167, I176, L188, L189, V190, L191, W192, I194, H195, H196, A201, Y207, Y213, I214, V216, L221, M242, F244, F245, I248, L249, I255, F257, F263, I264, A265, Y268, A269, Y270, I272, I280, M281, C290, C294, A300, I301, H308, H311, I315, V322, L327, L329, A330, A351, M363, Y368, A390, I391, A442, L454, V461, L464, V468, L472, C483, H488, C490, C494, M495, A512 |
| 764 | Tau-tubulin kinase 2 (EC 2.7.11.1) | Q6IQ55 | V17, V23, Y36, A38, V47, L49, V51, V67, L68, L71, C78, V92, V93, L101, L119, L121, I125, L126, I129, I132, H139, F147, C159, M161, L209, L212, F213, Y214, M215, L216, F219, W226, V235, F255, F258, I262, L276, V279, F280, I284 |
| 765 | Growth/differentiation factor 6 | Q6KF10 | F363, C387, A401, I430, C452, C454 |
| 766 | Iodotyrosine deiodinase 1 | Q6PHW0 | I116, A123, I149, I181, A188, I190, L191, I192, L193, I194, F195 |
| 767 | Spike glycoprotein/HCoV-NL63 | Q6Q1S2 | I485, F487, A489, A491, L509, W541, C577, F579, L581, A583, L596, V598 |
| 768 | Nucleoprotein/strain A/Equine/Santiago/1/1985H3N8 | Q6TXC0 | V33, I36, F39, M43, L56, I57, I63, M66, V67, L68, A70, I96, I116, I119, W120, M136, M137, W139, A153, L154, M163, M189, V190, L193, I194, I197, I201, Y219, C223, L226, F230, A234, M238, M239, V242, L256, L259, A263, I265, L266, C275, L276, A278, Y281, F291, Y296, L307, I312, L315, L328, V329, W330, M331, A332, C333, H334, A336, A337, L341, I347, V352, V363, M371, L381, A387, A427, A428, I444, Y487 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 769 | Hemagglutinin/ A/Netherlands/219/2003 (H7N7) | Q6VMK1 | V58, I66, C67, L76, C79, L81, L82, I85, C91, A99, L101, I102, I103, C112, L123, L127, I133, I145, C154, Y162, M165, L168, Y184, A192, L193, I194, I195, W196, I198, H199, Y211, I218, V220, I246, F248, L253, V259, F261, F263, A266, F267, I268, A269, P270, A273, F275, L276, I283, C293, C297, Y298, A353, Y370, A392, L466, L474, H490, C492, C496, A514 |
| 770 | Neuraminidase (EC 3.2.1.18)/strain A/Budgerigar/Hokkaido/1/1977 H4N6 | Q6XV28 | L87, V94, A105, I106, I114, V116, Y121, L122, C124, M131, F132, A133, L134, A145, L158, I159, W161, C176, I177, C184, M191, I193, C194, M195, A202, A204, V205, V206, Y208, A220, L224, C231, V232, C233, V240, V241, M242, I255, I256, Y257, F258, I276, C279, C281, Y282, V285, I288, C290, I291, C292, A299, V303, I304, I306, Y317, L318, C319, V322, L323, V350, F353, A354, F355, W362, L363, Y375, M377, L378, V380, A383, I397, I398, A409, F410, I411, F420, F424, Y425, V426, L428, V438, I445, V446, A447, L448, A464, I466 |
| 771 | Tubulin alpha-1A chain | Q71U36 | C4, I5, I7, H8, V9, V14, I16, C20, W21, L23, Y24, C25, H28, I30, F52, F53, V62, A65, V66, F67, V68, L70, V74, I75, V78, L86, I93, A99, A100, Y103, A104, I115, V118, L119, I122, L125, F135, L136, V137, F138, H139, L153, M154, L157, L167, F169, Y172, A174, Y185, I188, L189, L195, C200, A201, F202, M203, V204, A208, I209, I212, C213, L227, L230, I231, I234, V235, I238, A240, L242, V250, L252, F255, L259, V260, I265, H266, F267, L269, A270, A273, V288, I291, C295, M302, V303, C305, Y312, M313, C315, C316, L317, L318, Y319, V323, V328, A331, I335, V344, I355, V363, A369, A374, V375, C376, M377, L378, A383, I384, A387, W388, L391, F395, Y399, Y408, F418, A421, M425, L428, Y432 |
| 772 | Endogenous retrovirus group K member 9 Env polyprotein | Q75760 | A54, A69, M94, M99, V100, M103, I107, V119, L121, V126, I151, C154, A171, L190, A221, I222, C225, C236, L256, L257, V267, I281, I282, V283, L285, V289, I291, C293, F312, I322, A325, C327, I329, W334, L338, I341, V342, I343, L345, I354, V355, F356, H369, F371, C373, F378, C380, L385, F386, L407, C409, I411, I414, I415, V421, A424, M425, I440, L443, L444, L445, I458, F459, W470, L474, Y477, V480, I482, V496, I539, V540, L546, L547, A549, I550, A552, M556, L557, V561, I564, L567, V571, I626, I633 |
| 773 | Rho-related GTP-binding protein RhoU | Q7L0Q8 | V50, C52, V53, L54, V55, V60, L65, V66, Y74, A82, V90, V92, V97, L99, L101, A105, Y118, I123, F124, L125, L126, C127, F128, V130, F136, V139, W143, V144, I147, C151, I156, I157, L158, V159, L175, V183, A188, L190, C191, A192, I195, C203, L211, V214, F215, A217, A218, I219 |
| 774 | Ribonucleoside-diphosphate reductase subunit M2 B (EC 1.17.4.1) | Q7LG56 | L34, I52, A66, W78, F88, I89, I92, L93, A94, F95, F96, F111, V115, V117, A120, F123, Y124, H134, M137, L141, I142, Y145, I146, A158, I159, Y164, A169, W171, V187, V188, A189, A191, A192, V196, F197, F198, A203, A204, I205, L208, L213, M214, L217, I224, F234, A235, C236, M238, F239, V251, I254, I255, A258, V259, F265, L266, A269, L270, V272, L274, I275, M282, I286, A290, L294, F303 |
| 775 | Ankyrin repeat and sterile alpha motif domain-containing protein 1B | Q7Z6G8 | V815, W818, L819, L831, F836, M842, M847, L852, I857, I866, A869, I870, V889, L893, F905, I933, I939, A1064, F1065, A1084, C1085, I1105, L1107, V1109, V1114, I1130, I1133, F1146, A1147, Y1148, I1149, C1160, V1162, F1163, A1171, I1174, L1178, A1181 |
| 776 | E3 ubiquitin-protein ligase HUWE1 (EC 6.3.2.—) | Q7Z6Z7 | A1335, A1338, A1348, L1352, F4001, V4019, V4021, V4026, F4027, L4034, M4042, W4065, Y4066, I4069, M4073, L4080, I4093, F4107, F4109, V4110, I4113, V4114, A4115, A4117, L4124, C4126, F4128, F4132, Y4133, I4136, M4146, F4174, V4207, V4210, C4211, M4215, F4226, F4230, I4234, L4238, I4239, I4241, L4247, I4251, I4278, F4281, A4284, L4285, A4294, V4300, F4311, F4323, I4325, C4341, L4345, L4347, Y4350, L4356, L4360, A4363, I4364 |
| 777 | Hemagglutinin [Cleaved into: Hemagglutinin HA1 chain; Hemagglutinin HA2 chain]/strain A/Equine/Kentucky/1/1981 | Q82559 | A26, L28, C29, L30, A34, V41, V51, L57, V58, I66, C67, V73, C79, L81, I82, M85, L86, C91, F94, L101, F102, I103, F109, C112, Y113, Y115, Y120, A121, L123, V127, A128, L133, F140, A153, C154, F162, F163, L166, L169, L179, Y193, W195, I197, H198, H199, Y210, V217, V219, I245, I247, Y248, I251, V252, I257, L258, I260, L266, V267, A268, F273, I289, C296, I297, I303, I324, L331, A332, A349, W358, Y366, A388, A440, L462, L470, C481, F482, I484, H486, C488, C492, I493, I496, A510 |
| 778 | Fusion glycoprotein F0 | Q84850 | I233, F237, V247, M251, L257, I261, M274, V281, F342, V349, C382, A412, V414, C416, C422, A424, V450 |
| 779 | Regulating synaptic membrane exocytosis protein 1 | Q86UR5 | V600, L602, A614, L616, L618, A633, I635, A644, L650, V656, W659, L664, V672, I676, V685, I687, V689, L746, V748, L750, L759, V761, V763, A766, V782, M784, V818, F823, L828, I830, V832, L846, I849, L853 |
| 780 | Fermitin family homolog 3 | Q86UX7 | L73, L74, I358, V378, F380, L404, I422, V426, L437, C439, A446, W448, M449, A450, C452, L454, A455 |
| 781 | Transmembrane protease serine 6 (EC 3.4.21.—) | Q8IU80 | I504 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 782 | Sodium channel subunit beta-4 | Q8IWT1 | L51, C53, L64, W68, L79, I80, V84, I101, I114, I116, L118, L121, C131, V133, L149 |
| 783 | Interferon lambda-3 | Q8IZI9 | L27, L45, A59, L65, L75, L82, L85, A93, L94, A96, L98, L102, L126, C136, A161, C169, V174, L181 |
| 784 | Interferon lambda-2 | Q8IZJ0 | L31, L49, A63, L69, L89, A100, L106, C140 |
| 785 | Abl interactor 1 | Q8IZP0 | V451, A453, L465, I473, V475, I476, C488, F495 |
| 786 | Kin of IRRE-like protein 3 | Q8IZU9 | I438, C440, I442, A452, W453, L483, I485, I488, Y497, C499, A501, L514 |
| 787 | Envelope glycoprotein gp160 | Q8J581 | C50, A51, H62, A66, M91, M96, V97, M100, I104, L107, V116, L143, I210, Y212, C213, A219, I220, C223, C234, V237, I246, L254, I265, I267, I279, I280, V281, L283, V287, I289, C291, I320, A323, C325, V327, W332, L336, V339, A340, L343, I351, I352, H366, F375, C377, F383, L408, C410, I412, I415, I416, A422, A425, M426, I441, L444, L445, L446, F460, W471, L475, Y478, V481, I483, V497, I540, V541, L547, L548, A550, I551, A553, L557, L558, V562, I565, L568, V572, I627, I634 |
| 788 | Endogenous retrovirus group K member 21 Env polyprotein | Q8JDI3 | A54, H65, A69, F92, M94, M99, V100, M103, I107, L110, V126, I145, M152, V173, I175, L189, F206, I211, Y213, C214, A220, I221, C235, V238, I247, L255, V266, I280, I281, V282, L284, V288, I290, I321, C326, V328, L337, V340, V341, L344, I352, F354, H367, F369, C371, F376, C378, F384, L405, C407, I409, I412, I413, V419, A422, M423, I438, L441, I442, L443, F457, M464, W468, L472, Y475, V478, I480, V494, I537, V538, L544, L545, A547, I548, A550, L554, L555, V559, I562, L565, V569, I624, I631 |
| 789 | Neuroligin-4, X-linked | Q8N0W4 | I55, V70, Y73, V76, Y78, F88, V109, C110, L132, C146, L147, L149, I151, V153, V168, M169, V170, I172, H173, L190, A191, V196, I197, V198, I199, I201, Y203, I207, F210, L211, A218, L224, I228, A230, L231, W233, I234, V238, V248, I250, F251, A257, C259, V260, L262, L263, A276, I277, I278, A288, I299, L300, A301, V304, C306, V315, L318, L326, I338, I349, Y365, I367, M368, L369, V380, V390, V399, F402, V403, L416, I420, L440, L443, V450, A457, H460, Y470, A471, F472, A488, V493, Y495, V496, F497, F508, L519, V523, M524, Y526, W527, F530, A531, A558, L570, I572, A584, F589, I603 |
| 790 | Jouberin | Q8N157 | V1057, A1058, I1072, I1078, V1080, F1101 |
| 791 | Gamma-aminobutyric acid receptor subunit gamma-1 | Q8N1C3 | I436 |
| 792 | TGF-beta-activated kinase 1 and MAP3K7-binding protein 3 | Q8N5C8 | L13, L16, V27, V28, M32, C42 |
| 793 | Inactive dipeptidyl peptidase 10 | Q8N608 | L69, V94, V95, L117, V139, A142, A155, V158, L180, A183, L192, I193, Y194, I195, I200, L230, Y231, L235, A241, L251, A252, L254, I256, I266, Y280, L294, Y295, V296, V297, L299, L306, Y320, I321, V324, V333, V334, W336, L337, I345, C349, F385, V388, H400, V401, A402, V425, I438, F440, L452, C475, F489, L490, C493, L503, L545, L547, L549, A562, L563, L564, L565, V576, L588, V594, I595, V596, A597, L609, I615, V622, V631, I647, Y655, A657, F668, C670, A675, L680, A684, A686, F687, L692, V711, I721, H723, V730, F732, H734, L742, I773, F777, L781 |
| 794 | Proprotein convertase subtilisin/kexin type 9 (EC 3.4.21.—) | Q8NBP7 | V80, L82, A95, L98, A102, F122, V124, L130, A134, V140, I143, F150, I161, V180, V182, Y183, L184, L185, H193, I196, H229, L230, A231, V233, V234, A242, A245, M247, L250, V252, I271, L283, V284, V285, L286, L287, C301, L304, V309, V310, L311, V312, A314, A315, A322, A328, A330, V333, I334, V336, A338, V346, V359, L361, F362, A363, I368, A371, A388, A389, A390, H391, V392, A393, I395, A396, A397, M399, L400, A409, L411, L415, I424, F429, V441, A442, A473, A475, L484, C486, F489, C509, A511, V520, A522, I523, A524, C526, C527, A542, C588, A594, I596, H597, A598, C600, C601, A603, L606, V622, A625, L632, C654, V656, V672, A674, A676, C678, C679 |
| 795 | Cytoplasmic dynein 2 heavy chain 1 | Q8NCM8 | L1352, F1356, F1368, C1411, L1419, L1438, M1476, V1484, V1496, L1511, L1515, W1626, C1640, M1644, Y1655, C1671, L1675, A1678, V1699, A1736, V1750, L1751, A1753, V1754, A1764, F1788, V1815, A1826, V1872, A1901, L1943, A1962, V1975, V1976, I1977, V1978, W1989, L1992, A1995, M2008, I2053, V2069, F2094, A2105, I2113, C2182, L2200, F2208, F2254, F2275, W2278, L2279, L2301, A2304, L2354, V2355, L2374, A2376, V2395, V2403, L2427, V2474, V2476, V2480, L2524, I2526, A2531, F2548, F2572, L2634, I2640, F2646, L2651, L2653, A2654, V2668, A2701, V2708, L2712, F2722, L2751, H2777, L2780, C2803, V2805, M2808, I2819, C2862, Y2872, F2875, A3208, A3209, A3317, V3318, L3324, V3332, V3353, I3360, A3383, V3390, L3403, A3496, L3509, A3522, F3571, A3572, F3575, W3648, Y3651, C3657, A3694, L3724, L3740, A3754, M3755, A3771, W3776, L3777, A3811, L3822, A3861, |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| | | | A3868, F3870, H3871, A3872, C3874, Y3927, I3931, L3944, L4021, L4040, V4090, Y4140, L4141, L4144, I4151, A4202, I4217, C4225, C4248, A4301 |
| 796 | Semaphorin-6D | Q8NFY4 | L150, A179, Y199, I211, Y252, A256, V269, F292, L297, A407, V417, L465, C521 |
| 797 | Protein CASC5 | Q8NG31 | F2149, Y2151, I2154, L2156, I2158, L2197, I2202, V2233, C2236, L2239, I2243, L2265, L2267, F2269, F2278, I2280, L2282, I2309, Y2322, V2326, V2327, I2330 |
| 798 | Envelope glycoprotein | Q8Q7Z9 | M23, I24, I30, L69, A100, I101, C115, V118, V131, L135, L136, V146, I160, I161, V162, L164, V168, I170, C172, A192, F193, I196, M202, H206 |
| 799 | CTLA4 | Q8TDA6 | A54, C58, Y60, V69, V71, V73, C85, L95, V112, I116, C129, V131, I149 |
| 800 | 2-amino-3-carboxymuconate-6-semialdehyde decarboxylase (EC 4.1.1.45) | Q8TDX5 | I5, H6, H8, I9, L10, L17, A37, L39, C53, M63, A72, L73, M79, F80, Y82, L92, C93, L96, L100, F111, L114, L117, M119, A125, M129, C132, V141, I143, V147, L152, L157, V160, Y161, A163, A164, C169, L171, F172, V173, A202, I203, M206, I207, V211, V220, C221, F222, A223, F229, F262, L274, L277, V286, I287, I305, M308, L319, A321, A324, F327 |
| 801 | Partitioning defective 3 homolog B | Q8TEW8 | I12, L434, I499, L509, I527, I533, L550, V553, L558, A566, I584 |
| 802 | Protein Shroom3 | Q8TF72 | A30, L32, A63, L70, V76, I79, A91, L102, L104, V106 |
| 803 | Intelectin-1 | Q8WWA0 | C41, C48, L58, C70, L81, V82, A83, V85, C94, W100, A129, Y139, L147, I149, H151, V152, W161, L167, L176, L183, I186, Y187, W200, V236, F238, V240, F241, A246, A247, A249, L250, C251, M254, H264, C265, F272, C280, F283, F286, I303, A306, A307, L309, L310, F311, Y312 |
| 804 | Palladin | Q8WX93 | F1020, C1022, V1024, I1032, W1034, C1058, L1060, Y1073, I1075, A1077, L1090, C1152, M1154, C1156, V1158, L1193, I1195, V1198, Y1206, C1208, A1210, L1253, C1255, W1267, I1291, L1293, I1295, A1298, Y1306, V1308, A1310 |
| 805 | Relaxin receptor 2 | Q8WXD0 | C52, L59 |
| 806 | Nesprin-2 | Q8WXH0 | A191, V203, W210, A215, F216, A218, I219, I220, L242, A245, F246, A249, V264, I274, M275, Y277, V278, A279, F281, L282 |
| 807 | Mucin-16 | Q8WXI7 | L14325, F14327, I14329, L14332, I14353, L14357, L14360, V14389, C14393, A14399, I14407, F14411, L14421, V14431 |
| 808 | Hemagglutinin [Cleaved into: Hemagglutinin HA1 chain; Hemagglutinin HA2 chain]/strain A/Hong Kong/1/1968 H3N2 | Q91MA7 | A27, L29, C30, L31, A35, V42, V52, L58, V59, I67, C68, I74, C80, L82, I83, A85, L86, L87, C92, F95, L102, F103, V104, F110, C113, Y114, Y116, Y121, A122, L124, V128, A129, L134, F141, A154, C155, F163, F164, L167, L170, Y177, L180, L193, Y194, I195, W196, V198, H199, H200, Y211, V218, V220, I246, I248, Y249, I252, V253, V258, L259, I261, L267, I268, A269, F274, I290, C297, I298, I304, V325, L332, A333, A350, W359, Y367, A389, A441, L463, L471, C482, F483, I485, H487, C489, C493, I494, I497, A511 |
| 809 | Alpha-N-acetylneuraminide alpha-2,8-sialyltransferase (EC 2.4.99.8) | Q92185 | W68, F78, C85, C86, F92, M105, Y107, I117, C138, A139, V140, V141, I146, L147, C152, I156, F161, V162, C165, L167, V178, L184, V185, I191, I192, L199, F206, Y213, A222, F223, L233, V235, Y236, L239, A244, F262, W263, A270, L273, A282, A283, L284, L286, C287, V290, Y293, W296, F298, I307, Y311, Y312, L316, F321, A323, M324, L334, L340, C347 |
| 810 | Nicastrin | Q92542 | C50, L53, L54, C62, I73, V85, M95, V96, L98, F103, M108, L111, L121, A122, V123, W164, L171, F176, F178, I180, F181, L182, L183, V191, I192, L212, C213, A214, M215, L217, C230, C248, L251, V256, W257, M259, V275, V276, V277, A278, A279, L282, F288, A292, A295, A298, V299, A300, F302, V303, L306, A307, A308, A309, A311, L312, A315, V325, M326, F327, V328, F329, F330, F335, Y337, I338, M347, V354, F362, L365, V368, L376, M378, V394, L397, L401, F430, V439, L441, A442, L471, A484, L487, A488, V490, A491, V493, L494, L498, Y499, L501, A502, V511, A513, V518, L521, L522, F525, A529, F534, L538, H553, I555, V566, V567, A570, L571, V605, C620, A628, A630, A634, A658, I660 |
| 811 | Protein NDRG1 | Q92597 | Y73, C92, A119, I145, W183, H214, L284 |
| 812 | Nectin-2 | Q92692 | L52, C54, V68, W70, A83, F85, L103, L127, Y138, F142, L156, V180, A181, C183, V236, C238, V240, L255, V257, V263, W272, L314, C329, V331 |
| 813 | Ryanodine receptor 2 | Q92736 | L14, V20, V21, L22, C24, A26, L35, C36, L37, A38, A39, I64, C65, F67, L69, L78, L113, Y115, A118, I119, L121, H123, L130, C131, A144, V147, L149, C158, W160, I162, V175, L181, L183, L192, V203, A205, A206, W212, V214, L228, L234, L236, H238, C244, L245, V247, V260, Y262, V267, A271, L274, W275, L277, I289, F295, L297, H299, V300, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | Y305, L306, L315, L316, A322, F329, F331, I354, C361, I363, L372, A391, I403, L405, A416, V418, I419, F426, F429, L447, V452, L456, L459, I460, F463, L482, L488, F489, M494, V498, C501, I502, L505, F514, A518, I529, L530, L533, L536, A539, L540, W697, A698, V718, C757, I766, V791, V792, A886, F921, V996, A1000, H1004, L1050, V1054, V1115, W1117, L1128, A1134, A1136, F1137, V1162, C1164, V1166, M1173, F1175, F1195, V1204, V1443, W1445, I1446, L1459, V1465, V1467, L1469, I1507, L1518, F1520, A1542, F2720, A2725, H2727, H2729, L2779, M2782, M2828, M2840, M2844, A2845, A2889, I2892, L2893, L2896 |
| 814 | Serine protease HTRA1 (EC 3.4.21.—) | Q92743 | C53, C76, L132, L150, V175, I179, A182, V183, V184, H185, I186, L188, F207, I208, I215, V216, A219, V221, V222, V228, V230, A240, A249, I251, A252, I254, I256, V279, V280, A281, I282, V297, I317, A321, I323, L332, V333, V339, I340, I342, F353, A354, I355, I360, F363, I383, A395, L398, A412, I414, A423, L428, V433, I434, I437, V448, I452, L458, M460, V462, I471, V473 |
| 815 | Secreted frizzled-related protein 3 | Q92765 | A63 |
| 816 | Ras-responsive element-binding protein 1 | Q92766 | C701, C792, C805, C1514 |
| 817 | Disks large homolog 3 | Q92796 | I132, L134, L141, A146, V154, I160, I162, A170, A171, V179, V183, L184, V186, V191, A199, A202, L203, A206, V210, L212, V214, V227, L229, L236, I240, I255, I257, A265, A266, L278, V281, L286, A294, L298, V305, L307, V309, A310, I387, L389, I409, F410, V411, A420, L426, I432, V435, A448, A451, V459, I461, A463 |
| 818 | X-linked retinitis pigmentosa GTPase regulator | Q92834 | A13, V14, H46, A48, V49, V50, L56, M58, F59, L67, V81, V89, A92, H98, L100, V101, V108, A110, L119, I133, A153, A154, L155, L161, M163, W164, I172, H201, A203, F204, V205, L211, V213, F214, L222, L228, H254, V256, V257, V263, F266, L274, L280, I289, H306, A308, L309, L315, M316, F319, C343, H360, M361, V362, V363, A365 |
| 819 | Ectodysplasin-A (Ectodermal dysplasia protein) | Q92838 | L90, V251, L253, V262, L271, L293, V295, Y301, I303, V307, V309, Y311, I312, F314, A318, Y320, V322, I336, C346, I360, V362, I369, I371, M373, F380, A382 |
| 820 | Canalicular multispecific organic anion transporter 1 | Q92887 | A668, V669, L680, A683, M684, I1330, V1332, V1333, L1343, L1347, F1348 |
| 821 | Tumor necrosis factor receptor superfamily member 14 | Q92956 | C53, C54, C57 |
| 822 | Lipoma-preferred partner | Q93052 | C444, L451, C476, I483, A494, F500, C524 |
| 823 | Homogentisate 1,2-dioxygenase (EC 1.13.11.5) | Q93099 | L61, Y62, W97, F112, V113, L119, C120, L131, A132, I133, I135, F136, L137, C138, C146, F147, F154, L155, I156, V157, L163, I165, F169, M172, V174, I179, C180, V181, I182, M186, F188, I190, Y199, I200, L201, V203, F208, L221, F227, V239, V245, I246, L253, A256, F263, V265, A267, W268, Y277, V300, L301, A303, A313, F315, I317, F342, L345, A397, F398, F400, Y423 |
| 824 | Interleukin-22 receptor subunit alpha-2 | Q969J5 | F41, L45, F61, V62, C118, L120, Y131, V135, F152, V176, L178, L183, V205, A241, I243 |
| 825 | SH3 domain-containing kinase-binding protein 1 | Q96B97 | A4, V6, L18, I20, I26, W37, F48, V53, C103, V105, L117, L119, I125, V127, L140, F147, I152, C272, V274, L286, I288, V294, W307, F318, V323 |
| 826 | Interleukin-17 receptor A | Q96F46 | L48, V93, A94, I96, W98, A112, L114, F129, L135, F144, F149, V150, V151, Y157, V159, V161, H163, V182, M190, C196, L217, V219, F221, Y230, I232, L234, V281, I283, F287 |
| 827 | Leucine-rich repeat and immunoglobulin-like domain-containing nogo receptor-interacting protein 1 | Q96FE5 | V55, C57, L76, L78, I83, L86, F91, L97, L100, L102, V107, A114, F115, L118, L121, L124, L131, V138, L142, L145, L148, I150, L158, F163, L166, L169, L172, V174, L179, A186, F187, L190, L193, L196, L198, C201, A210, L211, L214, L217, L220, L222, I230, L241, L244, I246, W249, L252, C259, L260, L265, L268, I270, A282, L286, L289, I299, L310, L313, L318, L323, A330, F331, L334, L340, V342, L347, L350, V354, L361, L364, L366, L371, L377, V380, F381, L387, F389, C396, V402, F407, A424, F444, C446, W458, L482, V484, A487, Y495, C497, A499, A510, L512 |
| 828 | PDZ and LIM domain protein 5 | Q96HC4 | L8, W14, L28, I30, A39, V49, V50, I53, A58, M61, A66, I70, L77, M79, L81, C420, I427, L432, C446, M453, F458, V459, C467 |
| 829 | E3 ubiquitin-protein ligase Itchy homolog | Q96J02 | L20, I22, V24, V43, V45, V47, V71, V73, L79, F81, V83, L95, I102, L106, L113, L122, L135, I137, L139, L328, L440, F456, F496, F535, C539, I550, V552, F558, I565, L573, V579, I580, V592, W596, F597, L600, L611, F638, F640, I641, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | F644, I645, A646, M647, A648, Y664, I667, L677, F705, A742, F757, F761, I764, L765, L770, F773, L778, L782, W793, I809, F812, F815, V816, M825, L827, L828, V831, F842, F854, C855, I856, C871, L875, L877, L886, L890, A893, I894 |
| 830 | Serine/threonine-protein kinase WNK4 (EC 2.7.11.1) | Q96J92 | L210 |
| 831 | Roundabout homolog 3 | Q96MS0 | C143, I572, L574, I591, V616, F627, V629, A631 |
| 832 | NACHT, LRR and PYD domains-containing protein 3 | Q96P20 | L10, L14, F25, L29, L54, A55, M58, A67, W68, A69, M70, A71, I74, F75, A87 |
| 833 | Interleukin-17F | Q96PD4 | C102, C107, V129 |
| 834 | SLIT and NTRK-like protein 1 | Q96PX8 | Y61, L63, L65, L70, L73, F78, L87, M89, L94, A101, F102, L105, V108, L111, I113, I118, F121, L129, L132, L135, A137, L142, A149, F150, L153, L156, L159, L161, I166, V173, F174, L182, L184, L189, V197, L198, I201, I207, L208, L209, W214, C216, L220, L223, A234, V239, C241, L247, L252, I387, I390, F395, L401, L404, L406, I411, F419, L422, L425, L428, M430, L435, L438, F443, L446, L449, L452, V454, I459, I462, F467, M470, L473, L476, L478, L483, V490, F491, L496, L499, L501, F506, V514, L515, I524, L526, W531, I537, F540, L556, F569 |
| 835 | Membrane-associated guanylate kinase, WW and PDZ domain-containing protein 1 | Q96QZ7 | F318, Y377, L475, L496, I498, A507, M513, V518, I519, V520, V522, V527, L528, V535, V548, L550, L552, C553, I646, I686, V689, V694, V702, V715, L717, V719, I842, L844, I865, I867, A876, L888, I889, V891, V896, V904, A911, V917, L919, V921, V999, I1001, I1038, A1047, L1053, V1062, I1075, V1086, L1088, V1153, L1166, L1176, A1187, M1193, I1199, I1202, A1215, L1218, V1226, L1228, L1230 |
| 836 | Envelope glycoprotein gp160 | Q993A8 | A13, M38, V44, M47, I51, V63, V70, I97, L136, A167, I168, C182, V185, I194, L202, L203, V213, I227, I228, V229, L231, V235, I237, C239, M269, C274, I276, W281, L285, I288, A289, L292, I302, I303, F304, H317, F319, C321, F326, C328, L333, F334, L359, C361, I366, I367, V373, A376, M377, I392, L395, L396, L397, I410, F411, M418, W422, L426, V432, I434, V448, I491, V492, L498, L499, A501, I502, A504, L508, L509, V513, I516, L519, I523, I578, I585 |
| 837 | Neurogenic locus notch homolog protein 4 | Q99466 | C472, C510, C548, C586, C965, L1638, H1639, A1641, A1642, A1650, L1671, H1672, A1674, V1675, A1679, V1682, C1683, L1686, L1705, M1706, L1707, A1708, A1709, L1716, L1720, A1737, L1738, H1739, A1741, A1742, A1749, A1750, L1753, L1771, F1772, L1773, A1774, A1775, V1782, A1783, L1786, V1806, A1807, L1815 |
| 838 | Protein deglycase DJ-1 | Q99497 | A6, L7, V8, I9, L10, A11, A14, V25, M26, V33, A36, L58, A61, Y67, V69, V70, V71, L72, A79, L82, V88, L92, I102, A103, A104, I105, A111, L112, L113, H115, I117, V123, M133, M134, I152, L153, F164, A165, I168, V169 |
| 839 | Histone H2B type 1-N | Q99877 | V42, V45, L46, A59, M63, V67, I70, F71, I74, A75, A78, A82, I90, I95, A98, V99, L103, A108, A111, A118 |
| 840 | Myocilin (Myocilin 55 kDa subunit) (Trabecular meshwork-induced glucocorticoid response protein) [Cleaved into: Myocilin, N-terminal fragment (Myocilin 20 kDa N-terminal fragment); Myocilin, C-terminal fragment (Myocilin 35 kDa N-terminal fragment)] | Q99972 | V269, W270, W286, I288, V298, Y301, F307, H316, L318, A327, V329, L334, F336, V344, I345, Y347, L349, I360, A363, L381, V383, L388, V390, I391, I401, L403, L406, L411, V426, A429, F430, I431, I432, L436, V449, M476, L486, W489, M494 |
| 841 | Semaphorin-3C | Q99985 | L305, L449, L472, I473, I491, L526 |
| 842 | Sclerostin | Q9BQB4 | C80, L146, C165 |
| 843 | Programmed cell death protein 10 | Q9BUL8 | L22, A41, A46, A51, L81, F100, L103, A107, L110, L114, I117, F127, I134, L141, V145, V148, L160, F167, F174, V190, F191, A194, L197, I198, I204, L205, F208 |
| 844 | Brother of CDO | Q9BWV1 | V622, V624, W626, F639, V641, I668, Y677, F679, V681, A683, V701, I718, I729, L731, F748, I750, I777, Y786, I788, M790, C792 |
| 845 | Complement C1q tumor necrosis factor-related protein 5 | Q9BXJ0 | A108, L123, F125, F143, C145, Y151, F153, V155, V159, L164, L168, L199, V205, V207, F227 |

TABLE 5-continued

TARGETS

| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
|---|---|---|---|
| 846 | Periaxin | Q9BXM0 | V44, A53 |
| 847 | Complement factor H-related protein 5 | Q9BXR6 | Y53, I70, C87, V110, I127, C129 |
| 848 | Disintegrin and metalloproteinase domain-containing protein 33 | Q9BZ11 | L212, L214, Y215, I216, V217, A218, L237, V240, V244, L247, L248, I253, W263, L279, F282, L283, A298, L300, L301, V328, A339, A340, M343, A344, I347, L351, M373, L405, C433, C444, C457, C462, C488, C495 |
| 849 | NACHT, LRR and PYD domains-containing protein 1 | Q9C000 | L13, L21, F24, L28, V53, A54, L57, A66, A70, W74, L82, V136, F365, F801, A824, V825, L828, L842, L844, C847, L849, C854, L870, L872, L877, A882, C886, L899, C904, C910, C911, L918, L927, L929, V939, L942, C943, L946, L953, L956, L958, M967, L971, L974, I983, L1379, V1382, L1389, I1390, V1393, V1396, V1399, L1400, L1403, L1408, V1416, M1426, L1429, L1444, A1447, L1448, L1459 |
| 850 | MCG4778 | Q9D1H1 | L75, F77, I79, L82, I88, I103, L107, L110, V140, C144, A150, I158, F162, L172, V182 |
| 851 | Amyloid beta A4 precursor protein-binding family B member 2 | Q9DBR4 | V594, L611, A614, V630, M632, V639, V641, C654, V656, L659, F661, M662, V664, F671, A672, F673, I674, C684, V686, F687, C689, A693, V696, V700, A703, N738 |
| 852 | Sperm-egg fusion protein Juno | Q9EQF4 | M28, C47, W50, C55, C86, A93, C95, F96, C99, L103, V120, V123, L125, C126, C130, W133, C137, F169, F173, L179, C180, I183, F188, C200, L201, V216 |
| 853 | Fibroblast growth factor 23 | Q9GZV9 | H41, L42, L53, I55, A72, L73, I85, L94, C95, M96, C113, F115, V126, L135, V136, F157 |
| 854 | ADP-ribosylation factor-like protein 6 | Q9H0F7 | V20, L21, C22, L23, I33, I34, F58, M70, A89, I90, F92, V93, I94, V104, L109, L112, I118, I125, L126, F127, F128, A129, V143, L149, C160 |
| 855 | Magnesium transporter protein 1 | Q9H0U3 | L44, I54, M56, L64, V65, Y72, V74, I75, V76, M77, F78, C90, A93, F97, L100, A101, I114, F116, V119, V127, F128, F139, A163, I166, I170 |
| 856 | ATP-binding cassette sub-family G member 8 | Q9H221 | L195, L234, L264, A422, A546, A548, A549 |
| 857 | ATP-binding cassette sub-family G member 5 | Q9H222 | V72, I81, M82, C83, I84, L85, L95, L96, L139, L142, V144, L148, Y150, A155, V168, M172, I185, A204, M214, L215, F216, L235, A239, I244, V245, I249, I263, A264, F273, M280, F284, F298, Y301, Y329, L371, V375, A415, L423, F426, V427, M435, A438, F442, V448, Y458, M463, M464, A466, Y467, V471, A478, F482, C486, Y487, L490, L492, A505, L506, A508, H510, L511, L518, L521, V530, V534, C571, I574, L575, V576, F580, C613, A616, L627, F642 |
| 858 | Cadherin-23 | Q9H251 | I42, L55, F78, V87, L89, V103, F105, V107, V118, I120, V122, V154, V187, V189, V205, A207, L222, I224 |
| 859 | DnaJ homolog subfamily C member 5 | Q9H3Z4 | L16, Y17, L20, I31, A53, I60, A63, L67, I75, V95 |
| 860 | SPARC-related modular calcium-binding protein 1 | Q9H4F8 | I416 |
| 861 | Anthrax toxin receptor 1 | Q9H6X2 | L45, Y46, F47, I48, L49, V55, I62, Y63, F65, V66, L69, L78, M80, F82, I83, V84, F85, L109, L113, M120, F124, A127, I131, I145, I146, A147, L148, F159, A165, V175, C177, V178, V180, L188, I191, A192, L208 |
| 862 | Pleckstrin homology domain-containing family A member 1 | Q9HB21 | L14, F30, L32, F39, F81, V82, M83, L92, W103, V106, L107, C198, L215, I220, I235, C246, L257, F258, I260, V269, V284 |
| 863 | Transient receptor potential cation channel subfamily V member 4 | Q9HBA0 | L487 |
| 864 | Interleukin-21 | Q9HBE4 | L35, V39, L42, A56, C64, A68, F69, C71, F72, L77, I89, L96, F129, L130, F133, L136, L137, I141 |
| 865 | E3 ubiquitin-protein ligase SMURF1 | Q9HCE7 | I15, L17, V19, A22, L25, L33, A38, I40, V42, L68, I76, I78, V80, I86, F94, I133, V135, F324 |
| 866 | Roundabout homolog 2 | Q9HCK4 | C110, A435, L437, W451, L473, L478, Y486, C488, A490, A501, L503, V538, L540, I557, V582, F593, V595, A597, V637, V652, V654, I665, Y668, V670, L699, I710, V712 |
| 867 | Golgi-associated PDZ and coiled-coil motif-containing protein | Q9HD26 | L291, I313, I315, A324, L330, A335, I336, A338, V339, L344, A352, L356, I363, F365, V367 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 868 | Neurexin-3-beta | Q9HDB5 | I96, L113, V115, F117, I125, L126, V127, I129, L139, L141, I143, I148, V150, F152, I159, I161, V168, V176, A185, L187, V189, V194, L204, F207, I213, I215, F224, L228, L231, Y233, V238, L239, V255, V261 |
| 869 | Neuraminidase (EC 3.2.1.18)/strain A/Brevig Mission/1/1918 H1N1 (Influenza A virus (strain A/South Carolina/1/1918 H1N1)) | Q9IGQ6 | L85, I106, V114, V116, F121, I122, F132, F133, L134, L158, C161, A178, W179, A181, A183, C184, L191, I193, I195, A202, V203, A204, L206, L224, A232, C233, V234, F239, I241, M242, A251, Y253, I255, I258, V263, H275, Y276, C279, C281, Y282, V288, C290, V291, C292, V304, F306, L310, C318, V321, F322, F349, F351, Y353, V357, W358, I359, F371, M373, I374, F387, I393, V394, F406, V407, M418, C421, F422, W423, V424, L426, W437, I443, F445 |
| 870 | Spike glycoprotein | Q9J3E7 | L79, V87, F92, F100, I104, A106, V108, F123, I126, V127, I128, F132, V139, V140, I141, I148, V152, C153, C158, C165, A201, F202, F206, F213, A215, F226, I232, V241, L242, F244, C246, Y258, V260, A482, Y891, V900, V906, A994, A1053, L1067, I1113 |
| 871 | Interleukin-23 subunit alpha | Q9NPF7 | C33, L40, A44, L82, C89, L90, I93, H94, L97, Y100, F109, L124, L128, L131, L150, L169, V173, A176, V179, F180 |
| 872 | SLAM family member 7 | Q9NQ25 | F39, I51, W53, L90, L95, L122, V124, Y125, L128, W164, L180, C195 |
| 873 | Serine protease inhibitor Kazal-type 5 | Q9NQ38 | C30, F33, C44, C63, C66, C161, L173, C194, C197, C225, L237, C258, C261, C297, L309, C330, C333, C367, L379, C400, C403, C437, L449, C470, C473, C496, L508, C529, C532, C567, L579, C600, M602, C603, C632, L644, V653, C665, M667, C668, C707, L719, C740, C743, C774, L786, C807, C810, C849, L861, C882, C885, C916, L928, C949, C952, C1014, Y1021, L1027, C1028, I1040 |
| 874 | Ubiquitin carboxyl-terminal hydrolase CYLD (EC 3.4.19.12) | Q9NQC7 | V131, V133, V146, V165, L167, C193, V195, F196, V236, L238, V249, L255, V265, V267, C286, I295, A476, I488, A502, L504, A531, I594, L603, L607, F608, C609, L610, F611, A612, Y633, L640, V645, V654, I659, L662, L666, F685, L689, I693, L700, I717, I730, F745, L752, I754, M756, L775, I777, L780, C788, C802, F816, A863, V864, L865, C866, A874, F875, V876, L886, F888, V906, C909, V912, A935, C945, Y947 |
| 875 | Potassium voltage-gated channel subfamily H member 7 | Q9NS40 | I30, A32, C44, F48, C49, M51, V59, C64, C66, I82, A83, V96, Y98, I112, I127, A766, A781, L785, I790, I807, F808, V825, A827, L833, V844 |
| 876 | Septin-11 | Q9NVA2 | F42, I44, L45, C46, V47, L57, M58, V92, L94, L96, V99, Y114, I117, I121, F125, L129, A149, C150, L151, I154, M169, L172, V176, I178, I179, I181, I182, A183, F196, I200, M228, F234, V237, A252, V262, F270, L273, M276, L285, H293, Y294 |
| 877 | Alpha-parvin | Q9NVD7 | L268, V272, H275, L276, V283, L286, F290, L296, V297, L299, M300, V308, V327, A330, M334, L339, I349, L358, V360, L361, L364 |
| 878 | Sodium channel subunit beta-3 | Q9NY72 | L43, C45, V60, W62, V103, I105, V107, Y118, C120, V122 |
| 879 | Endoplasmic reticulum aminopeptidase 1 (EC 3.4.11.—) | Q9NZ08 | F47, Y57, Y63, L65, I67, L71, F76, V82, I84, A86, I93, I94, L95, A105, L107, L115, L123, I131, A132, L133, L139, L140, V141, Y145, V147, V148, I149, Y151, Y163, L177, A178, F182, A186, A187, A190, F191, C193, F194, A201, F203, I205, I207, F236, M242, Y245, L246, V247, A248, F249, I250, I251, V267, V269, A271, A279, Y281, A282, L283, A285, A286, L289, L290, Y293, F297, L308, A309, A310, I311, F314, A318, M319, W322, L324, Y327, A331, L332, L333, I347, V351, A352, L355, A356, H357, W359, F360, L363, M366, W369, L372, W373, L374, F378, A379, F381, M382, V387, L394, V396, F405, A407, M408, A412, V419, V423, M432, V436, A442, C443, I444, L445, L448, F457, I461, L465, L478, W479, M482, V517, M520, M521, W524, F530, L532, I533, I535, V542, M544, Y549, W563, V565, L567, L582, F600, M604, Y607, Y608, I609, V610, L620, L624, V631, A637, L639, I640, A643, L646, I654, A657, L658, L660, Y663, L664, V673, L680, M687, V695, F699, F702, L703, L731, L732, A735, C743, A747, V767, A770, V771, A776, W782, L785, I801, A804, L805, C806, L814, L817, L818, I827, F832, I835, L836, I839, A849, W850, L853, L860, F864, I871, M874, V875, F882, V891, F895, L898, L905, I915, I929, L933 |
| 880 | Interleukin-1 receptor accessory protein-like 1 | Q9NZN1 | L66, V347 |
| 881 | Programmed cell death 1 ligand 1 | Q9NZQ7 | V21, M36, I38, C40, L53, V55, W57, M59, I64, I65, F67, Y81, L92, A97, A98, L99, I101, V104, Y112, C114, I116, I126, V128, A132, Y134, L153, C155, A157, A163, W167, V193, L197, F207, C209, F211, L214, L224, I226 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 882 | Potassium voltage-gated channel subfamily D member 2 | Q9NZV8 | L66, F84 |
| 883 | Signal-regulatory protein gamma | Q9P1W8 | A49, L51, C53, V64, W66, I104, I109, C119, V120, F166, C168, F173, W182, A211, V213, L215, V224, C226, V228, L244, A247, I248, V269, C271, V273, F276, L283, W285, C329, V331 |
| 884 | Spastin (EC 3.6.4.3) | Q9UBP0 | V116, A123, A130, A145 |
| 885 | Glyoxylate reductase/hydroxypyruvate reductase (EC 1.1.1.79) | Q9UBQ7 | V9, V11, L23, A24, A26, V49, A50, A52, L55, L56, C57, V63, L68, V77, I78, I93, A112, A115, L118, L119, C123, V156, I158, A167, I168, A169, L172, L181, A192, L205, A206, F211, I212, V213, V214, C226, F230, F231, A238, V239, F240, I241, V248, L254, A257, A264, A266, L268, V270, L282, A309, A310, L313 |
| 886 | Beta-1,4-galactosyltransferase 7 | Q9UBV7 | L95, A96, V97, L98, V99, F111, V112, M115, L119, I128, V130, L131, A142, L144, I145, V147, I159, A160, H162, L166, L167, L173, Y175, H184, V185, A186, L190, V200, I203, L204, L205, L206, Y211, M217, F231, I235, L242, L258, A262, A305, L310, I312, C324 |
| 887 | Fibulin-5 | Q9UBX5 | C166, C286 |
| 888 | 5'-AMP-activated protein kinase subunit gamma-2 | Q9UGJ0 | M265, C270, I273, V289, A292, L296, A304, L306, L318, I320, F323, I324, I326, L327, L341, I346, A368, L370, A373, V374, L377, L385, V387, L399, H401, I404, L405, L408, F420, L425, I430, I445, A448, L449, I457, L460, V462, Y473, V478, A482, L490, V494, L498, C511, L517, I520, V529, L532, V533, V534, V535, I545, L547, I550, L551, A553, L554 |
| 889 | Deleted in malignant brain tumors 1 protein | Q9UGM3 | A1896, V1899, I1901, V1910, C1911, A1920, V1922, V1923, C1924, A1981, V1983 |
| 890 | Interleukin-20 receptor subunit alpha | Q9UHF4 | M50, L54, L82, C95, L97, A110, V112, I151, V153, M172, L179, Y181, V183, V185, V216, V218 |
| 891 | Doublecortin domain-containing protein 2 | Q9UHG0 | I141, L143, I144, I158, V169, V173, L187, V195, Y207, V208, A209, V210, Y220 |
| 892 | DNA polymerase subunit gamma-2, mitochondrial (EC 2.7.7.7) | Q9UHN1 | L69, C73, F78, L79, L106, L110, W114, V118, V125, A130, L185, A189, L190, Y193, L197, Y206, L208, A209, C214, A237, L239, V240, W241, F242, W255, W262, W263, F266, F273, L289, F293, W295, I303, L303, L311, L322, V335, L336, V338, L342, M346, L347, A348, Y349, V371, L372, L374, L378, A379, V383, A384, L385, V387, L395, C399, L402, L406, L407, L418, I437, L438, V441, V443, I453, L471 |
| 893 | C-type lectin domain family 2 member D | Q9UHP7 | C86, F87, C103, A108, L110, A111, V113, L122, H131, W132, I133, L135, F155, C163, A164, L166, I183, C184 |
| 894 | Apolipoprotein | Q9UIR5 | W35, C60, C71 |
| 895 | Gap junction delta-2 protein | Q9UKL4 | C62 |
| 896 | Endoplasmic reticulum mannosyl-oligosaccharide 1,2-alpha-mannosidase (EC 3.2.1.113) | Q9UKM7 | V253, F257, A260, Y264, A268, L274, L287, L289, L291, I292, A294, L295, M298, A310, V314, L318, F320, V326, L328, I335, L336, L339, L340, A342, F351, A355, F358, L362, A365, I372, V377, I379, V395, I401, L403, F405, L408, F417, V421, V424, I428, L438, V439, I443, L458, A462, Y466, Y468, L470, I474, Y487, A490, I491, V494, L498, F509, V510, L513, M522, C527, L529, L533, A534, H545, L548, A549, L552, M553, C556, M559, L567, V572, V585, L596, V601, L604, F605, L607, Y616, I623, L624, I641, V644, M656, F660, L661, L665, Y667, L668, L670, L671, V685, F686, A690, H691, L693 |
| 897 | Disintegrin and metalloproteinase domain-containing protein 28 | Q9UKQ2 | C423, C434, C452, C453, C485 |
| 898 | Frizzled-4 | Q9ULV1 | I50, C53, A75, L79, L94, F97, L98, C99, V101, Y102, V103, C117, C121, V124, C128, L132, F135, L143 |
| 899 | Heat shock factor protein 4 | Q9ULV5 | L21, L24, L27, V28, I37, F46, V48, F54, V58, L59, F71, L75, F101, F106, L114, V117 |
| 900 | Neurogenic locus notch homolog protein 3 | Q9UM47 | C194, C428, C466, C504, C617, C884, C921, C1405, C1417, F1437, C1446, C1451, F1456, C1475, A1476, L1513, V1514, L1515, V1517, L1524, F1531, L1535, L1539, V1582, L1584, I1586, A1604, A1607, A1608, L1611, A1613 |
| 901 | Unconventional myosin-VI | Q9UM54 | A9, I31, A43, C63, L65, A71, L73, L74, I77, I86, V90, I93, L94, I95, A96, I103, I112, V127, F128, A129, I130, A131, A134, M138, V140, I147, I148, V149, A155, V164, Y167, L168, A185, L188, L189, A191, F192, A195, F206, F209, I212, F214, V220, I235, Y245, H246, I247, F248, Y249, L251, C252, L265, F271, Y273, L274, Y281, F282, I318, M320, M324, I327, L337, V340, V341, A342, V344, L345, L347, I350, L372, C375, A376, L378, L379, L381, L386, L390, A416, A419, A422, L423, A424, V427, Y428, L431, F432, V435, V436, V439, I452, V454, L455, F471, Y475, C476, L480, F483, |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| | | | F484, I488, L489, Y496, C514, I515, L517, I518, I525, I528, L529, F543, V547, F577, I578, I579, V586, Y588, F593, L605, I609, I617, L651, L654, L655, L658, F665, I666, C668, I669, I685, L689, M694, V697, L698, M701, Y705, A709, L714, Y718, Y721, L729, F734, C735, A737, L738, F739, L753, V756, F757, F758, F763, A764, I769, L777, L780, V784, I1171, F1180, A1204, H1205, F1206, A1212, M1215, L1226, V1227, M1235, L1245, F1258, W1262, L1271, A1274, I1275, A1280, A1285, L1289 |
| 902 | Rho GTPase-activating protein 26 | Q9UNA1 | A761, A763, L775, F783, V786, L795, I806 |
| 903 | Tumor necrosis factor ligand superfamily member 18 | Q9UNG2 | A82, F84, C100, V101, L109, I111, Y117, I119, V123, A124, V137, L139, Y140, I155, V158, L164, I170, L172, V180, W187, I189 |
| 904 | Protein unc-13 homolog A | Q9UPW8 | L1494, L1500 |
| 905 | Neuraminidase (EC 3.2.1.18)/strain A/Hong Kong/156/1997 H5N1 genotype Gs/Gd | Q9W7Y7 | I87, V95, V97, F102, I103, F113, F114, L115, L139, C142, A159, W160, A162, A164, C165, L172, I174, I176, A183, V184, A185, L187, L205, A213, C214, V215, F220, V222, M223, A232, Y234, I236, I239, V244, H256, Y257, C260, C262, Y263, A266, I269, C271, V272, C273, V285, F287, C299, V302, F303, F330, F332, Y334, V338, W339, I340, F352, M354, I355, F368, I374, I375, F387, I388, M399, C402, F403, W404, V405, L407, W418, I424, F426 |
| 906 | Hemagglutinin [Cleaved into: Hemagglutinin HA1 chain; Hemagglutinin HA2 chain]/strain A/Brevig Mission/1/1918 H1N1 (Influenza A virus (strain A/South Carolina/1/1918 H1N1)) | Q9WFX3 | V7, I20, C21, I22, A26, V33, V36, V43, L49, L50, L58, C59, L61, L67, L69, C72, I74, A75, W77, L78, L79, C84, L87, W93, Y95, I96, V97, C107, Y108, L118, L122, V125, F128, F134, A151, A152, C153, Y155, A158, L165, L166, W167, L168, Y175, L178, V190, L191, V192, L193, W194, V196, H197, H198, Y209, Y215, V216, V218, Y223, A233, M244, Y246, Y247, L250, L251, I257, F259, A261, L265, I266, A267, Y270, A271, F272, A273, L274, I282, I283, C292, C296, A302, I303, H313, I317, V324, L329, M331, A332, A349, M361, Y366, A388, I389, A440, L452, V459, L462, V466, L470, C481, H486, C488, C492, M493 |
| 907 | Genome polyprotein [Cleaved into: Core protein p21/genotype 1b (isolate Con1) (HCV) | Q9WMX2 | L754, V1061, L1070, A1071, C1073, V1074, V1077, C1078, W1079, V1081, A1085, I1097, L1108, V1109, L1120, L1130, L1132, I1140, V1142, V1158, L1161, L1169, C1171, A1176, V1177, I1179, F1180, A1190, A1192, V1193, F1195, V1196, V1198, M1201, Y1244, V1251, V1253, L1254, A1259, A1260, M1268, I1291, Y1293, Y1296, A1301, I1312, I1314, C1315, C1318, I1326, L1327, I1329, V1332, A1336, A1341, L1343, V1344, V1345, L1346, A1347, I1373, F1375, I1380, I1385, L1391, I1392, F1393, C1394, C1400, L1403, L1407, V1432, V1434, V1435, A1436, L1440, F1444, F1448, V1451, I1452, F1470, A1481, Y1499, L1517, C1518, C1520, Y1521, A1526, Y1528, L1539, Y1542, L1555, W1558, V1561, I1568, F1572, L1586, V1587, A1588, A1591, C1594, W1608, L1611, H1619, L1624, L1625, L1628, I1641, I1645, M2025, C2029, I2035, C2052, F2060, I2062, C2070, Y2090, V2091, V2093, V2102, M2105, F2122, V2128, F2147, L2160, L2440, L2449, L2450, V2456, Y2457, A2458, A2464, Y2483, V2486, M2490, A2492, A2494, V2497, A2499, A2507, C2508, Y2522, A2524, V2527, A2534, I2538, L2545, L2546, I2557, C2565, A2576, L2578, V2580, L2584, V2586, V2588, C2589, A2593, L2594, V2597, V2598, L2601, A2604, V2605, Y2610, V2620, L2623, A2626, M2634, F2636, Y2638, V2647, I2652, I2658, Y2659, C2661, C2662, A2665, A2668, A2671, I2672, L2675, L2679, Y2680, L2685, C2693, C2698, A2700, V2703, L2704, C2708, L2712, C2714, A2718, A2719, A2720, A2721, C2722, A2725, L2727, M2732, L2733, V2734, L2739, V2740, V2741, I2742, C2743, A2753, L2755, F2758, A2761, M2762, Y2765, A2767, I2782, V2789, A2792, Y2801, L2803, L2811, A2812, A2814, A2815, L2828, I2831, I2832, A2835, L2838, W2839, A2840, I2843, L2844, M2845, H2847, F2848, F2849, L2858, A2861, C2864, I2866, A2869, C2870, Y2871, I2873, L2876, L2878, I2881, I2882, L2885, A2890, F2891, V2904, A2905, C2907, L2908, L2911, V2913, V2918, W2919, A2923, V2926, L2930, L2931, A2937, A2938, C2940, L2944, F2945, A2948, A2960, A2961, F2970, A2972, Y2974, I2979 |
| 908 | Tumor necrosis factor ligand superfamily member 13B | Q9Y275 | L112, C146, L147, L149, V166, A177, L178, I185, V187, F193, F194, I195, Y196, V199, Y201, M208, H210, I212, L224, L226, M236, C245, A248, L253, L259, L261, A262, I263, A268, V276, F278, F279, A281, L282 |
| 909 | Cofilin-2 | Q9Y281 | V11, V14, M18, A35, V36, L37, F38, I47, I48, I55, V57, Y68, F71, V72, L75, C80, Y82, A83, L84, Y85, A87, V100, F101, W104, A109, Y117, I124, F128, V137, L149, L161 |
| 910 | Ragulator complex protein LAMTOR2 | Q9Y2Q5 | L11, L23, L24, L25, A42, A46, V81, A82, I83, L89, L90, L91, C92, M93, L104, A108 |

TABLE 5-continued

| TARGETS | | | |
|---|---|---|---|
| SEQ ID NO. | Protein Name/Strain | UniProt ID No. | Exemplified Sites of Mutations to Generate Peptidogenic Protein (Each position can be substituted alone or in any combination with any of the other listed amino acid positions.) |
| 911 | Kinesin-like protein KIF3A | Q9Y496 | V15, V17, V18, V19, I46, V48, V76, I85, V88, I96, A98, M110, I122, F127, I130, Y149, L150, I152, V157, L160, M195, H216, F224, I226, I235, L246, L248, V249, A252, L267, V283, I284, L302, L310, M318, C319, A320, I322, A325, L336, A339, A342, I345 |
| 912 | Neurexin-3 | Q9Y4C0 | F337, L576, L582, L585, F711, I824, F875, F896, L909, L949, L988, Y993, V1022, I1101, L1118, V1120, F1122, I1130, L1131, V1132, I1134, L1144, L1146, I1148, I1153, V1155, F1157, I1164, I1166, V1173, V1181, A1190, L1192, V1194, V1199, L1209, F1212, I1218, I1220, F1229, L1233, L1236, Y1238, V1243, L1244, V1260, V1266 |
| 913 | Dystrobrevin alpha | Q9Y4J8 | C258, L266, C270 |
| 914 | Kallikrein-4 (EC 3.4.21.—) | Q9Y5K2 | I31, A46, A47, L48, V59, L60, V66, L67, A69, C72, I79, L81, L83, A99, A114, L117, M118, L119, I132, I135, C148, V150, W153, V168, C178, C192, A193, L211, C213, L217, L220, V236, Y237, L240 |
| 915 | CD2-associated protein | Q9Y5K6 | Y4, V6, L18, I20, I26, L38, F49, V54, C113, V115, L127, L129, I135, F157, V162, C274, L288, F290, I296, F320, A325 |
| 916 | Brefeldin A-inhibited guanine nucleotide-exchange protein 2 | Q9Y6D5 | F654, A679, Y711, F722, A739, A769, I776, I822 |
| 917 | Cadherin-10 | Q9Y6N8 | L63, F102, I111, A113, I117, L127, A131, V147, I148, I150, V169, V182, I217, I218, V235, I237, A239, V255, I257, A293, F317, L346, V348, A350, V371, I373 |
| 918 | Tumor necrosis factor receptor superfamily member 11A | Q9Y6Q6 | C47, C50, A113, C114, C133 |

Example 4: Assays Measuring Alterations in Conformational Dynamics

Alterations in conformational dynamics can be measured by standard methods known in the art. In preferred embodiments, alterations in conformational dynamics can be shown by measuring changes in melting temperatures, in urea-induced equilibrium unfolding studies, and/or Gibbs free energy as compared to the starting protein.

Changes in melting temperature can be shown by the following protocol. For example, a peptidogenic protein (0.20 mg/ml) and a starting protein (as a control) is heated from 10° C. to 72° C. in a 0.1 cm quartz cuvette with a heating rate of 1 degree×min−1 controlled by a Jasco programmable Peltier element. The dichroic activity at 209 nm and the photomultiplier tube voltage (PMTV) are continuously monitored in parallel every 0.5° C. All the thermal scans are corrected for the solvent contribution at the different temperatures. Melting temperature (Tm) values are calculated by taking the first derivative of the ellipticity at 209 nm with respect to temperature. All denaturation experiments are performed in triplicate (see Lori et al., PLoS One, 5; 8(6):e64824 (2013)).

A change in urea-induced equilibrium unfolding can be shown by the following protocol. A peptidogenic protein (final concentration 40 ug/ml) and a starting protein (as a control) is incubated at 10° C. in increasing concentrations of urea (0-8 M) in 25 mM Tris/HCl, pH 7.5, in the presence of 0.2 M NaCl and 2 mM DTT (for non-disulfide containing proteins). After 10 min, equilibrium is reached and the intrinsic fluorescence emission, absorbance at 287 nm, and/or far-UV CD spectra (0.5-cm cuvette) are recorded in parallel at 10° C. To test the reversibility of the unfolding, a peptidogenic protein is unfolded at 10° C. in 7.0 M urea at 0.4 mg/ml protein concentration in 25 mM Tris/HCl, pH 7.5, in the presence of 2 mM DTT and 0.2 M NaCl. After 10 mM, refolding is started by 10-fold dilution of the unfolding mixture at 10° C. into solutions of the same buffer used for unfolding containing decreasing urea concentrations. The final protein concentration is 40 ug/ml. After an incubation period of 15 min to 24 h, the intrinsic fluorescence emission, absorbance at 287 nm, and/or the CD spectra are recorded as a function of urea concentration at 10° C. (see Lori et al., PLoS One, 5; 8(6):e64824 (2013)).

Alterations in Gibbs free energy can be shown by the following protocol. In order to measure Gibbs free energy, differential scanning calorimetry (DSC) experiments are performed on a VP-DSC (Microcal Inc., Northampton, Mass.) instrument at a scan rate of 1.5 deg/minute. Where possible, temperature-induced unfolding of a peptidogenic protein is checked for reversibility by comparing first and second DSC scans. It is understood that reversibility of folding and unfolding is not a requirement for the peptidogenic proteins described herein. The partial molar heat capacity of the protein, Cp,pr(T), is obtained from the experimentally measured apparent heat capacity difference between the sample (containing protein solution) and reference (containing corresponding buffer solution) cells, ΔC_p^app (T). Protein concentration is measured spectrophotometrically using a known molar extinction coefficient. Analysis of the heat capacity profiles according to a two-state model is done using non-linear regression routine NLREG and in-house written scripts. The standard thermodynamic functions under reference conditions are calculated as:

$$\Delta H_{cal}(T) = \Delta H(T_m) + \Delta C_p(T - T_m)$$

$$\Delta S(T) = \Delta S(T_m) + \Delta C_p \ln(T/T_m) = \frac{\Delta Hcal(Tm)}{Tm} + \Delta Cp\ln(T/Tm)$$

$$\Delta G(T) = (T_m - T)(\Delta H_{cal}(T_m)/T_m - \Delta C_p) - T\Delta C_p \ln(T/T_m)$$

Where ΔH(T), ΔS(T), and ΔG(T) are the enthalpy, entropy and Gibbs energy functions of a peptidogenic protein, respectively, ΔHcal is the enthalpy of unfolding at the transition temperature Tm, and ΔCp is the heat capacity of unfolding (see Loladze et al., J. Mol. Biol. 320, 343-357 (2002)).

Example 5: Assays Measuring Peptidogenicity

One of the intracellular conditions that may participate in processing of the peptidogenic proteins as described herein is proteolysis. The influence of the differential stability of the peptidogenic proteins on proteolysis can be determined using one of several in vitro or ex vivo assays.

(a) Cathepsin L Proteolysis

In one embodiment, examination of the behavior of the peptidogenic proteins toward proteolysis is measured by subjecting them to the action of cathepsin L, one of the enzymes known to be critical in protein antigen processing (Hsieh, C. S., deRoos, P., Honey, K., Beers, C., and Rudensky, A. Y. (2002) *J. Immunol.* 168, 2618-2625). Susceptibility of the peptidogenic proteins to proteolysis is assessed using lysosomal cathepsin L. The peptidogenic proteins (0.5 ug/ul) are incubated with various amounts (e.g., 1.5 munits) of enzyme in 50 mM sodium acetate buffer, pH 4.5, for various lengths of time at 37° C. Digestion is stopped using 0.1% TEA, and proteolysis is monitored by reversed-phase HPLC on C18 reverse phase columns (Vydac, Hesperia, CA). Elution of the proteolytic products is carried out with a linear gradient of acetonitrile/water containing 0.1% TEA.

(b) Proteolysis Using Alpha-Chymotrypsin and Carboxypeptidase Y

In another embodiment, examination of the behavior of the peptidogenic proteins toward proteolysis is measured by subjecting them to the action of alpha-chymotrypsin and carboxypeptidase Y. Alpha-chymotrypsin is an endopeptidase which cleaves at the carboxyl terminus of aromatic amino acids; carboxypeptidase Y is an exopeptidase which removes amino acids sequentially from the carboxyl terminus. Proteolytic digestion with these enzymes is specific for unstable conformations, hence, the conformational stability of the peptidogenic proteins determines their resistance/susceptibility to proteolytic digestion. The peptidogenic proteins at 1 mg/ml in 0.5 ml of 20 mM HEPES-buffered saline, pH 7.5, are incubated at 37° C. with 100 ug of alpha-chymotrypsin from bovine pancreas and carboxypeptidase Y from yeast. Each incubation is terminated at various time-points and the digested samples are stored at −20° C. until analyzed. Samples are analyzed by sodium dodecyl sulfate-polyacrylamide gel electrophoresis (SDS-PAGE), through a 15% acrylamide gel and under reducing conditions, then stained with Coomassie Brilliant Blue for visualization.

(c) Proteolysis Using Lysosomal Extracts

In another embodiment, examination of the behavior of the peptidogenic proteins toward proteolysis is measured by subjecting them to the action of lysosomal extracts of bone marrow-derived dendritic cells. The peptidogenic proteins are incubated at various concentrations in the presence of equal amounts of proteins from crude lysosomal extracts from bone marrow-derived dendritic cells. The mixtures are incubated in 0.1 M sodium citrate buffer, 0.5% Triton X-100, and 2 mM dithiothreitol at pH 4.5. Each incubation is terminated at various time-points and the digested samples are stored at −20° C. until analyzed. Samples are analyzed by SDS-PAGE. The experiments are repeated with and without prior adsorption of peptidogenic proteins onto an adjuvant such as aluminum hydroxide. Bone marrow-derived dendritic cells are purified with use of anti-CD11c microbeads from bone marrow cultured in granulocyte macrophage-colony stimulating factor. See, for example, Delamarre et al., FIG. 4.

(d) Proteolysis after Internalization by Bone Marrow-Derived Dendritic Cells

In another embodiment, examination of the behavior of the peptidogenic proteins toward proteolysis is measured by labeling them with FITC per the manufacturer's protocol, incubating bone marrow-derived dendritic cells with the FITC-proteins, and measuring the percentage of FITC+, CD11c+ cells over time. Bone marrow-derived dendritic cells are loaded with 0.5 mg/ml of the FITC-labeled peptidogenic proteins for 1 hour, are washed, and then are cultured at 37° C. for various amounts of time. FACS is then used to determine the percentage of FITC+, CD11c+ cells at each time point subtracted to the percentage of FITC+, CD11c+ cells at time 0 h. This represents the percentage of proteolysis of the peptidogenic proteins. The experiments are repeated with and without prior adsorption of FITC-labeled peptidogenic proteins onto an adjuvant such as aluminum hydroxide.

Example 6: Antibody Production and Sequencing

Ig-seq of antibody repertoires may follow previously described protocols (10, 29) with minor modifications. B cells can be isolated from the serum, spleen, or other tissues of hyperimmunized rabbits. In order to reduce the complexity of the sequencing library, this population can be sorted to enrich for $CD19^{+}CD3^{-}CD27^{+}CD38^{int}$ memory B cells or B cells that recognize the target antigen (5, 30, 31). These cells are then lysed and mRNA is isolated using standard methods, and reverse transcribed to cDNA using 5' RACE with 3' primers specific for the IgH or IgL constant region (9, 32). The cDNA library is then amplified with primers containing the required paired-end adapter sequences and optional barcodes to enable quantification of template and error correction by averaging multiple reads (8, 9).

Complete determination of antibody sequences requires identifying native VH-VL pairs. As each VH and VL sequence is encoded by a separate mRNA, clonal sequencing may be performed by isolating single B cells in sub-nanoliter volume wells (5) or microemulsion (9) prior to mRNA isolation, reverse transcription, and overlap extension or linkage PCR. As an alternative, endogenous VH-VL pairs can be identified through partial cross-linking of purified Fabs prior to LC-MS/MS. Under the appropriate conditions, this will result in a fraction of the Fab heavy and light chains forming interchain crosslinks, and the resulting peptide masses will be used to determine native pairing.

In order to identify the antibodies raised in response to a mixture of peptidogenic proteins, sequence information can be combined with data from high-resolution mass spectrometry. Protein A-purified IgGs can be digested with papain to release the two Fabs from the Fc domain. These can then be immunoaffinity purified on a custom column prepared using the peptidogenic protein immobilized on a solid support, the eluted Fabs proteolytically digested, and the peptide products subjected to mass spectrometry. The resulting peptide masses can be compared with the complete antibody sequencing data to identify the CDR sequences that recognize the antigen. Pairing of IgG VH and VL sequences can be accomplished through chemical cross-linking of the immunoaffinity purified Fabs prior to the proteolytic digest; Young et al have demonstrated the feasibility of this approach (33).

Example 7: Immunization Using a Mixture of Peptidogenic Proteins

Methods of raising antibodies in mammals are well known in the art. In one example, polyclonal antiserum against peptidogenic proteins is raised by immunization of pathogen free rabbits with a total of 500 μg of a mixture of peptidogenic proteins over a period of two months. For example, the peptidogenic proteins can be dissolved in PBS and emulsified with an equal volume of Freund's adjuvant. After the final booster, the serum of the rabbits can be separated to determine the titer of the polyclonal antiserum. To obtain monoclonal antibodies, 4-6 week old Balb/c mice can be immunized with a peptidogenic protein (for example 4 times with 2 week intervals with 10-100 μg/injection dissolved in Freunds complete adjuvant for the first injection, and Freund's incomplete adjuvant for subsequent immunizations). Splenocytes are isolated and fused with a fusion cell line such as Sp2/0 myeloma cells, followed by limiting dilution. Growing clones are screened using for example an enzyme-linked immunosorbant assay (ELISA). 96 cells plates are coated with peptidogenic proteins or with a control protein. The culture supernatant is added, followed by washing and addition of a labeled anti-mouse antibody for detection. After limited dilution cloning of the peptidogenic protein-specific antibody producing hybridomas stable hybridomas are obtained. From each cell, supernatant is collected and by affinity chromatography using protein A sepharose columns monoclonal antibodies can be purified.

Example 8: Another Example of Immunization Using a Mixture of Peptidogenic Proteins In an additional animal model, groups of 5 mice (C57BL/6J; Jackson Labs) can be subcutaneously immunized with 5 μg of endotoxin-free peptidogenic proteins emulsified in alum, which is the adjuvant most commonly used in human vaccines. Three weeks later, mice are bled and the presence of peptidogenic protein-specific antibodies can be determined by titering the seras by ELISA (direct binding of antibodies in sera to wild type BPTI or APP-KI coated, directly or indirectly (via a biotinylated tag and streptavidin), on the wells). To confirm that the peptidogenic proteins have a similar conformation as the starting protein, competitive inhibition assays are performed in which titrated amounts of starting protein and peptidogenic proteins are pre-incubated with the seras prior to adding to the starting protein coated plates. This provides additional evidence, with an immunological probe, that the 3D structure of the peptidogenic proteins has not been compromised by the engineered mutations.

To determine whether the peptidogenic proteins result in better secondary antibody responses, groups of mice can be immunized as described above, and 6 weeks after the primary immunization they can be immunized a second time. One week post-secondary immunization, mice are bled and antigen-specific antibody responses are determined by ELISA as described above. Mouse dendritic cells are pulsed in vitro with the peptidogenic proteins that can generate a strong antibody response, and 24 hrs later the peptidogenic protein-derived peptides presented by MHCII are isolated and their masses analysed by liquid chromatography and mass spectrometry (LC/MS). These studies require large numbers (>$10^7$) of dendritic cells which are purified from mice previously injected with a mouse tumor line expressing FLT-3L, a cytokine that drives dendritic cell development in vivo (the spleens of these mice fill up with dendritic cells; Segura et al, 2009). To allow for peak identification and the quantiifcation of MHCII-peptides by mass spectrometry, the peptidogenic protein can be biosynthetically labeled with stable isotopes such as 13C and 15N (during production of the recombinant protein—see above) prior to feeding to the DCs (Hoedt et al 2014).

Example 9: Immunization Using Sequences Encoding a Mixture of Peptidogenic Proteins Methods of directly injecting polynucleotides into animals are well described in the art. See, for example, U.S. Pat. Nos. 5,676,954; 6,875,748; 5,661,133. Briefly, using the known degeneracy of the genetic code, polynucleotides encoding a mixture of peptidogenic proteins described herein can be synthesized using standard DNA synthesis techniques. The polynucleotide(s) can then be directly injected into the animal, such as, for example, mice. Specifically, a mixture of polynucleotides encoding the mixture of peptidogenic proteins can be injected into the quadriceps muscles of restrained awake mice (female 6-12 week old BALB/c or Nude, nu/nu, from Harlan Sprague Dawley, Indianapolis, Ind.). In one embodiment, 50 μg of a polynucleotide in 50 μl solution using a disposable sterile, plastic insulin syringe and 28G ½ needle (Becton-Dickinson, Franklin Lakes, N.J., Cat. No. 329430) fitted with a plastic collar cut from a micropipette tip can be used to inject the mice, as described in Hartikka, J., et al., Hum. Gene Ther. 7:1205-1217 (1996)).

Alternatively, 6-week old Sprague Dawley female mice (body weight 20-25 grams) can be given 5000 ppm ZnOSO4 in their drinking water beginning 24 hours prior to injection. This amount of zinc has been shown to be able to activate the metallothionein promoter. Each mouse is then injected intravenously through a tail vein puncture with a 25 gauge needle with 30 μg of polynucleotides encoding the mixture of peptidogenic proteins complexed with 150 μg liposome (Lipofection TM) in a total volume of 30 μl. In one embodiment, the polynucleotides mixture injected into the mice encodes for different peptidogenic proteins relating to the same starting protein. Alternatively, a library of peptidogenic proteins can be encoded by the mixture of polynucleotides, wherein the library relates to different starting proteins. Animal care should be maintained throughout the study and should be performed in compliance with the "Guide for the Use and Care of Laboratory Animals", Institute of Laboratory Animal Resources, Commission on Life Sciences, National Research Council, National Academy Press.

After the injected polynucleotide encoding the peptidogenic proteins are delivered into the cells in the animal, the peptidogenic proteins are then expressed in vivo. The peptidogenic proteins can then stimulate the production of antibodies specific to the peptidogenic proteins. These antibodies can be isolated and used as a polyclonal mixture or further isolated into single species or monoclonals. The process of the immune response and production of antibodies against foreign antigens in vivo are well known in the art. Unlike the traditional protocols of antibody generation, the platform invention described herein allows the simultaneously raising of a group of antibodies against multiple peptidogenic proteins (whether or not they rely on the same starting protein). This simultaneous production of antibodies to multiple proteins using a mixture of polynucleotides has the potential to change how antibody production is currently being performed.

Example 10: Immunization Using mRNA Encoding Peptidogenic Proteins

The methods of directly injecting in vitro transcribed (IVT) mRNA into animals are also well known in the art. See, Sahin et al., Nat Rev Drug Discov. 2014 October; 13(10):759-80; Kariko et al., Mol Ther, 2008 November; 16(11):1833-40; Kariko et al., Nucleic Acid Res, 2011, November; 39(21):e142; U.S. Pat. No. 6,511,832. For example, linearized DNA plasmid templates which encode a mixture of peptidogenic proteins can be used. All mRNAs can be designed to contain 5' and 3' untranslated regions, the open reading frames, and long poly(A) tails, which can help determine the translational activity and stability of the mRNA molecule after its transfer into cells.

For example, mRNAs (including a poly(A) tail) encoding peptidogenic proteins can be synthesized using triphosphate-derivatives of pseudouridine and 5-methylcytidine (m5C) (TriLink) to generate a modified nucleoside containing RNA. A 5'-cap can be added to the mRNAs by supplementing the transcription reactions with 6 mmol/l 3'-O-Me-m7GpppG, a nonreversible cap analog (New England Biolabs, Beverly, Mass.) and lowering the concentration of guanosine triphosphate (3.75 mmol/1). Purification of the transcripts can be performed by Turbo DNase (Ambion, Austin, Tex.) digestion followed by LiCl precipitation and 75% ethanol wash. The concentrations of RNA reconstituted in water can be determined by measuring the optical density at 260 nm. Efficient incorporation of modified nucleotides to the transcripts can be determined by HPLC analyses. All RNA samples can be analyzed by denaturing agarose gel electrophoresis for quality assurance. Lipofectin (Invitrogen, Carlsbad, Calif.) and mRNA are then complexed in phosphate buffer in order to enhance transfection. To assemble a 50 μl complex of RNA-lipofectin, first 0.4 μl potassium phosphate buffer (0.4 mol/1, pH 6.2) containing 10 μg/bovine serum albumin (Sigma, St. Louis, Mo.) is added to 6.7 μl DMEM, then 0.8 μl lipofectin is mixed in and the sample is incubated for 10 minutes. In a separate tube, 0.25-3 μg of RNA is added to DMEM to a final volume of 3.3 μl. Diluted RNA is added to the lipofectin mix and incubated for 10 minutes. Finally, the RNA-lipofectin complex is further diluted by adding 38.8 μl DMEM.

The RNA encoding the peptidogenic proteins can then be injected into the mouse models described herein. In general, a composition comprising 60 μl final volume with 1 μl lipofectin and different amounts of polynucleotides encoding the peptidogenic proteins are injected into the lateral vein using a 1-ml syringe with a 27G½ needle (Becton Dickinson, San Diego, Calif.). Alternatively, the polynucleotides can be injected via intramuscular, intradermal, intranasal, subcutaneous, intravenous, intratracheal, and intrathecal deliveries. After the polynucleotides are delivered into the cells, the peptidogenic proteins are synthesized in vivo.

The immune responses triggered by the peptidogenic proteins and the subsequent production of antibodies in the animals are described herein.

Example 11: Affinity Maturing Antibodies to Peptidogenic Protein Using Phage Display Once antibodies have been raised to the peptidogenic proteins by presenting and allowing the peptidogenic protein to undergo processing by an antigen presenting cell such as described in the Examples herein, the resulting antibodies can be matured using a display approach. For example, a library of phage displaying scFvs or Fabs derived from B cell mRNA encoding the target-specific antibodies can be screened in an assay to identify those phage displaying scFvs or Fabs that immunospecifically bind to a peptidogenic protein or to a starting protein. Phage displaying scFvs or Fabs that bound to immobilized peptidogenic protein or starting protein can be identified after panning on immobilized peptidogenic protein or starting protein and assessing by ELISA for binding to immobilized peptidogenic protein or starting protein. The peptidogenic protein or starting protein that is immobilized on plates for these assays can be purified from supernatants of Sf9 cells infected with a baculovirus expression construct as described in Moore et al., Science 285:260-263 or from supernatants from HEK293 cells. Each of the identified scFvs or Fabs can then be sequenced.

To determine the specificity of each of the unique scFvs or Fabs, a phage ELISA can be performed for each scFvs or Fabs against the peptidogenic protein or starting protein and control wells. Individual *E. coli* colonies containing a phagemid representing one of the unique scFvs or Fabs can be inoculated into 96-well plates containing 100 μl 2TYAG medium per well. Plates are incubated at 37° C. for 4 hours, shaking. M13K07 helper phage is then added to each well to a MOI of 10 and the plates are incubated for a further 1 hour at 37° C. The plates are centrifuged in a benchtop centrifuge at 2000 rpm for 10 minutes. The supernatant is removed and cell pellets are resuspended in 100 μl 2TYAK and incubated at 30° C. overnight, shaking.

The next day, plates are centrifuged at 2000 rpm for 10 min and the 100 μl phage-containing supernatant from each well are carefully transferred into a fresh 96-well plate. Twenty μl of 6×MPBS is added to each well, and incubated at room temperature for 1 hour to pre-block the phage prior to ELISA.

Flexible 96-well plates (Falcon) are coated overnight at 4° C. with a peptidogenic protein (directly or indirectly, at 1 mg/ml) in PBS, BSA (1 g/ml) in PBS, or PBS. After coating, the solutions are removed from the wells, and the plates are blocked for 1 hour at room temperature in MPBS. The plates are washed 3 times with PBS and then 50 μl of pre-blocked phage is added to each well. The plates are incubated at room temperature for 1 hour and then washed with 3 changes of PBST followed by 3 changes of PBS. To each well, 50 μl of an anti-gene VIII-HRP conjugate (Pharmacia) at a 1 to 5000 dilution in MPBS is added and the plates are incubated at room temperature for 1 hour. Each plate is washed three times with PBST followed by three times with PBS. Then 50 μl of an HRP-labelled anti-mouse antibody (DAKO EnVision) diluted 1/50 in 3% MPBS is added and incubated for 1 hour at room temperature. Each plate is then washed three times with PBST followed by three times with PBS. Fifty μl of TMB substrate is then added to each well, and incubated at room temperature for 30 minutes or until color development. The reaction is stopped by the addition of 25 μl of 0.5 M H2SO4. The signal generated is measured by reading the absorbance at 450 nm (A450) using a microtiter plate reader (Bio-Rad 3550).

Conversion of scFvs or Fabs to IgG1 format can be performed as follows. The VH domain and the VL domains of scFvs or Fabs that we wish to convert into IgG molecules can be cloned into vectors containing the nucleotide sequences of the appropriate heavy (human IgG1, IgG2, etc.) or light chain (human kappa or human lambda) constant regions such that a complete heavy or light chain molecule could be expressed from these vectors when transfected into an appropriate host cell. Further, when cloned heavy and light chains are both expressed in one cell line (from either one or two vectors), they can assemble into a complete functional antibody molecule that is secreted into the cell culture medium. Methods for converting scFvs or Fabs into conventional antibody molecules are well known within the art.

The purification of the IgG from the fermentation broth is performed using a combination of conventional techniques commonly used for antibody production. Typically the culture harvest is clarified to remove cells and cellular debris prior to starting the purification scheme. This would normally be achieved by using either centrifugation or filtration of the harvest. Following clarification, the antibody would typically be captured and significantly purified using affinity chromatography on Protein A Sepharose. The antibody is bound to Protein A Sepharose at basic pH and, following washing of the matrix, is eluted by a reduction of the pH. Further purification of the antibody is then achieved by gel filtration. As well as removing components with different molecular weights from the antibody this step can also be used to buffer exchange into the desired final formulation buffer.

Example 12: Assays Used to Characterize Antibodies and Measure Cross-Reactivity

Antibodies (whether cross-reacting or antibodies raised against the peptidogenic protein) (including scFvs or Fabs and other molecules comprising, or alternatively consisting of, antibody fragments or variants thereof) may be screened in a variety of assays, some of which are described below to identify those antibodies that bind to the peptidogenic protein and/or starting protein.

In one particular assay, antibodies (whether cross-reacting or antibodies raised against the peptidogenic protein) that bind to a biotinylated protein (whether the peptidogenic protein and/or starting protein) can be captured on streptavidin coated magnetic beads. This assay may be applied to identify antibodies (whether cross-reacting or antibodies raised against the peptidogenic protein) that neutralize and/or bind to the peptidogenic protein and/or starting protein. Additionally, antibodies may be assayed in neutralization assays described herein or otherwise known in the art. For example, where the target protein is BlyS, antibodies may be tested for their ability to inhibit the peptidogenic protein and/or starting protein from binding to IM9 cells. In this assay, labeled peptidogenic protein and/or starting protein (e.g., biotinylated) is incubated with antibodies to allow for the formation of protein-antibody complexes. Following incubation, an aliquot of the protein-antibody sample is added to IM9 cells. Binding may be determined using techniques known in the art. For example, the binding of biotinylated protein (whether the peptidogenic protein and/or starting protein) to IM9 cells may be detected using a fluorimeter following the addition of streptavidin-delfia.

Biotinylated protein, if it is not bound by antibodies that neutralize the protein, will bind to the cells and can be detected. Thus, an antibody that decreases the amount of biotinylated-protein that binds to IM9 cells (relative to a control sample in which the protein had been preincubated with an irrelevant antibody or no antibody at all) is identified as one that binds to and neutralizes the protein.

Other immunoassays which can be used to analyze cross-reactivity and/or characterize the antibodies raised against the peptidogenic protein include, but are not limited to, competitive and non-competitive assay systems using techniques such as western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al, eds, 1994, Current Protocols in Molecular Biology, Vol. 1, John Wiley & Sons, Inc., New York.

Exemplary immunoassays are described briefly below (but are not intended by way of limitation) Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the cross-reacting antibody of interest to the cell lysate, incubating for a period of time (e.g., 1 to 4 hours) at 4° C., adding protein A and/or protein G sepharose beads to the cell lysate, incubating for about an hour or more at 4° C., washing the beads in lysis buffer and resuspending the beads in SDS/sample buffer. The ability of the antibody of interest to immunoprecipitate a peptidogenic protein and/or a starting protein can be assessed by, e.g., western blot analysis or mass spectrometry. One of skill in the art would be knowledgeable as to the parameters that can be modified to increase the binding of the antibody to a peptidogenic protein and/or a starting protein and decrease the background (e.g., pre-clearing the cell lysate with sepharose beads). For further discussion regarding immunoprecipitation protocols see, e.g., Ausubel et al, eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., 32P or 1211) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

In a further example, ELISAs comprise preparing peptidogenic protein and/or a starting protein, coating the well of a 96-well microtiter plate (directly or indirectly) with the peptidogenic protein and/or a starting protein, washing away the peptidogenic protein and/or a starting protein that did not bind the wells, adding the antibody of interest conjugated to a detectable compound such as an enzymatic substrate (e.g., horseradish peroxidase or alkaline phosphatase) to the wells and incubating for a period of time, washing away unbound antibodies or non-specifically bound antibodies, and detecting the presence of the antibodies specifically bound to the peptidogenic protein and/or a starting protein coating the well. In ELISAs the antibody of interest does not have to be conjugated to a detectable compound; instead, a second antibody (which recognizes the antibody of interest) conjugated to a detectable compound may be added to the well.

Further, instead of coating the well with the antigen, the antibody may be coated to the well. In this case, the detectable molecule could be the peptidogenic protein and/or a starting protein conjugated to a detectable compound such as an enzymatic substrate (e.g., horseradish peroxidase or alkaline phosphatase). One of skill in the art would be knowledgeable as to the parameters that can be modified to increase the signal detected as well as other variations of ELISAs known in the art. For further discussion regarding ELISAs see, e.g., Ausubel et al, eds, 1994, Current Protocols in Molecular Biology, Vol. 1, John Wiley & Sons, Inc., New York at 11.2.1. The binding affinity of an antibody to a peptidogenic protein and/or a starting protein and the off-rate of an antibody-protein interaction can be determined by competitive binding assays. One example of a competitive binding assay is a radioimmunoassay comprising the incubation of labeled peptidogenic protein and/or a starting protein (e.g., 3H or 1251) with the antibody of interest in the presence of increasing amounts of unlabeled peptidogenic protein and/or a starting protein, and the detection of the antibody bound to the labeled peptidogenic protein and/or a starting protein. The affinity of the antibody of the present invention for a peptidogenic protein and/or the starting protein and the binding off-rates can be determined from the data by Scatchard plot analysis. Competition with a second antibody can also be determined using radioimmunoassays. In this case, a peptidogenic protein and/or starting protein is incubated with an antibody of interest conjugated to a labeled compound (e.g., 3H or 1251) in the presence of increasing amounts of an unlabeled second anti-peptidogenic protein antibody.

In a preferred embodiment, BIAcore kinetic analysis can be used to determine the binding on and off rates of antibodies to peptidogenic protein and/or starting protein. BIAcore kinetic analysis comprises analyzing the binding and dissociation of peptidogenic protein and/or starting protein from chips with immobilized antibodies on their surface.

Example 13: Vaccination

Further, a mixture of peptidogenic proteins as described herein can be used as a vaccine. For example a concentration of 320 ug/mL in phosphate-buffered saline (PBS, 155 mM NaCl, 1 mM KH2PO4, 3 mM Na2HPO3) of the peptidogenic proteins are aseptically emulsified with an equal volume of Montanide ISA 51 to give a final vaccine concentration of 160 ug/mL. The emulsion is achieved by homogenizing the mixture in a volume of 200 mL in a 400-mL vessel at room temperature for 6 min at 6000 rpm using an Omni Mixer-ES homogenizer (Omni International, Warren-ton, VA). Each vaccine undergoes comprehensive quality control analyses to ensure general safety, purity, identity, integrity, and uniform water-in-oil droplet size. Stability of vaccines stored at 2-8° C. is evaluated regularly using mouse immunogenicity tests and physical and biochemical assays to verify the vaccine safety, potency, uniformity, purity, and integrity until 4-10 months after the termination of the human immunizations. The 160 ug/mL peptidogenic protein vaccines are diluted with the PBS/ISA 51 (the adjuvant control vaccine) to the final dose forms of 10 ug/mL or 40 ug/mL prior to immunizations. As a result of different degrees of dilution, these vaccines contained two different ratios of vaccine-containing vs. vaccine-free water droplets, namely ratios of 1:15 and 1:3 for the 10 ug/mL and 40 ug/mL formulations, respectively. The test and control vaccines may be highly viscous and require vortexing prior to and after manipulation to ensure homogeneity. The vaccine can be administered intramuscularly by needle and syringe. Vaccine-induced T-cell responses are further evaluated by means of a qualified intracellular cytokine staining assay. Peripheral-blood mononuclear cells are quantified to determine the proportion of total and memory CD4 and CD8 T cells producing interleukin-2, interferon-γ, or tumor necrosis factor (TNF).

Polynucleotides encoding a mixture of peptidogenic proteins can also be used as a vaccine by administering to a patient the polynucleotide described herein.

LITERATURE CITED

1. Starner N, et al., The Protein Capture Reagents Program Data Portal. (Submitted). 2014.
2. Paduch M, et al., Methods. 2013; 60(1):3-14. doi: 10.1016/j.ymeth.2012.12.010.
3. Acton T B, et al., Methods in Enzymology: Academic Press; 2005. p. 210-43.
4. Xiao R, et al., Journal of structural biology. 2010; 172(1):21-33.
5. DeKosky B J, Nat Biotech. 2013; 31(2):166-9. doi: 10.1038/nbt.2492.
6. Naso and Panavas, Current drug discovery technologies. 2014; 11(1):85-95. Epub 2013/09/12. PubMed PMID: 24020911.
7. Reddy S T et al. Current Opinion in Biotechnology. 2011; 22(4):584-9.
8. Vollmers C, et al., Proceedings of the National Academy of Sciences. 2013; 110(33):13463-8. doi: 10.1073/pnas.1312146110.
9. Georgiou G, et al., Nat Biotech. 2014; 32(2):158-68. doi: 10.1038/nbt.2782.
10. Sato S, et al., Nat Biotechnol. 2012; 30(11):1039-43. Epub 2012/11/10. doi: 10.1038/nbt.2406. PubMed PMID: 23138294.
11. Dobson C M. Nature. 2003; 426(6968):884-90.
12. Bowie, and Sauer Biochemistry. 1989; 28(18):7139-43. doi: 10.1021/bi00444a001.
13. Milla M E, et al., Nat Struct Mol Biol. 1994; 1(8):518-23.
14. Waldburger C D, et al., Nat Struct Mol Biol. 1995; 2(2):122-8.
15. Ascenzi P, et al., Current Protein and Peptide Science. 2003; 4(3):231-51. doi: 10.2174/1389203033487180.
16. Marks C, et al., Science. 1987; 235(4794):1370-3. doi: 10.1126/science.2435002.
17. Nilsson B et al., Journal of Biological Chemistry. 1991; 266(5):2970-7.
18. Betz S F, Protein Science. 1993; 2(10):1551-8. doi: 10.1002/pro.5560021002.
19. Eigenbrot and Kossiakoff, Protein Engineering. 1990; 3(7):591-8. doi: 10.1093/protein/3.7.591.
20. Hurle et al., Biochemistry. 1990; 29(18):4410-9. doi: 10.1021/bi00470a021.
21. Krokoszynska I, et al., Journal of Molecular Biology. 1998; 275(3):503-13. doi: 10.1006/jmbi.1997.1460.
22. Staley J P et al., Proceedings of the National Academy of Sciences. 1992; 89(5):1519-23. doi: 10.1073/pnas.89.5.1519.
23. Castro M J M et al., Biochemistry. 1996; 35(35):11435-46. doi: 10.1021/bi960515w.
24. Altman J D, et al., Protein Engineering. 1991; 4(5):593-600. doi: 10.1093/protein/4.5.593.
25. Cull and Schatz, Methods Enzymol. 2000; 326:430-40. Epub 2000/10/19. PubMed PMID: 11036656.
26. Fiorucci L et al., Histochem J. 1989; 21(12):721-30. doi: 10.1007/BF01002838.
27. Nori S L, et al., Peptides. 1992; 13(2):365-71. doi: http://dx.doi.org/10.1016/0196-9781(92)90122-J.
28. Savage M J, et al., Amyloid. 1995; 2(4):234-40. doi: doi:10.3109/13506129508999005.
29. Cheung W C et al., Nat Biotechnol. 2012; 30(5):447-52. Epub 2012/03/27. doi: 10.1038/nbt.2167. PubMed PMID: 22446692.
30. Kaminski D A et al., Frontiers in immunology. 2012; 3:302. Epub 2012/10/23. doi: 10.3389/fimmu.2012.00302. PubMed PMID: 23087687; PubMed Central PMCID: PMCPmc3467643.
31. Maecker H T et al., Nature reviews Rheumatology. 2012; 8(6):317-28. Epub 2012/06/01. doi: 10.1038/nrrheum.2012.66. PubMed PMID: 22647780; PubMed Central PMCID: PMCPmc3409841.
32. Toung J M et al., Genome research. 2011; 21(6):991-8. doi: 10.1101/gr.116335.110.
33. Young M M et al., Proceedings of the National Academy of Sciences. 2000; 97(11):5802-6. doi: 10.1073/pnas.090099097.
34. Goh C S et al., Nucleic Acids Research. 2003; 31(11): 2833-8. doi: 10.1093/nar/gkg397.
35. Glanville J, et al., Proceedings of the National Academy of Sciences. 2009; 106(48):20216-21. doi: 10.1073/pnas.0909775106.
36. Brochet X et al., Nucleic Acids Res. 2008; 36(Web Server issue):W503-8. Epub 2008/05/27. doi: 10.1093/nar/gkn316. PubMed PMID: 18503082; PubMed Central PMCID: PMCPmc2447746.
37. D'Angelo S., et al., mAbs. 2014; 6(1):160-72. Epub 2014/01/16. doi: 10.4161/mabs.27105. PubMed PMID: 24423623; PubMed Central PMCID: PMCPmc3929439.
38. Eng J K et al., Journal of the American Society for Mass Spectrometry. 1994; 5(11):976-89. doi: http://dx.doi.org/10.1016/1044-0305(94)80016-2.
39. Van Regenmortel MHV. Journal of Molecular Recognition. 2011; 24(5):741-53. doi: 10.1002/jmr.1116.

SEQUENCE LISTING (925 sequences)

SEQ ID NO: 1 - protein, 566 aa, Influenza A virus
  strain A/USA:Phila/1935 H1N1
  SITE (7)..(7): Xaa at position 7 is Val, Ala, Gly, Leu, or Ile
  SITE (20)..(20): Xaa at position 20 is Ile, Ala, Val, Leu, or Gly
  SITE (21)..(21): Xaa at position 21 is Cys, Ala, Val, Gly, Ser, or Thr
  SITE (22)..(22): Xaa at position 22 is Ile, Ala, Val, Leu, or Gly
  SITE (26)..(26): Xaa at position 26 is Ala, Gly, or Pro
  SITE (33)..(33): Xaa at position 33 is Val, Ala, Gly, Leu, or Ile
  SITE (36)..(36): Xaa at position 36 is Val, Ala, Gly, Leu, or Ile
  SITE (43)..(43): Xaa at position 43 is Val, Ala, Gly, Leu, or Ile
  SITE (49)..(49): Xaa at position 49 is Leu, Ala, Val, Gly, or Ile
  SITE (50)..(50): Xaa at position 50 is Leu, Ala, Val, Gly, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (61)..(61): Xaa at position 61 is Leu, Ala, Val, Gly, or Ile
  SITE (67)..(67): Xaa at position 67 is Leu, Ala, Val, Gly, or Ile
  SITE (69)..(69): Xaa at position 69 is Leu, Ala, Val, Gly, or Ile
  SITE (72)..(72): Xaa at position 72 is Cys, Ala, Val, Gly, Ser, or Thr
  SITE (74)..(74): Xaa at position 74 is Ile, Ala, Val, Leu, or Gly
  SITE (75)..(75): Xaa at position 75 is Ala, Gly, or Pro
  SITE (77)..(77): Xaa at position 77 is Trp, Tyr, Phe, Met, His, Ile, Leu Val, Ala, or Gly
  SITE (78)..(78): Xaa at position 78 is Leu, Ala, Val, Gly, or Ile
  SITE (79)..(79): Xaa at position 79 is Leu, Ala, Val, Gly, or Ile
  SITE (84)..(84): Xaa at position 84 is Cys, Ala, Val, Gly, Ser, or Thr
  SITE (87)..(87): Xaa at position 87 is Leu, Ala, Val, Gly, or Ile
  SITE (93)..(93): Xaa at position 93 is Trp, Tyr, Phe, Met, His, Ile, Leu Val, Ala, or Gly
  SITE (95)..(95): Xaa at position 95 is Tyr, Phe, Met, His, Ile, Leu, Val Ala, or Gly
  SITE (96)..(96): Xaa at position 96 is Ile, Ala, Val, Leu, or Gly
  SITE (97)..(97): Xaa at position 97 is Val, Ala, Gly, Leu, or Ile
  SITE (108)..(108): Xaa at position 108 is Tyr, Phe, Met, His, Ile, Leu, Val Ala, or Gly
  SITE (118)..(118): Xaa at position 118 is Leu, Ala, Val, Gly, or Ile
  SITE (122)..(122): Xaa at position 122 is Leu, Ala, Val, Gly, or Ile
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (134)..(134): Xaa at position 134 is Phe, Tyr, Met, His, Ile, Leu, Val Ala, or Gly
  SITE (151)..(151): Xaa at position 151 is Ala, Gly, or Pro
  SITE (152)..(152): Xaa at position 152 is Ala, Gly, or Pro
  SITE (153)..(153): Xaa at position 153 is Cys, Ala, Val, Gly, Ser, or Thr
  SITE (155)..(155): Xaa at position 155 is His, Phe, Tyr, Lys, Arg, Gly, Ser Thr, Ala, Val, Leu, Ile, Asn, Met, or Gln
  SITE (165)..(165): Xaa at position 165 is Leu, Ala, Val, Gly, or Ile
  SITE (166)..(166): Xaa at position 166 is Leu, Ala, Val, Gly, or Ile
  SITE (167)..(167): Xaa at position 167 is Trp, Tyr, Phe, Met, His, Ile, Leu Val, Ala, or Gly
  SITE (168)..(168): Xaa at position 168 is Leu, Ala, Val, Gly, or Ile
  SITE (178)..(178): Xaa at position 178 is Leu, Ala, Val, Gly, or Ile
  SITE (190)..(190): Xaa at position 190 is Val, Ala, Gly, Leu, or Ile
  SITE (191)..(191): Xaa at position 191 is Leu, Ala, Val, Gly, or Ile
  SITE (192)..(192): Xaa at position 192 is Val, Ala, Gly, Leu, or Ile
  SITE (193)..(193): Xaa at position 193 is Leu, Ala, Val, Gly, or Ile
  SITE (194)..(194): Xaa at position 194 is Trp, Tyr, Phe, Met, His, Ile, Leu Val, Ala, or Gly
  SITE (196)..(196): Xaa at position 196 is Val, Ala, Gly, Leu, or Ile
  SITE (197)..(197): Xaa at position 197 is His, Phe, Tyr, Lys, Arg, Gly, Ser Thr, Ala, Val, Leu, Ile, Asn, Met, or Gln
  SITE (198)..(198): Xaa at position 198 is His, Phe, Tyr, Lys, Arg, Gly, Ser Thr, Ala, Val, Leu, Ile, Asn, Met, or Gln
  SITE (209)..(209): Xaa at position 209 is Tyr, Phe, Met, His, Ile, Leu, Val Ala, or Gly
  SITE (215)..(215): Xaa at position 215 is Tyr, Phe, Met, His, Ile, Leu, Val Ala, or Gly
  SITE (216)..(216): Xaa at position 216 is Val, Ala, Gly, Leu, or Ile
  SITE (218)..(218): Xaa at position 218 is Val, Ala, Gly, Leu, or Ile
  SITE (219)..(219): Xaa at position 219 is Val, Ala, Gly, Leu, or Ile
  SITE (223)..(223): Xaa at position 223 is Tyr, Phe, Met, His, Ile, Leu, Val Ala, or Gly
  SITE (244)..(244): Xaa at position 244 is Met, Ile, Leu, Val, Ala, or Gly
  SITE (246)..(246): Xaa at position 246 is Tyr, Phe, Met, His, Ile, Leu, Val Ala, or Gly
  SITE (247)..(247): Xaa at position 247 is Tyr, Phe, Met, His, Ile, Leu, Val Ala, or Gly
  SITE (250)..(250): Xaa at position 250 is Leu, Ala, Val, Gly, or Ile
  SITE (251)..(251): Xaa at position 251 is Leu, Ala, Val, Gly, or Ile
  SITE (257)..(257): Xaa at position 257 is Ile, Ala, Val, Leu, or Gly
  SITE (259)..(259): Xaa at position 259 is Phe, Tyr, Met, His, Ile, Leu, Val Ala, or Gly
  SITE (261)..(261): Xaa at position 261 is Ala, Gly, or Pro
  SITE (265)..(265): Xaa at position 265 is Leu, Ala, Val, Gly, or Ile
  SITE (266)..(266): Xaa at position 266 is Ile, Ala, Val, Leu, or Gly
  SITE (267)..(267): Xaa at position 267 is Ala, Gly, or Pro
  SITE (270)..(270): Xaa at position 270 is Tyr, Phe, Met, His, Ile, Leu, Val Ala, or Gly
  SITE (271)..(271): Xaa at position 271 is Ala, Gly, or Pro
  SITE (272)..(272): Xaa at position 272 is Phe, Tyr, Met, His, Ile, Leu, Val Ala, or Gly
  SITE (273)..(273): Xaa at position 273 is Ala, Gly, or Pro
  SITE (274)..(274): Xaa at position 274 is Leu, Ala, Val, Gly, or Ile
  SITE (278)..(278): Xaa at position 278 is Phe, Tyr, Met, His, Ile, Leu, Val Ala, or Gly
  SITE (282)..(282): Xaa at position 282 is Ile, Ala, Val, Leu, or Gly
  SITE (283)..(283): Xaa at position 283 is Ile, Ala, Val, Leu, or Gly
  SITE (292)..(292): Xaa at position 292 is Cys, Ala, Val, Gly, Ser, or Thr
  SITE (296)..(296): Xaa at position 296 is Cys, Ala, Val, Gly, Ser, or Thr
  SITE (302)..(302): Xaa at position 302 is Ala, Gly, or Pro
  SITE (303)..(303): Xaa at position 303 is Ile, Ala, Val, Leu, or Gly
  SITE (313)..(313): Xaa at position 313 is His, Phe, Tyr, Lys, Arg, Gly, Ser Thr, Ala, Val, Leu, Ile, Asn, Met, or Gln
  SITE (317)..(317): Xaa at position 317 is Ile, Ala, Val, Leu, or Gly
  SITE (324)..(324): Xaa at position 324 is Val, Ala, Gly, Leu, or Ile
  SITE (329)..(329): Xaa at position 329 is Leu, Ala, Val, Gly, or Ile
  SITE (331)..(331): Xaa at position 331 is Met, Ile, Leu, Val, Ala, or Gly
  SITE (332)..(332): Xaa at position 332 is Val, Ala, Gly, Leu, or Ile
  SITE (349)..(349): Xaa at position 349 is Ala, Gly, or Pro
  SITE (361)..(361): Xaa at position 361 is Met, Ile, Leu, Val, Ala, or Gly
  SITE (366)..(366): Xaa at position 366 is Tyr, Phe, Met, His, Ile, Leu, Val Ala, or Gly
  SITE (388)..(388): Xaa at position 388 is Ala, Gly, or Pro
  SITE (389)..(389): Xaa at position 389 is Ile, Ala, Val, Leu, or Gly
  SITE (440)..(440): Xaa at position 440 is Ala, Gly, or Pro
  SITE (452)..(452): Xaa at position 452 is Leu, Ala, Val, Gly, or Ile
  SITE (459)..(459): Xaa at position 459 is Val, Ala, Gly, Leu, or Ile
  SITE (462)..(462): Xaa at position 462 is Leu, Ala, Val, Gly, or Ile
  SITE (466)..(466): Xaa at position 466 is Val, Ala, Gly, Leu, or Ile
  SITE (470)..(470): Xaa at position 470 is Leu, Ala, Val, Gly, or Ile
  SITE (481)..(481): Xaa at position 481 is Cys, Ala, Val, Gly, Ser, or Thr
  SITE (486)..(486): Xaa at position 486 is His, Phe, Tyr, Lys, Arg, Gly, Ser Thr, Ala, Val, Leu, Ile, Asn, Met, or Gln
  SITE (488)..(488): Xaa at position 488 is Cys, Ala, Val, Gly, Ser, or Thr
  SITE (492)..(492): Xaa at position 492 is Cys, Ala, Val, Gly, Ser, or Thr
  SITE (493)..(493): Xaa at position 493 is Met, Ile, Leu, Val, Ala, or Gly
MKARLLXLLCALAAADADTXXXGYHXNNSTDTXDTXLEKNVTXTHSVNXXEDSHNGKXXRXKGIPPXQXGKXNXXGXXXGNPEXDSXLPARSXSXXXETPNSENGACXPGDFINYEEXREQXSSXSSXERFEIXPKESSWPKHNTTKGVTXXXSXAGKSSFYRNXXXXTKKEDSYPKXKNSYVNKKGKEXXXXXGXXXPSSSKEQQTLXQNENAXXSXXSSNXNRRFTPEIAERPKVRDQTGRXNXXWTXXEPGDTXIXEXNGNXXXPWXXXXXSRGXGSGXXTSNASMHEXNTKXQTPQGXXNSSLPFQNIXPVTXGECPKYXRSAKXRXXTGLRNIPSIQSRGLFGXIAGFIEGGWTGXIDGWXGYHHQNEQGSGYAADQKSTQNXXNGITNKVNSVIEKMNTQFTAVGKEFNNLEKRMENLNKKVDDGFLDIWTYNXELLVLLENERTXDFHDSNXKNXYEKXKSQXKNNAKEIGNGXFEFYXKXDNEXXESVRNGTYDYPKYSEESKLNREKIDGVKLESMGVYQILAIYSTVASSLVLLVSLGAISFWMCSNGSLQCRICI

SEQ ID NO: 2 - protein, 692 aa, Pan paniscus
  SITE (80)..(80): Xaa at position 80 is Val, Ala, Gly, Leu, or Ile
  SITE (95)..(95): Xaa at position 95 is Ala, Gly, or Pro
  SITE (98)..(98): Xaa at position 98 is Leu, Ala, Val, Gly, or Ile
  SITE (102)..(102): Xaa at position 102 is Ala, Gly, or Pro
  SITE (122)..(122): Xaa at position 122 is Phe, Tyr, Met, His, Ile, Leu, Val Ala, or Gly
  SITE (124)..(124): Xaa at position 124 is Val, Ala, Gly, Leu, or Ile
  SITE (134)..(134): Xaa at position 134 is Ala, Gly, or Pro
  SITE (143)..(143): Xaa at position 143 is Ile, Ala, Val, Leu, or Gly
MGTVSSRRSWWPLPLLLLLLLLLGPAGARAQEDEDGDYEELVLALRSEEDGLAEAPEHGTTATFHRCAKDPWRLPGTYVXVLKEETHLSQSERTXRRXQAQXAHRGYLTKILHVFHGLLPGXLXKMSGDLLELXLKLPHVDYXEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVRPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEAGMGTRVHCHQQGHVLTGCSSHWEVEDLGTHKPPVLRPRGQPNQCVGHREASIHASCCRAPGLECKVKEHGIPAPQEQVTVACEEGWTLTGCSALPGTSHVLGAYAVDNTCVVRNRDVSTAGSTSEEAVAAVAICCRSRHLAQASQELQ

SEQ ID NO: 3 - protein, 810 aa, Homo sapiens
  SITE (193)..(193): Xaa at position 193 is Tyr, Phe, Met, His, Ile, Leu, Val Ala, or Gly
  SITE (209)..(209): Xaa at position 209 is Trp, Tyr, Phe, Met, His, Ile, Leu Val, Ala, or Gly
  SITE (234)..(234): Xaa at position 234 is Cys, Ala, Val, Gly, Ser, or Thr
  SITE (244)..(244): Xaa at position 244 is Trp, Tyr, Phe, Met, His, Ile, Leu Val, Ala, or Gly
  SITE (245)..(245): Xaa at position 245 is Cys, Ala, Val, Gly, Ser, or Thr
  SITE (246)..(246): Xaa at position 246 is Phe, Tyr, Met, His, Ile, Leu, Val Ala, or Gly
  SITE (257)..(257): Xaa at position 257 is Cys, Ala, Val, Gly, Ser, or Thr
  SITE (259)..(259): Xaa at position 259 is Ile, Ala, Val, Leu, or Gly
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENXDGKISKTMSGLECQAXDSQSPHAHGYIPSKFPNKNLKKNYXRNPDRELRPXXXTTDPNKRWELXDXPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTANPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 4 - protein, 205 aa, Homo sapiens
  SITE (80)..(80): Xaa at position 80 is Val, Ala, Gly, Leu, or Ile
  SITE (98)..(98): Xaa at position 98 is Leu, Ala, Val, Gly, or Ile
  SITE (102)..(102): Xaa at position 102 is Ala, Gly, or Pro
  SITE (122)..(122): Xaa at position 122 is Phe, Tyr, Met, His, Ile, Leu, Val Ala, or Gly
  SITE (124)..(124): Xaa at position 124 is Val, Ala, Gly, Leu, or Ile
  SITE (134)..(134): Xaa at position 134 is Ala, Gly, or Pro
  SITE (143)..(143): Xaa at position 143 is Ile, Ala, Val, Leu, or Gly
MGTVSSRRSWWPLPLLLLLLLLLGPAGARAQEDEDGDYEELVLALRSEEDGLAEAPEHGTTATFHRCAKDPWRLPGTYVXVLKEETHLSQSERTARRXQAQXARRGYLTKILHVFHGLLPGXLXKMSGDLLELXLKLPHVDYXEEDSSVFAQSIPWNLERITPPRYRADEYQPPAYLEDHCGGHRGAVQMALQKTQETLGQEQFD

SEQ ID NO: 5 - protein, 979 aa, Homo sapiens
  SITE (474)..(474): Xaa at position 474 is Val, Ala, Gly, Leu, or Ile
  SITE (476)..(476): Xaa at position 476 is Ile, Ala, Val, Leu, or Gly
  SITE (495)..(495): Xaa at position 495 is Ala, Gly, or Pro
  SITE (512)..(512): Xaa at position 512 is Ile, Ala, Val, Leu, or Gly
  SITE (513)..(513): Xaa at position 513 is Cys, Ala, Val, Gly, Ser, or Thr
  SITE (521)..(521): Xaa at position 521 is Val, Ala, Gly, Leu, or Ile
  SITE (530)..(530): Xaa at position 530 is Leu, Ala, Val, Gly, or Ile
  SITE (534)..(534): Xaa at position 534 is Val, Ala, Gly, Leu, or Ile
  SITE (546)..(546): Xaa at position 546 is Leu, Ala, Val, Gly, or Ile
  SITE (547)..(547): Xaa at position 547 is Leu, Ala, Val, Gly, or Ile
  SITE (549)..(549): Xaa at position 549 is Trp, Tyr, Phe, Met, His, Ile, Leu Val, Ala, or Gly
  SITE (550)..(550): Xaa at position 550 is Cys, Ala, Val, Gly, Ser, or Thr
  SITE (553)..(553): Xaa at position 553 is Ile, Ala, Val, Leu, or Gly
  SITE (554)..(554): Xaa at position 554 is Ala, Gly, or Pro
  SITE (557)..(557): Xaa at position 557 is Met, Ile, Leu, Val, Ala, or Gly
  SITE (560)..(560): Xaa at position 560 is Leu, Ala, Val, Gly, or Ile
  SITE (565)..(565): Xaa at position 565 is Leu, Ala, Val, Gly, or Ile
  SITE (566)..(566): Xaa at position 566 is Val, Ala, Gly, Leu, or Ile
  SITE (567)..(567): Xaa at position 567 is His, Phe, Tyr, Lys, Arg, Gly, Ser Thr, Ala, Val, Leu, Ile, Asn, Met, or Gln
  SITE (570)..(570): Xaa at position 570 is Leu, Ala, Val, Gly, or Ile
  SITE (571)..(571): Xaa at position 571 is Ala, Gly, or Pro
  SITE (572)..(572): Xaa at position 572 is Ala, Gly, or Pro
  SITE (575)..(575): Xaa at position 575 is Val, Ala, Gly, Leu, or Ile
  SITE (577)..(577): Xaa at position 577 is Val, Ala, Gly, Leu, or Ile
  SITE (583)..(583): Xaa at position 583 is Val, Ala, Gly, Leu, or Ile
  SITE (585)..(585): Xaa at position 585 is Ile, Ala, Val, Leu, or Gly
  SITE (591)..(591): Xaa at position 591 is Ala, Gly, or Pro
  SITE (614)..(614): Xaa at position 614 is Ala, Gly, or Pro
  SITE (623)..(623): Xaa at position 623 is Phe, Tyr, Met, His, Ile, Leu, Val Ala, or Gly
  SITE (629)..(629): Xaa at position 629 is Val, Ala, Gly, Leu, or Ile
  SITE (630)..(630): Xaa at position 630 is Trp, Tyr, Phe, Met, His, Ile, Leu Val, Ala, or Gly
  SITE (632)..(632): Xaa at position 632 is Tyr, Phe, Met, His, Ile, Leu, Val Ala, or Gly
  SITE (634)..(634): Xaa at position 634 is Val, Ala, Gly, Leu, or Ile
  SITE (636)..(636): Xaa at position 636 is Val, Ala, Gly, Leu, or Ile
  SITE (639)..(639): Xaa at position 639 is Leu, Ala, Val, Gly, or Ile
  SITE (640)..(640): Xaa at position 640 is Met, Ile, Leu, Val, Ala, or Gly
  SITE (655)..(655): Xaa at position 655 is Ile, Ala, Val, Leu, or Gly
  SITE (659)..(659): Xaa at position 659 is Leu, Ala, Val, Gly, or Ile
  SITE (670)..(670): Xaa at position 670 is Ile, Ala, Val, Leu, or Gly
  SITE (675)..(675): Xaa at position 675 is Val, Ala, Gly, Leu, or Ile
  SITE (679)..(679): Xaa at position 679 is Met, Ile, Leu, Val, Ala, or Gly
  SITE (682)..(682): Xaa at position 682 is Cys, Ala, Val, Gly, Ser, or Thr
  SITE (683)..(683): Xaa at position 683 is Trp, Tyr, Phe, Met, His, Ile, Leu Val, Ala, or Gly
  SITE (693)..(693): Xaa at position 693 is Phe, Tyr, Met, His, Ile, Leu, Val Ala, or Gly
  SITE (700)..(700): Xaa at position 700 is Phe, Tyr, Met, His, Ile, Leu, Val Ala, or Gly
  SITE (703)..(703): Xaa at position 703 is Met, Ile, Leu, Val, Ala, or Gly
  SITE (711)..(711): Xaa at position 711 is Val, Ala, Gly, Leu, or Ile
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPXAXKVLRENTSPKANKEILDEXYVMAGVGSPYVSRLLGXXLTSTVQLXTQLMPYGCXLDHXRENRGRLGSQDXXNXXMQXXKGXSYXEDVRXXXRDXXXRNXLXKSPNHXKXTDFGLXRLLDIDETEYHADGGKVPIKWMXLESILRRRXTHQSDXXSXGXTXWEXXTFGAKPYDGIPAREXPDLXEKGERLPQPPXCTIDXYMIXVKXXMIDSECRPRXRELVSEXSRXARDPQRFXVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 6 - protein, 153 aa, Homo sapiens
  SITE (31)..(31): Xaa at position 31 is Leu, Ala, Val, Gly, or Ile
  SITE (34)..(34): Xaa at position 34 is Ile, Ala, Val, Leu, or Gly
  SITE (38)..(38): Xaa at position 38 is Leu, Ala, Val, Gly, or Ile
  SITE (48)..(48): Xaa at position 48 is Cys, Ala, Val, Gly, Ser, or Thr
  SITE (70)..(70): Xaa at position 70 is Cys, Ala, Val, Gly, Ser, or Thr
  SITE (72)..(72): Xaa at position 72 is Ala, Gly, or Pro
  SITE (73)..(73): Xaa at position 73 is Ala, Gly, or Pro
  SITE (76)..(76): Xaa at position 76 is Leu, Ala, Val, Gly, or Ile
  SITE (89)..(89): Xaa at position 89 is Cys, Ala, Val, Gly, Ser, or Thr
  SITE (100)..(100): Xaa at position 100 is His, Phe, Tyr, Lys, Arg, Gly, Ser Thr, Ala, Val, Leu, Ile, Asn, Met, or Gln
  SITE (107)..(107): Xaa at position 107 is Leu, Ala, Val, Gly, or Ile
  SITE (110)..(110): Xaa at position 110 is Leu, Ala, Val, Gly, or Ile
  SITE (114)..(114): Xaa at position 114 is Leu, Ala, Val, Gly, or Ile
  SITE (118)..(118): Xaa at position 118 is Ala, Gly, or Pro
  SITE (133)..(133): Xaa at position 133 is Leu, Ala, Val, Gly, or Ile
  SITE (136)..(136): Xaa at position 136 is Phe, Tyr, Met, His, Ile, Leu, Val Ala, or Gly
  SITE (140)..(140): Xaa at position 140 is Leu, Ala, Val, Gly, or Ile
  SITE (144)..(144): Xaa at position 144 is Met, Ile, Leu, Val, Ala, or Gly
MGLTSQLLPPLFFLLACAGNFVHGHKCDITXQEXIKTXNSLTEQKTLXTELTVTDIFAASKNTTEKETFXRXXTVXRQFYSHHEKDTRXLGATAQQFHRXKQLIRFXKRXDRNXWGLXGLNSCPVKEANQSTXENXLERXKTIXREKYSKCSS

SEQ ID NO: 7 - protein, 249 aa, Peptoclostridium difficile
  NAP07
  SITE (32)..(32): Xaa at position 32 is Phe, Tyr, Met, His, Ile, Leu, Val Ala, or Gly
  SITE (51)..(51): Xaa at position 51 is Phe, Tyr, Met, His, Ile, Leu, Val Ala, or Gly
  SITE (53)..(53): Xaa at position 53 is Phe, Tyr, Met, His, Ile, Leu, Val Ala, or Gly
  SITE (73)..(73): Xaa at position 73 is Phe, Tyr, Met, His, Ile, Leu, Val Ala, or Gly
  SITE (74)..(74): Xaa at position 74 is Ala, Gly, or Pro
  SITE (104)..(104): Xaa at position 104 is Phe, Tyr, Met, His, Ile, Leu, Val Ala, or Gly
  SITE (124)..(124): Xaa at position 124 is Phe, Tyr, Met, His, Ile, Leu, Val Ala, or Gly
  SITE (129)..(129): Xaa at position 129 is Ala, Gly, or Pro
  SITE (132)..(132): Xaa at position 132 is Ala, Gly, or Pro
  SITE (143)..(143): Xaa at position 143 is Phe, Tyr, Met, His, Ile, Leu, Val Ala, or Gly
  SITE (164)..(164): Xaa at position 164 is Phe, Tyr, Met, His, Ile, Leu, Val Ala, or Gly
  SITE (165)..(165): Xaa at position 165 is Ala, Gly, or Pro
  SITE (195)..(195): Xaa at position 195 is Phe, Tyr, Met, His, Ile, Leu, Val Ala, or Gly
  SITE (215)..(215): Xaa at position 215 is Phe, Tyr, Met, His, Ile, Leu, Val Ala, or Gly
  SITE (220)..(220): Xaa at position 220 is Ala, Gly, or Pro
  SITE (223)..(223): Xaa at position 223 is Ala, Gly, or Pro
  SITE (237)..(237): Xaa at position 237 is Phe, Tyr, Met, His, Ile, Leu, Val Ala, or Gly
MRTIDGKKYYFNTNTAEAATGWQTIDGKKYYXNTNTSIASTGYTIINDKHXYXNTDGIMQIGVFKGPDGFEYXXPANTDANNIEGQAIRYQNRFLYLHDNIYYXGNNSKAATGWVTIDGRRYYXEPNTXIGXNGYKIIDNKNXYFRNGLPQIGVFKGPNGFEYXXPANTDANNIDGQAIRYQNRFLHLLGNIYYXGNNSKAVTGWQTINGNMYYXMPDTXMAXAGGLFEIDGVIYFXGVDGVKAPGIYG

SEQ ID NO: 8 - protein, 200 aa, Homo sapiens
  SITE (35)..(35): Xaa at position 35 is Leu, Ala, Val, Gly, or Ile
  SITE (38)..(38): Xaa at position 38 is Ala, Gly, or Pro
  SITE (39)..(39): Xaa at position 39 is Leu, Ala, Val, Gly, or Ile
MALWMRLLPLLALLALWGPDPAAAFVNQHLCGSHXVEXXYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 9 - protein, 574 aa, Human respiratory syncytial virus
  SITE (204)..(204): Xaa at position 204 is Leu, Ala, Val, Gly, or Ile
  SITE (206)..(206): Xaa at position 206 is Ile, Ala, Val, Leu, or Gly
  SITE (214)..(214): Xaa at position 214 is Ile, Ala, Val, Leu, or Gly
  SITE (215)..(215): Xaa at position 215 is Ser, Ala, or Gly
  SITE (233)..(233): Xaa at position 233 is Ile, Ala, Val, Leu, or Gly
  SITE (247)..(247): Xaa at position 247 is Val, Ala, Gly, Leu, or Ile
  SITE (251)..(251): Xaa at position 251 is Met, Ile, Leu, Val, Ala, or Gly
  SITE (257)..(257): Xaa at position 257 is Leu, Ala, Val, Gly, or Ile
  SITE (261)..(261): Xaa at position 261 is Ile, Ala, Val, Leu, or Gly
  SITE (274)..(274): Xaa at position 274 is Met, Ile, Leu, Val, Ala, or Gly
  SITE (280)..(280): Xaa at position 280 is Ile, Ala, Val, Leu, or Gly
  SITE (281)..(281): Xaa at position 281 is Val, Ala, Gly, Leu, or Ile
  SITE (299)..(299): Xaa at position 299 is Tyr, Phe, Met, His, Ile, Leu, Val Ala, or Gly
  SITE (301)..(301): Xaa at position 301 is Val, Ala, Gly, Leu, or Ile
  SITE (303)..(303): Xaa at position 303 is Leu, Ala, Val, Gly, or Ile
  SITE (313)..(313): Xaa at position 313 is Cys, Ala, Val, Gly, Ser, or Thr
  SITE (333)..(333): Xaa at position 333 is Cys, Ala, Val, Gly, Ser, or Thr
  SITE (343)..(343): Xaa at position 343 is Cys, Ala, Val, Gly, Ser, or Thr
  SITE (349)..(349): Xaa at position 349 is Val, Ala, Gly, Leu, or Ile
  SITE (352)..(352): Xaa at position 352 is Phe, Tyr, Met, His, Ile, Leu, Val Ala, or Gly
  SITE (365)..(365): Xaa at position 365 is Val, Ala, Gly, Leu, or Ile
  SITE (366)..(366): Xaa at position 366 is Phe, Tyr, Met, His, Ile, Leu, Val Ala, or Gly
  SITE (367)..(367): Xaa at position 367 is Cys, Ala, Val, Gly, Ser, or Thr
  SITE (382)..(382): Xaa at position 382 is Cys, Ala, Val, Gly, Ser, or Thr
  SITE (412)..(412): Xaa at position 412 is Ala, Gly, or Pro
  SITE (413)..(413): Xaa at position 413 is Ile, Ala, Val, Leu, or Gly
  SITE (414)..(414): Xaa at position 414 is Val, Ala, Gly, Leu, or Ile
  SITE (416)..(416): Xaa at position 416 is Cys, Ala, Val, Gly, Ser, or Thr
  SITE (422)..(422): Xaa at position 422 is Cys, Ala, Val, Gly, Ser, or Thr
  SITE (424)..(424): Xaa at position 424 is Ala, Gly, or Pro
  SITE (442)..(442): Xaa at position 442 is Val, Ala, Gly, Leu, or Ile
  SITE (450)..(450): Xaa at position 450 is Val, Ala, Gly, Leu, or Ile
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVXPXVNKQSCSXXNIETVIEFQQKNNRLLEXTREFSVNAGVTTPXSTYXLTNSEXLSLXNDMPITNDQKKLXSNNVQXXRQQSYSIMSIIKEEVLAXVXQXPLYGVIDTPXWKLHTSPLCTTNTKEGSNIXLTRTDRGWYXDNAGSXSFXPQAETCKVQSNRXXXDTMNSLTLPSEVNLXNVDIFNPKYDCKIMTSKTDVSSSVITSLGXXXSXYGKTKXTXSNKNRGIIKTFSNGCDYXSNKGVDTXSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 10 - protein, 2710 aa, Peptoclostridium difficile
  SITE (2585)..(2585): Xaa at position 2585 is Phe, Tyr, Met, His, Ile, Leu Val, Ala, or Gly
  SITE (2593)..(2593): Xaa at position 2593 is Ala, Gly, or Pro
  SITE (2604)..(2604): Xaa at position 2604 is Phe, Tyr, Met, His, Ile, Leu Val, Ala, or Gly
  SITE (2625)..(2625): Xaa at position 2625 is Phe, Tyr, Met, His, Ile, Leu Val, Ala, or Gly
  SITE (2626)..(2626): Xaa at position 2626 is Ala, Gly, or Pro
  SITE (2656)..(2656): Xaa at position 2656 is Phe, Tyr, Met, His, Ile, Leu Val, Ala, or Gly
  SITE (2676)..(2676): Xaa at position 2676 is Phe, Tyr, Met, His, Ile, Leu Val, Ala, or Gly
  SITE (2681)..(2681): Xaa at position 2681 is Ala, Gly, or Pro
  SITE (2684)..(2684): Xaa at position 2684 is Ala, Gly, or Pro
  SITE (2698)..(2698): Xaa at position 2698 is Phe, Tyr, Met, His, Ile, Leu Val, Ala, or Gly
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDLLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDRFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNGKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGRRYYXEPNTAIGXNGYKIIDNKNXYFRNGLPQIGVFKGPNGFEYXXPANTDANNIDGQAIRYQNRFLHLLGNIYYXGNNSKAVTGWQTINGNMYYXMPDTXMAXAGGLFEIDGVIYFXGVDGVKAPGIYG

SEQ ID NO: 11 - protein, 1353 aa, Human coronavirus EMC
  isolate United Kingdom/H123990006/2012 (HCoV-EMC)
  SITE (30)..(30): Xaa at position 30 is Cys, Ala, Val, Gly, Ser, or Thr
  SITE (40)..(40): Xaa at position 40 is Phe, Tyr, Met, His, Ile, Leu, Val Ala, or Gly
  SITE (44)..(44): Xaa at position 44 is Trp, Tyr, Phe, Met, His, Ile, Leu Val, Ala, or Gly
  SITE (48)..(48): Xaa at position 48 is Ile, Ala, Val, Leu, or Gly
  SITE (53)..(53): Xaa at position 53 is Ala, Gly, or Pro
  SITE (58)..(58): Xaa at position 58 is Tyr, Phe, Met, His, Ile, Leu, Val Ala, or Gly
  SITE (64)..(64): Xaa at position 64 is Tyr, Phe, Met, His, Ile, Leu, Val Ala, or Gly
  SITE (67)..(67): Xaa at position 67 is Ile, Ala, Val, Leu, or Gly
  SITE (74)..(74): Xaa at position 74 is Leu, Ala, Val, Gly, or Ile
  SITE (85)..(85): Xaa at position 85 is Tyr, Phe, Met, His, Ile, Leu, Val Ala, or Gly
  SITE (101)..(101): Xaa at position 101 is Phe, Tyr, Met, His, Ile, Leu, Val Ala, or Gly
  SITE (105)..(105): Xaa at position 105 is Tyr, Phe, Met, His, Ile, Leu, Val Ala, or Gly
  SITE (112)..(112): Xaa at position 112 is Phe, Tyr, Met, His, Ile, Leu, Val Ala, or Gly
  SITE (117)..(117): Xaa at position 117 is Val, Ala, Gly, Leu, or Ile
  SITE (120)..(120): Xaa at position 120 is Ile, Ala, Val, Leu, or Gly
  SITE (123)..(123): Xaa at position 123 is Ala, Gly, or Pro
  SITE (124)..(124): Xaa at position 124 is Ala, Gly, or Pro
  SITE (132)..(132): Xaa at position 132 is Ile, Ala, Val, Leu, or Gly
  SITE (144)..(144): Xaa at position 144 is Tyr, Phe, Met, His, Ile, Leu, Val Ala, or Gly
  SITE (153)..(153): Xaa at position 153 is Val, Ala, Gly, Leu, or Ile
  SITE (169)..(169): Xaa at position 169 is Leu, Ala, Val, Gly, or Ile
  SITE (170)..(170): Xaa at position 170 is Val, Ala, Gly, Leu, or Ile
  SITE (172)..(172): Xaa at position 172 is Leu, Ala, Val, Gly, or Ile
  SITE (176)..(176): Xaa at position 176 is Cys, Ala, Val, Gly, Ser, or Thr
  SITE (182)..(182): Xaa at position 182 is Ala, Gly, or Pro
  SITE (184)..(184): Xaa at position 184 is Tyr, Phe, Met, His, Ile, Leu, Val Ala, or Gly
  SITE (185)..(185): Xaa at position 185 is Cys, Ala, Val, Gly, Ser, or Thr
  SITE (195)..(195): Xaa at position 195 is Cys, Ala, Val, Gly, Ser, or Thr
  SITE (232)..(232): Xaa at position 232 is Phe, Tyr, Met, His, Ile, Leu, Val Ala, or Gly
  SITE (237)..(237): Xaa at position 237 is Cys, Ala, Val, Gly, Ser, or Thr
  SITE (239)..(239): Xaa at position 239 is Phe, Tyr, Met, His, Ile, Leu, Val Ala, or Gly
  SITE (243)..(243): Xaa at position 243 is Tyr, Phe, Met, His, Ile, Leu, Val Ala, or Gly
  SITE (253)..(253): Xaa at position 253 is Trp, Tyr, Phe, Met, His, Ile, Leu Val, Ala, or Gly
  SITE (254)..(254): Xaa at position 254 is Phe, Tyr, Met, His, Ile, Leu, Val Ala, or Gly
  SITE (256)..(256): Xaa at position 256 is Ile, Ala, Val, Leu, or Gly
  SITE (263)..(263): Xaa at position 263 is Val, Ala, Gly, Leu, or Ile
  SITE (265)..(265): Xaa at position 265 is Leu, Ala, Val, Gly, or Ile
  SITE (278)..(278): Xaa at position 278 is Met, Ile, Leu, Val, Ala, or Gly
  SITE (279)..(279): Xaa at position 279 is Phe, Tyr, Met, His, Ile, Leu, Val Ala, or Gly
  SITE (282)..(282): Xaa at position 282 is Ala, Gly, or Pro
  SITE (290)..(290): Xaa at position 290 is Ile, Ala, Val, Leu, or Gly
  SITE (292)..(292): Xaa at position 292 is Tyr, Phe, Met, His, Ile, Leu, Val Ala, or Gly
  SITE (293)..(293): Xaa at position 293 is Tyr, Phe, Met, His, Ile, Leu, Val Ala, or Gly
  SITE (300)..(300): Xaa at position 300 is Ile, Ala, Val, Leu, or Gly
  SITE (309)..(309): Xaa at position 309 is Ala, Gly, or Pro
  SITE (312)..(312): Xaa at position 312 is Ala, Gly, or Pro
  SITE (313)..(313): Xaa at position 313 is Phe, Tyr, Met, His, Ile, Leu, Val Ala, or Gly
  SITE (314)..(314): Xaa at position 314 is Tyr, Phe, Met, His, Ile, Leu, Val Ala, or Gly
  SITE (316)..(316): Xaa at position 316 is Tyr, Phe, Met, His, Ile, Leu, Val Ala, or Gly
  SITE (318)..(318): Xaa at position 318 is Leu, Ala, Val, Gly, or Ile
  SITE (329)..(329): Xaa at position 329 is Val, Ala, Gly, Leu, or Ile
  SITE (336)..(336): Xaa at position 336 is Ala, Gly, or Pro
  SITE (339)..(339): Xaa at position 339 is Cys, Ala, Val, Gly, Ser, or Thr
  SITE (347)..(347): Xaa at position 347 is Leu, Ala, Val, Gly, or Ile
  SITE (349)..(349): Xaa at position 349 is Cys, Ala, Val, Gly, Ser, or Thr
  SITE (351)..(351): Xaa at position 351 is Tyr, Phe, Met, His, Ile, Leu, Val Ala, or Gly
  SITE (354)..(354): Xaa at position 354 is Phe, Tyr, Met, His, Ile, Leu, Val Ala, or Gly
  SITE (360)..(360): Xaa at position 360 is Val, Ala, Gly, Leu, or Ile
  SITE (361)..(361): Xaa at position 361 is Tyr, Phe, Met, His, Ile, Leu, Val Ala, or Gly
  SITE (366)..(366): Xaa at position 366 is Phe, Tyr, Met, His, Ile, Leu, Val Ala, or Gly
  SITE (368)..(368): Xaa at position 368 is Ala, Gly, or Pro
  SITE (383)..(383): Xaa at position 383 is Cys, Ala, Val, Gly, Ser, or Thr
  SITE (404)..(404): Xaa at position 404 is Phe, Tyr, Met, His, Ile, Leu, Val Ala, or Gly
  SITE (407)..(407): Xaa at position 407 is Cys, Ala, Val, Gly, Ser, or Thr
  SITE (409)..(409): Xaa at position 409 is Tyr, Phe, Met, His, Ile, Leu, Val Ala, or Gly
  SITE (411)..(411): Xaa at position 411 is Leu, Ala, Val, Gly, or Ile
  SITE (414)..(414): Xaa at position 414 is Leu, Ala, Val, Gly, or Ile
  SITE (415)..(415): Xaa at position 415 is Leu, Ala, Val, Gly, or Ile
  SITE (417)..(417): Xaa at position 417 is Leu, Ala, Val, Gly, or Ile
  SITE (420)..(420): Xaa at position 420 is Val, Ala, Gly, Leu, or Ile
  SITE (423)..(423): Xaa at position 423 is Phe, Tyr, Met, His, Ile, Leu, Val Ala, or Gly
  SITE (425)..(425): Xaa at position 425 is Cys, Ala, Val, Gly, Ser, or Thr
  SITE (434)..(434): Xaa at position 434 is Ala, Gly, or Pro
  SITE (437)..(437): Xaa at position 437 is Cys, Ala, Val, Gly, Ser, or Thr
  SITE (438)..(438): Xaa at position 438 is Tyr, Phe, Met, His, Ile, Leu, Val Ala, or Gly
  SITE (446)..(446): Xaa at position 446 is Phe, Tyr, Met, His, Ile, Leu, Val Ala, or Gly
  SITE (461)..(461): Xaa at position 461 is Ala, Gly, or Pro
  SITE (464)..(464): Xaa at position 464 is Ile, Ala, Val, Leu, or Gly
  SITE (467)..(467): Xaa at position 467 is Phe, Tyr, Met, His, Ile, Leu, Val Ala, or Gly
  SITE (469)..(469): Xaa at position 469 is Tyr, Phe, Met, His, Ile, Leu, Val Ala, or Gly
  SITE (478)..(478): Xaa at position 478 is Cys, Ala, Val, Gly, Ser, or Thr
  SITE (482)..(482): Xaa at position 482 is Ala, Gly, or Pro
  SITE (497)..(497): Xaa at position 497 is Tyr, Phe, Met, His, Ile, Leu, Val Ala, or Gly
  SITE (503)..(503): Xaa at position 503 is Cys, Ala, Val, Gly, Ser, or Thr
  SITE (573)..(573): Xaa at position 573 is Ile, Ala, Val, Leu, or Gly
  SITE (577)..(577): Xaa at position 577 is Tyr, Phe, Met, His, Ile, Leu, Val Ala, or Gly
  SITE (584)..(584): Xaa at position 584 is Val, Ala, Gly, Leu, or Ile
  SITE (585)..(585): Xaa at position 585 is Cys, Ala, Val, Gly, Ser, or Thr
  SITE (603)..(603): Xaa at position 603 is Cys, Ala, Val, Gly, Ser, or Thr
  SITE (606)..(606): Xaa at position 606 is Tyr, Phe, Met, His, Ile, Leu, Val Ala, or Gly
  SITE (616)..(616): Xaa at position 616 is Val, Ala, Gly, Leu, or Ile
  SITE (617)..(617): Xaa at position 617 is Phe, Tyr, Met, His, Ile, Leu, Val Ala, or Gly
  SITE (620)..(620): Xaa at position 620 is Cys, Ala, Val, Gly, Ser, or Thr
  SITE (631)..(631): Xaa at position 631 is Val, Ala, Gly, Leu, or Ile
  SITE (632)..(632): Xaa at position 632 is Tyr, Phe, Met, His, Ile, Leu, Val Ala, or Gly
  SITE (648)..(648): Xaa at position 648 is Tyr, Phe, Met, His, Ile, Leu, Val Ala, or Gly
  SITE (649)..(649): Xaa at position 649 is Tyr, Phe, Met, His, Ile, Leu, Val Ala, or Gly
  SITE (650)..(650): Xaa at position 650 is Cys, Ala, Val, Gly, Ser, or Thr
  SITE (654)..(654): Xaa at position 654 is Cys, Ala, Val, Gly, Ser, or Thr
  SITE (655)..(655): Xaa at position 655 is Val, Ala, Gly, Leu, or Ile
  SITE (657)..(657): Xaa at position 657 is Val, Ala, Gly, Leu, or Ile
  SITE (659)..(659): Xaa at position 659 is Val, Ala, Gly, Leu, or Ile
  SITE (661)..(661): Xaa at position 661 is Val, Ala, Gly, Leu, or Ile
  SITE (662)..(662): Xaa at position 662 is Ile, Ala, Val, Leu, or Gly
  SITE (663)..(663): Xaa at position 663 is Tyr, Phe, Met, His, Ile, Leu, Val Ala, or Gly
  SITE (671)..(671): Xaa at position 671 is Ala, Gly, or Pro
  SITE (673)..(673): Xaa at position 673 is Leu, Ala, Val, Gly, or Ile
  SITE (677)..(677): Xaa at position 677 is Val, Ala, Gly, Leu, or Ile
  SITE (679)..(679): Xaa at position 679 is Cys, Ala, Val, Gly, Ser, or Thr
  SITE (697)..(697): Xaa at position 697 is Leu, Ala, Val, Gly, or Ile
  SITE (707)..(707): Xaa at position 707 is Leu, Ala, Val, Gly, or Ile
  SITE (711)..(711): Xaa at position 711 is Val, Ala, Gly, Leu, or Ile
  SITE (713)..(713): Xaa at position 713 is Cys, Ala, Val, Gly, Ser, or Thr
  SITE (724)..(724): Xaa at position 724 is Val, Ala, Gly, Leu, or Ile
  SITE (727)..(727): Xaa at position 727 is Cys, Ala, Val, Gly, Ser, or Thr
  SITE (729)..(729): Xaa at position 729 is Leu, Ala, Val, Gly, or Ile
  SITE (731)..(731): Xaa at position 731 is Leu, Ala, Val, Gly, or Ile
  SITE (735)..(735): Xaa at position 735 is Leu, Ala, Val, Gly, or Ile
  SITE (736)..(736): Xaa at position 736 is Cys, Ala, Val, Gly, Ser, or Thr
  SITE (737)..(737): Xaa at position 737 is Ala, Gly, or Pro
  SITE (770)..(770): Xaa at position 770 is Val, Ala, Gly, Leu, or Ile
  SITE (782)..(782): Xaa at position 782 is Ile, Ala, Val, Leu, or Gly
  SITE (786)..(786): Xaa at position 786 is Phe, Tyr, Met, His, Ile, Leu, Val Ala, or Gly
  SITE (795)..(795): Xaa at position 795 is Ile, Ala, Val, Leu, or Gly
  SITE (802)..(802): Xaa at position 802 is Val, Ala, Gly, Leu, or Ile
  SITE (806)..(806): Xaa at position 806 is Cys, Ala, Val, Gly, Ser, or Thr
  SITE (810)..(810): Xaa at position 810 is Val, Ala, Gly, Leu, or Ile
  SITE (811)..(811): Xaa at position 811 is Cys, Ala, Val, Gly, Ser, or Thr
  SITE (817)..(817): Xaa at position 817 is Cys, Ala, Val, Gly, Ser, or Thr
  SITE (821)..(821): Xaa at position 821 is Leu, Ala, Val, Gly, or Ile
  SITE (824)..(824): Xaa at position 824 is Tyr, Phe, Met, His, Ile, Leu, Val Ala, or Gly
  SITE (827)..(827): Xaa at position 827 is Phe, Tyr, Met, His, Ile, Leu, Val Ala, or Gly
  SITE (828)..(828): Xaa at position 828 is Cys, Ala, Val, Gly, Ser, or Thr
  SITE (835)..(835): Xaa at position 835 is Leu, Ala, Val, Gly, or Ile
  SITE (893)..(893): Xaa at position 893 is Leu, Ala, Val, Gly, or Ile
  SITE (894)..(894): Xaa at position 894 is Leu, Ala, Val, Gly, or Ile
  SITE (895)..(895): Xaa at position 895 is Phe, Tyr, Met, His, Ile, Leu, Val Ala, or Gly
  SITE (898)..(898): Xaa at position 898 is Val, Ala, Gly, Leu, or Ile
  SITE (909)..(909): Xaa at position 909 is Tyr, Phe, Met, His, Ile, Leu, Val Ala, or Gly
  SITE (912)..(912): Xaa at position 912 is Cys, Ala, Val, Gly, Ser, or Thr
  SITE (923)..(923): Xaa at position 923 is Leu, Ala, Val, Gly, or Ile
  SITE (925)..(925): Xaa at position 925 is Cys, Ala, Val, Gly, Ser, or Thr
  SITE (934)..(934): Xaa at position 934 is Val, Ala, Gly, Leu, or Ile
  SITE (935)..(935): Xaa at position 935 is Leu, Ala, Val, Gly, or Ile
  SITE (947)..(947): Xaa at position 947 is Tyr, Phe, Met, His, Ile, Leu, Val Ala, or Gly
  SITE (960)..(960): Xaa at position 960 is Trp, Tyr, Phe, Met, His, Ile, Leu Val, Ala, or Gly
  SITE (968)..(968): Xaa at position 968 is Ala, Gly, or Pro
  SITE (972)..(972): Xaa at position 972 is Phe, Tyr, Met, His, Ile, Leu, Val Ala, or Gly
  SITE (978)..(978): Xaa at position 978 is Tyr, Phe, Met, His, Ile, Leu, Val Ala, or Gly
  SITE (989)..(989): Xaa at position 989 is Val, Ala, Gly, Leu, or Ile
  SITE (990)..(990): Xaa at position 990 is Leu, Ala, Val, Gly, or Ile
  SITE (997)..(997): Xaa at position 997 is Ile, Ala, Val, Leu, or Gly
  SITE (1001)..(1001): Xaa at position 1001 is Phe, Tyr, Met, His, Ile, Leu Val, Ala, or Gly
  SITE (1004)..(1004): Xaa at position 1004 is Ala, Gly, or Pro
  SITE (1007)..(1007): Xaa at position 1007 is Ala, Gly, or Pro
  SITE (1012)..(1012): Xaa at position 1012 is Phe, Tyr, Met, His, Ile, Leu Val, Ala, or Gly
  SITE (1018)..(1018): Xaa at position 1018 is Ala, Gly, or Pro
  SITE (1026)..(1026): Xaa at position 1026 is Val, Ala, Gly, Leu, or Ile
  SITE (1030)..(1030): Xaa at position 1030 is Ala, Gly, or Pro
  SITE (1032)..(1032): Xaa at position 1032 is Ala, Gly, or Pro
  SITE (1033)..(1033): Xaa at position 1033 is Leu, Ala, Val, Gly, or Ile
  SITE (1036)..(1036): Xaa at position 1036 is Leu, Ala, Val, Gly, or Ile
  SITE (1040)..(1040): Xaa at position 1040 is Leu, Ala, Val, Gly, or Ile
  SITE (1044)..(1044): Xaa at position 1044 is Phe, Tyr, Met, His, Ile, Leu Val, Ala, or Gly
  SITE (1046)..(1046): Xaa at position 1046 is Ala, Gly, or Pro
  SITE (1047)..(1047): Xaa at position 1047 is Ile, Ala, Val, Leu, or Gly
  SITE (1049)..(1049): Xaa at position 1049 is Ala, Gly, or Pro
  SITE (1054)..(1054): Xaa at position 1054 is Ile, Ala, Val, Leu, or Gly
  SITE (1058)..(1058): Xaa at position 1058 is Leu, Ala, Val, Gly, or Ile
  SITE (1065)..(1065): Xaa at position 1065 is Ala, Gly, or Pro
  SITE (1067)..(1067): Xaa at position 1067 is Ile, Ala, Val, Leu, or Gly
  SITE (1070)..(1070): Xaa at position 1070 is Leu, Ala, Val, Gly, or Ile
  SITE (1071)..(1071): Xaa at position 1071 is Ile, Ala, Val, Leu, or Gly
  SITE (1075)..(1075): Xaa at position 1075 is Leu, Ala, Val, Gly, or Ile
  SITE (1078)..(1078): Xaa at position 1078 is Leu, Ala, Val, Gly, or Ile
  SITE (1080)..(1080): Xaa at position 1080 is Ala, Gly, or Pro
  SITE (1086)..(1086): Xaa at position 1086 is Leu, Ala, Val, Gly, or Ile
  SITE (1103)..(1103): Xaa at position 1103 is Val, Ala, Gly, Leu, or Ile
  SITE (1106)..(1106): Xaa at position 1106 is Cys, Ala, Val, Gly, Ser, or Thr
  SITE (1107)..(1107): Xaa at position 1107 is Val, Ala, Gly, Leu, or Ile
  SITE (1116)..(1116): Xaa at position 1116 is Phe, Tyr, Met, His, Ile, Leu Val, Ala, or Gly
  SITE (1117)..(1117): Xaa at position 1117 is Cys, Ala, Val, Gly, Ser, or Thr
  SITE (1123)..(1123): Xaa at position 1123 is Ile, Ala, Val, Leu, or Gly
  SITE (1127)..(1127): Xaa at position 1127 is Val, Ala, Gly, Leu, or Ile
  SITE (1130)..(1130): Xaa at position 1130 is Ala, Gly, or Pro
  SITE (1134)..(1134): Xaa at position 1134 is Leu, Ala, Val, Gly, or Ile
  SITE (1136)..(1136): Xaa at position 1136 is Phe, Tyr, Met, His, Ile, Leu Val, Ala, or Gly
  SITE (1141)..(1141): Xaa at position 1141 is Tyr, Phe, Met, His, Ile, Leu Val, Ala, or Gly
  SITE (1155)..(1155): Xaa at position 1155 is Leu, Ala, Val, Gly, or Ile
  SITE (1156)..(1156): Xaa at position 1156 is Cys, Ala, Val, Gly, Ser, or Thr
  SITE (1166)..(1166): Xaa at position 1166 is Ala, Gly, or Pro
  SITE (1171)..(1171): Xaa at position 1171 is Tyr, Phe, Met, His, Ile, Leu Val, Ala, or Gly
  SITE (1172)..(1172): Xaa at position 1172 is Phe, Tyr, Met, His, Ile, Leu Val, Ala, or Gly
  SITE (1184)..(1184): Xaa at position 1184 is Trp, Tyr, Phe, Met, His, Ile Leu, Val, Ala, or Gly
  SITE (1192)..(1192): Xaa at position 1192 is Tyr, Phe, Met, His, Ile, Leu Val, Ala, or Gly
  SITE (1197)..(1197): Xaa at position 1197 is Ile, Ala, Val, Leu, or Gly
  SITE (1209)..(1209): Xaa at position 1209 is Val, Ala, Gly, Leu, or Ile
  SITE (1211)..(1211): Xaa at position 1211 is Tyr, Phe, Met, His, Ile, Leu Val, Ala, or Gly
  SITE (1223)..(1223): Xaa at position 1223 is Leu, Ala, Val, Gly, or Ile
  SITE (1260)..(1260): Xaa at position 1260 is Leu, Ala, Val, Gly, or Ile
  SITE (1262)..(1262): Xaa at position 1262 is Leu, Ala, Val, Gly, or Ile
  SITE (1266)..(1266): Xaa at position 1266 is Met, Ile, Leu, Val, Ala, or Gly
  SITE (1276)..(1276): Xaa at position 1276 is Leu, Ala, Val, Gly, or Ile
  SITE (1280)..(1280): Xaa at position 1280 is Tyr, Phe, Met, His, Ile, Leu Val, Ala, or Gly
  SITE (1281)..(1281): Xaa at position 1281 is Ile, Ala, Val, Leu, or Gly
  SITE (1320)..(1320): Xaa at position 1320 is Cys, Ala, Val, Gly, Ser, or Thr
  SITE (1323)..(1323): Xaa at position 1323 is Cys, Ala, Val, Gly, Ser, or Thr
  SITE (1327)..(1327): Xaa at position 1327 is Cys, Ala, Val, Gly, Ser, or Thr
MIHSVFLLMFLLTPTESYVDVGPDSVKSAXIEVDIQQTFXDKTXPRPXDVSKXDGIIXPQGRTXSNXTITYQGXFPYQGDHGDMXVYSAGHATGTTPQKLXVANXSQDVKQXANGFXVRXGAXXNSTGTVIXSPSTSATIRKIXPAFMLGSSXGNFSDGKMGRFFNHTXXLXPDGXGTLLRXFXXILEPRSGNHXPAGNSYTSFATYHTPATDCSDGNYNRNASLNSFKEYXNLRNXTXMYTXNITEDEILEXXGXTQTAQGXHXFSSRYVDLYGGNXXQFXTLPVYDTXKXXSIIPHSXRSIQSDRKXWAXXXVXKXQPLTFLLDFSXDGYIRRXIDXGFNDLSQXHXSXESXDVESGXXSVSSXEXKPSGSVVEQAEGVEXDFSPLLSGTPPQVYNFKRLVXTNXNXNXTKXXSXFSXNDXTXSQISPAAIXSNXXSSLILDYXSYPLSMKSDLSVSSXGPXSQXNXKQSFSNPTXLILXTVPHNLTTITKPLKXSYINKXSRFLSDDRTEVPQLVNANQYSPCVSIVPSTVWEDGDYYRKQLSPLEGGGWLVASGSTVAMTEQLQMGFGXTVQXGTDTNSXXPKLEFANDTKIASQLGNXVEXSLYGVSGRGXXQNXTAVGVRQQRFXXDAYQNLVGYYSDDGNXXXLRAXXSXPXSXXXDKETKTHXTXFGSXAXEHISSTMSQYSRSTRSMXKRRDSTYGPXQTPXGXVLGLVNSSLFXEDXKXPXGQSXXXLPDTPSTLTPRSVRSVPGEMRLASIAFNHPIQXDQLNSSYFKLSXPTNXSFGVTQEYXQTTIQKXTVDXKQYXXNGFQKXEQLXREXGQXXSKINQAXHGANLRQDDSVRNLFASVKSSQSSPIIPGFGGDFNLTLLEPVSISTGSRSARSAIEDXXXDKXTIADPGYMQGXDDXMQQGPASARDXIXAQYVAGYKXXPPLMDVNMEAAXTSSLLGSIAGVGXTAGLSSFXAIPXAQSIFXRLNGVGITQQXXSENQKLXANKXNQXLGXMQTGXTTTNEXFHKVQDAXNNNXQXXSKXASEXSNTXGXXSXSIGDXIQRXDVLEQDXQXDRXXNGRXTTXNXFVAQQXVRSESAALSAQLAKDKXNEXXKAQSKRSGXXGQGTHXVSFXVNXPNGXYXMHVGXYPSNHIEVVSAYGXXDAANPTNCIXPVNGXXIKTNNTRIVDEXSYTGSSFXAPEPXTSLNTKYVAPQXTXQNISTNLPPPLXGNSTGIDFQDELDEFFKNVSTSIPNFGSLTQINTTLXDXTYEXLSLQQVVKAXNESXXDLKELGNYTYYNKWPWYIWLGFIAGLVALALCVFFILCXTGXGTNXMGKLKCNRCCDRYEEYDLEPHKVHVH

SEQ ID NO: 12 - protein, 431 aa, Homo sapiens
  SITE (115)..(115): Xaa at position 115 is Ala, Gly, or Pro
  SITE (126)..(126): Xaa at position 126 is Val, Ala, Gly, Leu, or Ile
  SITE (158)..(158): Xaa at position 158 is Phe, Tyr, Met, His, Ile, Leu, Val Ala, or Gly
  SITE (166)..(166): Xaa at position 166 is Phe, Tyr, Met, His, Ile, Leu, Val Ala, or Gly
  SITE (172)..(172): Xaa at position 172 is Leu, Ala, Val, Gly, or Ile
  SITE (174)..(174): Xaa at position 174 is Phe, Tyr, Met, His, Ile, Leu, Val Ala, or Gly
  SITE (175)..(175): Xaa at position 175 is Val, Ala, Gly, Leu, or Ile
  SITE (184)..(184): Xaa at position 184 is Leu, Ala, Val, Gly, or Ile
  SITE (199)..(199): Xaa at position 199 is Ala, Gly, or Pro
  SITE (202)..(202): Xaa at position 202 is Tyr, Phe, Met, His, Ile, Leu, Val Ala, or Gly
  SITE (203)..(203): Xaa at position 203 is Ala, Gly, or Pro
  SITE (204)..(204): Xaa at position 204 is Ala, Gly, or Pro
  SITE (206)..(206): Xaa at position 206 is Ile, Ala, Val, Leu, or Gly
  SITE (207)..(207): Xaa at position 207 is Ala, Gly, or Pro
  SITE (209)..(209): Xaa at position 209 is Ala, Gly, or Pro
  SITE (210)..(210): Xaa at position 210 is Leu, Ala, Val, Gly, or Ile
  SITE (223)..(223): Xaa at position 223 is Leu, Ala, Val, Gly, or Ile
  SITE (228)..(228): Xaa at position 228 is Ile, Ala, Val, Leu, or Gly
  SITE (230)..(230): Xaa at position 230 is Leu, Ala, Val, Gly, or Ile
  SITE (236)..(236): Xaa at position 236 is Ile, Ala, Val, Leu, or Gly
  SITE (238)..(238): Xaa at position 238 is Leu, Ala, Val, Gly, or Ile
  SITE (265)..(265): Xaa at position 265 is Ala, Gly, or Pro
  SITE (278)..(278): Xaa at position 278 is Val, Ala, Gly, Leu, or Ile
  SITE (280)..(280): Xaa at position 280 is Trp, Tyr, Phe, Met, His, Ile, Leu Val, Ala, or Gly
  SITE (281)..(281): Xaa at position 281 is Trp, Tyr, Phe, Met, His, Ile, Leu Val, Ala, or Gly
  SITE (282)..(282): Xaa at position 282 is Cys, Ala, Val, Gly, Ser, or Thr
  SITE (283)..(283): Xaa at position 283 is Leu, Ala, Val, Gly, or Ile
  SITE (285)..(285): Xaa at position 285 is Ala, Gly, or Pro
  SITE (286)..(286): Xaa at position 286 is Val, Ala, Gly, Leu, or Ile
  SITE (287)..(287): Xaa at position 287 is Leu, Ala, Val, Gly, or Ile
  SITE (290)..(290): Xaa at position 290 is Met, Ile, Leu, Val, Ala, or Gly
  SITE (324)..(324): Xaa at position 324 is Ala, Gly, or Pro
  SITE (327)..(327): Xaa at position 327 is Leu, Ala, Val, Gly, or Ile
  SITE (328)..(328): Xaa at position 328 is Leu, Ala, Val, Gly, or Ile
  SITE (331)..(331): Xaa at position 331 is Leu, Ala, Val, Gly, or Ile
  SITE (349)..(349): Xaa at position 349 is Ile, Ala, Val, Leu, or Gly
  SITE (355)..(355): Xaa at position 355 is Phe, Tyr, Met, His, Ile, Leu, Val Ala, or Gly
  SITE (363)..(363): Xaa at position 363 is Leu, Ala, Val, Gly, or Ile
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSFGKVLLXRHKAEEVFYAXKVLQKKAILKKKEEKHIMSERNVLLKNVKHPXLVGLHFSXQTADKXYXXLDYINGGEXFYHLQRERCFLEPRXRFXXXEXXSXXGYLHSLNIVYRDXKPENXLXDSQGHXVXTDFGLCKENIEHNSTTSTFCGTPEYLXPEVLHKQPYDRTXDXXXXGXXXYEXLYGLPPFYSRNTAEMYDNILNKPLQLKPNITNSXRHXXEGXLQKDRTKRLGAKDDFMEXKSHVFXSLINWDDXINKKITPPFNPNVSGPNDLRHFDPEFTEEPVPNSIGKSPDSVLVTASVKEAAEAFLGFSYAPPTDSFL

SEQ ID NO: 13 - protein, 453 aa, Homo sapiens
  SITE (187)..(187): Xaa at position 187 is Val, Ala, Gly, Leu, or Ile
  SITE (189)..(189): Xaa at position 189 is Leu, Ala, Val, Gly, or Ile
  SITE (191)..(191): Xaa at position 191 is Val, Ala, Gly, Leu, or Ile
  SITE (195)..(195): Xaa at position 195 is Leu, Ala, Val, Gly, or Ile
  SITE (199)..(199): Xaa at position 199 is Ile, Ala, Val, Leu, or Gly
  SITE (210)..(210): Xaa at position 210 is Val, Ala, Gly, Leu, or Ile
  SITE (214)..(214): Xaa at position 214 is Ile, Ala, Val, Leu, or Gly
  SITE (216)..(216): Xaa at position 216 is Leu, Ala, Val, Gly, or Ile
  SITE (226)..(226): Xaa at position 226 is Met, Ile, Leu, Val, Ala, or Gly
  SITE (228)..(228): Xaa at position 228 is Ile, Ala, Val, Leu, or Gly
  SITE (230)..(230): Xaa at position 230 is Leu, Ala, Val, Gly, or Ile
  SITE (234)..(234): Xaa at position 234 is Phe, Tyr, Met, His, Ile, Leu, Val Ala, or Gly
  SITE (250)..(250): Xaa at position 250 is Val, Ala, Gly, Leu, or Ile
  SITE (270)..(270): Xaa at position 270 is Leu, Ala, Val, Gly, or Ile
  SITE (281)..(281): Xaa at position 281 is Val, Ala, Gly, Leu, or Ile
  SITE (282)..(282): Xaa at position 282 is Met, Ile, Leu, Val, Ala, or Gly
  SITE (284)..(284): Xaa at position 284 is Tyr, Phe, Met, His, Ile, Leu, Val Ala, or Gly
  SITE (286)..(286): Xaa at position 286 is Leu, Ala, Val, Gly, or Ile
  SITE (296)..(296): Xaa at position 296 is Phe, Tyr, Met, His, Ile, Leu, Val Ala, or Gly
  SITE (311)..(311): Xaa at position 311 is Leu, Ala, Val, Gly, or Ile
  SITE (313)..(313): Xaa at position 313 is Val, Ala, Gly, Leu, or Ile
  SITE (315)..(315): Xaa at position 315 is Leu, Ala, Val, Gly, or Ile
  SITE (317)..(317): Xaa at position 317 is Leu, Ala, Val, Gly, or Ile
  SITE (319)..(319): Xaa at position 319 is Cys, Ala, Val, Gly, Ser, or Thr
  SITE (327)..(327): Xaa at position 327 is Ala, Gly, or Pro
  SITE (330)..(330): Xaa at position 330 is Val, Ala, Gly, Leu, or Ile
  SITE (332)..(332): Xaa at position 332 is Leu, Ala, Val, Gly, or Ile
  SITE (334)..(334): Xaa at position 334 is Leu, Ala, Val, Gly, or Ile
  SITE (347)..(347): Xaa at position 347 is Leu, Ala, Val, Gly, or Ile
  SITE (363)..(363): Xaa at position 363 is Trp, Tyr, Phe, Met, His, Ile, Leu Val, Ala, or Gly
  SITE (365)..(365): Xaa at position 365 is Leu, Ala, Val, Gly, or Ile
  SITE (368)..(368): Xaa at position 368 is Val, Ala, Gly, Leu, or Ile
  SITE (380)..(380): Xaa at position 380 is Met, Ile, Leu, Val, Ala, or Gly
  SITE (405)..(405): Xaa at position 405 is Ala, Gly, or Pro
  SITE (407)..(407): Xaa at position 407 is Leu, Ala, Val, Gly, or Ile
  SITE (409)..(409): Xaa at position 409 is Phe, Tyr, Met, His, Ile, Leu, Val Ala, or Gly
  SITE (411)..(411): Xaa at position 411 is Leu, Ala, Val, Gly, or Ile
  SITE (419)..(419): Xaa at position 419 is Leu, Ala, Val, Gly, or Ile
  SITE (449)..(449): Xaa at position 449 is Tyr, Phe, Met, His, Ile, Leu, Val Ala, or Gly
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEXFXDXVERXSVLXASNGSLLKVDXQGEXRXKSFLPSGSEXRXGXTEEXCVGKSELRGYGPGIRXDEVSFHSSVNLDEFESHRIXRLQPPQGELTXXRXQXSDDLPSPLPXRLFPSVQWDRGSGRXQXYXKXRXDLLSKSQXLNXRXHXPLPRGVVSLSQEXSSPEQKAELAEGALRXDXPRXQGGSQLSGLFQXDVPGPPGPPSHGLSTSASPLGLGPXSXSXEXPRHTCSGXQVRFLRLAFRPCGNANPHKWVRHLSHSDAXVIRI

SEQ ID NO: 14 - protein, 839 aa, Homo sapiens
  SITE (38)..(38): Xaa at position 38 is Tyr, Phe, Met, His, Ile, Leu, Val Ala, or Gly
  SITE (40)..(40): Xaa at position 40 is Cys, Ala, Val, Gly, Ser, or Thr
  SITE (59)..(59): Xaa at position 59 is Leu, Ala, Val, Gly, or Ile
  SITE (61)..(61): Xaa at position 61 is Leu, Ala, Val, Gly, or Ile
  SITE (69)..(69): Xaa at position 69 is Leu, Ala, Val, Gly, or Ile
  SITE (74)..(74): Xaa at position 74 is Phe, Tyr, Met, His, Ile, Leu, Val Ala, or Gly
  SITE (77)..(77): Xaa at position 77 is Phe, Tyr, Met, His, Ile, Leu, Val Ala, or Gly
  SITE (80)..(80): Xaa at position 80 is Leu, Ala, Val, Gly, or Ile
  SITE (83)..(83): Xaa at position 83 is Leu, Ala, Val, Gly, or Ile
  SITE (85)..(85): Xaa at position 85 is Leu, Ala, Val, Gly, or Ile
  SITE (88)..(88): Xaa at position 88 is Cys, Ala, Val, Gly, Ser, or Thr
  SITE (90)..(90): Xaa at position 90 is Ile, Ala, Val, Leu, or Gly
  SITE (93)..(93): Xaa at position 93 is Ile, Ala, Val, Leu, or Gly
  SITE (97)..(97): Xaa at position 97 is Ala, Gly, or Pro
  SITE (98)..(98): Xaa at position 98 is Tyr, Phe, Met, His, Ile, Leu, Val Ala, or Gly
  SITE (101)..(101): Xaa at position 101 is Leu, Ala, Val, Gly, or Ile
  SITE (104)..(104): Xaa at position 104 is Leu, Ala, Val, Gly, or Ile
  SITE (107)..(107): Xaa at position 107 is Leu, Ala, Val, Gly, or Ile
  SITE (109)..(109): Xaa at position 109 is Leu, Ala, Val, Gly, or Ile
  SITE (114)..(114): Xaa at position 114 is Ile, Ala, Val, Leu, or Gly
  SITE (121)..(121): Xaa at position 121 is Ala, Gly, or Pro
  SITE (122)..(122): Xaa at position 122 is Phe, Tyr, Met, His, Ile, Leu, Val Ala, or Gly
  SITE (125)..(125): Xaa at position 125 is Leu, Ala, Val, Gly, or Ile
  SITE (128)..(128): Xaa at position 128 is Leu, Ala, Val, Gly, or Ile
  SITE (131)..(131): Xaa at position 131 is Leu, Ala, Val, Gly, or Ile
  SITE (133)..(133): Xaa at position 133 is Ala, Gly, or Pro
  SITE (141)..(141): Xaa at position 141 is Leu, Ala, Val, Gly, or Ile
  SITE (146)..(146): Xaa at position 146 is Ile, Ala, Val, Leu, or Gly
  SITE (149)..(149): Xaa at position 149 is Leu, Ala, Val, Gly, or Ile
  SITE (152)..(152): Xaa at position 152 is Leu, Ala, Val, Gly, or Ile
  SITE (155)..(155): Xaa at position 155 is Leu, Ala, Val, Gly, or Ile
  SITE (157)..(157): Xaa at position 157 is Val, Ala, Gly, Leu, or Ile
  SITE (158)..(158): Xaa at position 158 is Ala, Gly, or Pro
  SITE (162)..(162): Xaa at position 162 is Ile, Ala, Val, Leu, or Gly
  SITE (165)..(165): Xaa at position 165 is Phe, Tyr, Met, His, Ile, Leu, Val Ala, or Gly
  SITE (167)..(167): Xaa at position 167 is Leu, Ala, Val, Gly, or Ile
  SITE (171)..(171): Xaa at position 171 is Phe, Tyr, Met, His, Ile, Leu, Val Ala, or Gly
  SITE (174)..(174): Xaa at position 174 is Leu, Ala, Val, Gly, or Ile
  SITE (177)..(177): Xaa at position 177 is Leu, Ala, Val, Gly, or Ile
  SITE (180)..(180): Xaa at position 180 is Leu, Ala, Val, Gly, or Ile
  SITE (182)..(182): Xaa at position 182 is Leu, Ala, Val, Gly, or Ile
  SITE (187)..(187): Xaa at position 187 is Ile, Ala, Val, Leu, or Gly
  SITE (190)..(190): Xaa at position 190 is Ile, Ala, Val, Leu, or Gly
  SITE (195)..(195): Xaa at position 195 is Leu, Ala, Val, Gly, or Ile
  SITE (197)..(197): Xaa at position 197 is Val, Ala, Gly, Leu, or Ile
  SITE (198)..(198): Xaa at position 198 is Leu, Ala, Val, Gly, or Ile
  SITE (203)..(203): Xaa at position 203 is Leu, Ala, Val, Gly, or Ile
  SITE (206)..(206): Xaa at position 206 is Leu, Ala, Val, Gly, or Ile
  SITE (208)..(208): Xaa at position 208 is Leu, Ala, Val, Gly, or Ile
  SITE (210)..(210): Xaa at position 210 is Leu, Ala, Val, Gly, or Ile
  SITE (215)..(215): Xaa at position 215 is Met, Ile, Leu, Val, Ala, or Gly
  SITE (218)..(218): Xaa at position 218 is Ile, Ala, Val, Leu, or Gly
  SITE (222)..(222): Xaa at position 222 is Ala, Gly, or Pro
  SITE (223)..(223): Xaa at position 223 is Phe, Tyr, Met, His, Ile, Leu, Val Ala, or Gly
  SITE (226)..(226): Xaa at position 226 is Ile, Ala, Val, Leu, or Gly
  SITE (228)..(228): Xaa at position 228 is Leu, Ala, Val, Gly, or Ile
  SITE (231)..(231): Xaa at position 231 is Leu, Ala, Val, Gly, or Ile
  SITE (233)..(233): Xaa at position 233 is Leu, Ala, Val, Gly, or Ile
  SITE (243)..(243): Xaa at position 243 is Met, Ile, Leu, Val, Ala, or Gly
  SITE (246)..(246): Xaa at position 246 is Cys, Ala, Val, Gly, Ser, or Thr
  SITE (247)..(247): Xaa at position 247 is Ile, Ala, Val, Leu, or Gly
  SITE (253)..(253): Xaa at position 253 is Leu, Ala, Val, Gly, or Ile
  SITE (255)..(255): Xaa at position 255 is Val, Ala, Gly, Leu, or Ile
  SITE (258)..(258): Xaa at position 258 is Leu, Ala, Val, Gly, or Ile
  SITE (260)..(260): Xaa at position 260 is Leu, Ala, Val, Gly, or Ile
  SITE (272)..(272): Xaa at position 272 is Phe, Tyr, Met, His, Ile, Leu, Val Ala, or Gly
  SITE (276)..(276): Xaa at position 276 is Ala, Gly, or Pro
  SITE (277)..(277): Xaa at position 277 is Leu, Ala, Val, Gly, or Ile
  SITE (280)..(280): Xaa at position 280 is Leu, Ala, Val, Gly, or Ile
  SITE (288)..(288): Xaa at position 288 is Phe, Tyr, Met, His, Ile, Leu, Val Ala, or Gly
  SITE (290)..(290): Xaa at position 290 is Leu, Ala, Val, Gly, or Ile
  SITE (296)..(296): Xaa at position 296 is Tyr, Phe, Met, His, Ile, Leu, Val Ala, or Gly
  SITE (297)..(297): Xaa at position 297 is Leu, Ala, Val, Gly, or Ile
  SITE (300)..(300): Xaa at position 300 is Ile, Ala, Val, Leu, or Gly
  SITE (303)..(303): Xaa at position 303 is Leu, Ala, Val, Gly, or Ile
  SITE (304)..(304): Xaa at position 304 is Phe, Tyr, Met, His, Ile, Leu, Val Ala, or Gly
  SITE (307)..(307): Xaa at position 307 is Leu, Ala, Val, Gly, or Ile
  SITE (310)..(310): Xaa at position 310 is Val, Ala, Gly, Leu, or Ile
  SITE (313)..(313): Xaa at position 313 is Phe, Tyr, Met, His, Ile, Leu, Val Ala, or Gly
  SITE (315)..(315): Xaa at position 315 is Leu, Ala, Val, Gly, or Ile
  SITE (318)..(318): Xaa at position 318 is Val, Ala, Gly, Leu, or Ile
  SITE (320)..(320): Xaa at position 320 is Ile, Ala, Val, Leu, or Gly
  SITE (323)..(323): Xaa at position 323 is Val, Ala, Gly, Leu, or Ile
  SITE (326)..(326): Xaa at position 326 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (332)..(332): Xaa at position 332 is Trp, Tyr, Phe, Met, His, Ile, Leu Val, Ala, or Gly
  SITE (335)..(335): Xaa at position 335 is Leu, Ala, Val, Gly, or Ile
  SITE (337)..(337): Xaa at position 337 is Leu, Ala, Val, Gly, or Ile
  SITE (340)..(340): Xaa at position 340 is Cys, Ala, Val, Gly, Ser, or Thr
  SITE (342)..(342): Xaa at position 342 is Phe, Tyr, Met, His, Ile, Leu, Val Ala, or Gly
  SITE (348)..(348): Xaa at position 348 is Leu, Ala, Val, Gly, or Ile
  SITE (350)..(350): Xaa at position 350 is Leu, Ala, Val, Gly, or Ile
  SITE (353)..(353): Xaa at position 353 is Leu, Ala, Val, Gly, or Ile
  SITE (356)..(356): Xaa at position 356 is Leu, Ala, Val, Gly, or Ile
  SITE (358)..(358): Xaa at position 358 is Phe, Tyr, Met, His, Ile, Leu, Val Ala, or Gly
  SITE (363)..(363): Xaa at position 363 is Gly, Ala, or Pro
  SITE (372)..(372): Xaa at position 372 is Leu, Ala, Val, Gly, or Ile
  SITE (375)..(375): Xaa at position 375 is Leu, Ala, Val, Gly, or Ile
  SITE (378)..(378): Xaa at position 378 is Leu, Ala, Val, Gly, or Ile
  SITE (380)..(380): Xaa at position 380 is Leu, Ala, Val, Gly, or Ile
  SITE (385)..(385): Xaa at position 385 is Leu, Ala, Val, Gly, or Ile
  SITE (387)..(387): Xaa at position 387 is Phe, Tyr, Met, His, Ile, Leu, Val Ala, or Gly
  SITE (390)..(390): Xaa at position 390 is Cys, Ala, Val, Gly, Ser, or Thr
  SITE (391)..(391): Xaa at position 391 is Cys, Ala, Val, Gly, Ser, or Thr
  SITE (396)..(396): Xaa at position 396 is Phe, Tyr, Met, His, Ile, Leu, Val Ala, or Gly
  SITE (401)..(401): Xaa at position 401 is Leu, Ala, Val, Gly, or Ile
  SITE (404)..(404): Xaa at position 404 is Leu, Ala, Val, Gly, or Ile
  SITE (406)..(406): Xaa at position 406 is Leu, Ala, Val, Gly, or Ile
  SITE (412)..(412): Xaa at position 412 is Ile, Ala, Val, Leu, or Gly
  SITE (414)..(414): Xaa at position 414 is Met, Ile, Leu, Val, Ala, or Gly
  SITE (418)..(418): Xaa at position 418 is Phe, Tyr, Met, His, Ile, Leu, Val Ala, or Gly
  SITE (421)..(421): Xaa at position 421 is Leu, Ala, Val, Gly, or Ile
  SITE (424)..(424): Xaa at position 424 is Leu, Ala, Val, Gly, or Ile
  SITE (427)..(427): Xaa at position 427 is Leu, Ala, Val, Gly, or Ile
  SITE (429)..(429): Xaa at position 429 is Phe, Tyr, Met, His, Ile, Leu, Val Ala, or Gly
  SITE (437)..(437): Xaa at position 437 is Met, Ile, Leu, Val, Ala, or Gly
  SITE (442)..(442): Xaa at position 442 is Val, Ala, Gly, Leu, or Ile
  SITE (443)..(443): Xaa at position 443 is Phe, Tyr, Met, His, Ile, Leu, Val Ala, or Gly
  SITE (446)..(446): Xaa at position 446 is Leu, Ala, Val, Gly, or Ile
  SITE (449)..(449): Xaa at position 449 is Leu, Ala, Val, Gly, or Ile
  SITE (450)..(450): Xaa at position 450 is Ile, Ala, Val, Leu, or Gly
  SITE (452)..(452): Xaa at position 452 is Leu, Ala, Val, Gly, or Ile
  SITE (454)..(454): Xaa at position 454 is Ile, Ala, Val, Leu, or Gly
  SITE (461)..(461): Xaa at position 461 is Val, Ala, Gly, Leu, or Ile
  SITE (466)..(466): Xaa at position 466 is Ile, Ala, Val, Leu, or Gly
  SITE (467)..(467): Xaa at position 467 is Phe, Tyr, Met, His, Ile, Leu, Val Ala, or Gly
  SITE (470)..(470): Xaa at position 470 is Leu, Ala, Val, Gly, or Ile
  SITE (473)..(473): Xaa at position 473 is Leu, Ala, Val, Gly, or Ile
  SITE (476)..(476): Xaa at position 476 is Leu, Ala, Val, Gly, or Ile
  SITE (478)..(478): Xaa at position 478 is Met, Ile, Leu, Val, Ala, or Gly
  SITE (483)..(483): Xaa at position 483 is Phe, Tyr, Met, His, Ile, Leu, Val Ala, or Gly
  SITE (488)..(488): Xaa at position 488 is Leu, Ala, Val, Gly, or Ile
  SITE (492)..(492): Xaa at position 492 is Phe, Tyr, Met, His, Ile, Leu, Val Ala, or Gly
  SITE (495)..(495): Xaa at position 495 is Leu, Ala, Val, Gly, or Ile
  SITE (498)..(498): Xaa at position 498 is Leu, Ala, Val, Gly, or Ile
  SITE (501)..(501): Xaa at position 501 is Leu, Ala, Val, Gly, or Ile
  SITE (503)..(503): Xaa at position 503 is Leu, Ala, Val, Gly, or Ile
  SITE (506)..(506): Xaa at position 506 is Cys, Ala, Val, Gly, Ser, or Thr
  SITE (508)..(508): Xaa at position 508 is Leu, Ala, Val, Gly, or Ile
  SITE (515)..(515): Xaa at position 515 is Ala, Gly, or Pro
  SITE (516)..(516): Xaa at position 516 is Phe, Tyr, Met, His, Ile, Leu, Val Ala, or Gly
  SITE (519)..(519): Xaa at position 519 is Leu, Ala, Val, Gly, or Ile
  SITE (522)..(522): Xaa at position 522 is Leu, Ala, Val, Gly, or Ile
  SITE (524)..(524): Xaa at position 524 is Val, Ala, Gly, Leu, or Ile
  SITE (525)..(525): Xaa at position 525 is Leu, Ala, Val, Gly, or Ile
  SITE (527)..(527): Xaa at position 527 is Met, Ile, Leu, Val, Ala, or Gly
  SITE (532)..(532): Xaa at position 532 is Phe, Tyr, Met, His, Ile, Leu, Val Ala, or Gly
  SITE (533)..(533): Xaa at position 533 is Phe, Tyr, Met, His, Ile, Leu, Val Ala, or Gly
  SITE (535)..(535): Xaa at position 535 is Leu, Ala, Val, Gly, or Ile
  SITE (540)..(540): Xaa at position 540 is Tyr, Phe, Met, His, Ile, Leu, Val Ala, or Gly
  SITE (543)..(543): Xaa at position 543 is Leu, Ala, Val, Gly, or Ile
  SITE (546)..(546): Xaa at position 546 is Leu, Ala, Val, Gly, or Ile
  SITE (549)..(549): Xaa at position 549 is Leu, Ala, Val, Gly, or Ile
  SITE (551)..(551): Xaa at position 551 is Tyr, Phe, Met, His, Ile, Leu, Val Ala, or Gly
  SITE (556)..(556): Xaa at position 556 is Ile, Ala, Val, Leu, or Gly
  SITE (571)..(571): Xaa at position 571 is Leu, Ala, Val, Gly, or Ile
  SITE (574)..(574): Xaa at position 574 is Leu, Ala, Val, Gly, or Ile
  SITE (576)..(576): Xaa at position 576 is Leu, Ala, Val, Gly, or Ile
  SITE (581)..(581): Xaa at position 581 is Phe, Tyr, Met, His, Ile, Leu, Val Ala, or Gly
  SITE (590)..(590): Xaa at position 590 is Phe, Tyr, Met, His, Ile, Leu, Val Ala, or Gly
  SITE (591)..(591): Xaa at position 591 is Leu, Ala, Val, Gly, or Ile
  SITE (594)..(594): Xaa at position 594 is Ile, Ala, Val, Leu, or Gly
  SITE (600)..(600): Xaa at position 600 is Leu, Ala, Val, Gly, or Ile
  SITE (607)..(607): Xaa at position 607 is Met, Ile, Leu, Val, Ala, or Gly
  SITE (620)..(620): Xaa at position 620 is Val, Ala, Gly, Leu, or Ile
MMSASRLAGTLIPAMAFLSCVRPESWEPCVEVVPNITXQXMELNFYKIPDNLPFSTKNXDXSFNPLRHXGSYSXFSXPEXQVXDXSRXEXQTXEDGXXQSXSHXSTXIXTGNPXQSLALGXXSGXSSXQKXVXVETNLASXENFPXGHXKTXKEXNXXHNLXQSXKXPEYXSNXTNXEHXDXSSNKXQSXYCTDXRXXHQMPXLNXSXDXSLNPXNFXQPGXXKEXRXHKXTXRNNFDSLNVXKTXXQGLAGXEXHRXVXGEFRNEGNLEKXDKSXXEGXCNLTIEEXRXAYLDYXXDDXIDXXNCXTNXSSXSXVSXTXERXKDXSYNXGXQHXEXVNXKXGQFPTXKXKSXKRXTXTSNKXGNAFSEVDXPSXEFXDXSRNGXSXKGXXSQSDXGTTSXKYXDXSFNGVXTXSSNXLGXEQXEHXDXQHSNLKQXSEFSXXLSXRNXXYXDXSHTHTRXAFNGXXNGXSSXEVXKXAGNSXQENFXPDIXTEXRNXTFXDXSQXQXEQLSPTXXNSXSSXQXXNXSHNNXXSXDTFPXKCXNSXQVXDXSLNHXMTSKKQELQHFPSSXAFXNXTQNDXACTCEHQSXXQWXKDQRQXLVEVERXECATPSDKQGMPXLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 15 - protein, 468 aa, Homo sapiens
  SITE (132)..(132): Xaa at position 132 is Cys, Ala, Val, Gly, Ser, or Thr
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELXPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 16 - protein, 132 aa, Homo sapiens
  SITE (94)..(94): Xaa at position 94 is Cys, Ala, Val, Gly, Ser, or Thr
  SITE (119)..(119): Xaa at position 119 is Cys, Ala, Val, Gly, Ser, or Thr
MLTAAVLSCALLLALPATRGAQMGLAPMEGIRRPDQALLPELPGLGLRAPLKKTTAEQAEEDLLQEAQALAEVLDLQDREPRSSRRCVRLHESXLGQQVPCCDPCATCYCRFFNAFCYXRKLGTAMNPCSRT

SEQ ID NO: 17 - protein, 542 aa, Homo sapiens
  SITE (295)..(295): Xaa at position 295 is Val, Ala, Gly, Leu, or Ile
  SITE (307)..(307): Xaa at position 307 is Cys, Ala, Val, Gly, Ser, or Thr
  SITE (309)..(309): Xaa at position 309 is Leu, Ala, Val, Gly, or Ile
  SITE (326)..(326): Xaa at position 326 is Leu, Ala, Val, Gly, or Ile
  SITE (337)..(337): Xaa at position 337 is Leu, Ala, Val, Gly, or Ile
  SITE (352)..(352): Xaa at position 352 is Ile, Ala, Val, Leu, or Gly
  SITE (367)..(367): Xaa at position 367 is Ile, Ala, Val, Leu, or Gly
  SITE (370)..(370): Xaa at position 370 is Leu, Ala, Val, Gly, or Ile
  SITE (381)..(381): Xaa at position 381 is Val, Ala, Gly, Leu, or Ile
  SITE (382)..(382): Xaa at position 382 is Phe, Tyr, Met, His, Ile, Leu, Val Ala, or Gly
  SITE (403)..(403): Xaa at position 403 is Leu, Ala, Val, Gly, or Ile
  SITE (404)..(404): Xaa at position 404 is Ala, Gly, or Pro
  SITE (405)..(405): Xaa at position 405 is Ala, Gly, or Pro
  SITE (406)..(406): Xaa at position 406 is Val, Ala, Gly, Leu, or Ile
  SITE (423)..(423): Xaa at position 423 is Val, Ala, Gly, Leu, or Ile
  SITE (424)..(424): Xaa at position 424 is Ile, Ala, Val, Leu, or Gly
  SITE (425)..(425): Xaa at position 425 is Ile, Ala, Val, Leu, or Gly
  SITE (437)..(437): Xaa at position 437 is Ile, Ala, Val, Leu, or Gly
  SITE (446)..(446): Xaa at position 446 is Leu, Ala, Val, Gly, or Ile
  SITE (461)..(461): Xaa at position 461 is Leu, Ala, Val, Gly, or Ile
  SITE (493)..(493): Xaa at position 493 is Ile, Ala, Val, Leu, or Gly
  SITE (503)..(503): Xaa at position 503 is Val, Ala, Gly, Leu, or Ile
  SITE (504)..(504): Xaa at position 504 is Leu, Ala, Val, Gly, or Ile
  SITE (506)..(506): Xaa at position 506 is Phe, Tyr, Met, His, Ile, Leu, Val Ala, or Gly
  SITE (514)..(514): Xaa at position 514 is Phe, Tyr, Met, His, Ile, Leu, Val Ala, or Gly
  SITE (516)..(516): Xaa at position 516 is Leu, Ala, Val, Gly, or Ile
  SITE (518)..(518): Xaa at position 518 is Tyr, Phe, Met, His, Ile, Leu, Val Ala, or Gly
  SITE (522)..(522): Xaa at position 522 is Leu, Ala, Val, Gly, or Ile
  SITE (523)..(523): Xaa at position 523 is Cys, Ala, Val, Gly, Ser, or Thr
  SITE (524)..(524): Xaa at position 524 is Ala, Gly, or Pro
  SITE (525)..(525): Xaa at position 525 is Leu, Ala, Val, Gly, or Ile
  SITE (527)..(527): Xaa at position 527 is Ala, Gly, or Pro
  SITE (528)..(528): Xaa at position 528 is Phe, Tyr, Met, His, Ile, Leu, Val Ala, or Gly
  SITE (529)..(529): Xaa at position 529 is Ala, Gly, or Pro
  SITE (530)..(530): Xaa at position 530 is Ile, Ala, Val, Leu, or Gly
  SITE (531)..(531): Xaa at position 531 is Ala, Gly, or Pro
  SITE (532)..(532): Xaa at position 532 is Leu, Ala, Val, Gly, or Ile
  SITE (539)..(539): Xaa at position 539 is Leu, Ala, Val, Gly, or Ile
MPLRDETLREVWASDSGHEEESLSPEAPRRPKQRPAPAQRLRKKRTEAPESPCPTGSKPRKPGAGRTGRPREEPSPDPAQARAPQTVYARFLRDPEAKKRDPRETFLVARAPDAEDEEEEEEEDEEDEEEEAEEKKEKILLPPKKPLREKSSADLKERRAKAQGPRGDLGSPDPPPKPLRVRNKEAPAGEGTKMRKTKKKGSGEADKDPSGSPASARKSPAAMFLVGEGSPDKKALKKKGTPKGARKEEEEEEEAATVIKKSNQKGKAKGKGKKKAKEERAPSPPVEVDEPREFXLRPAPQGRTVRXRXTRDKKGMDRGMYPSYFXHLDTEKKVFLXAGRKRKRSKTANYLXSIDPTNLSRGGENFXGKXRSNLLGNRFTXXDNGQNPQRGYSTNVASLRQEXXXXIYETNVLGFRGPRRMTXXXPGMSAENERVPXRPRNASDGXLVRWQNKTLESLIEXHNKPPVWNDDSGSYTLNFQGRVTQASVKNFQXVHADDPDYIXXQXGRVAEDAXTXDXRYPXXXXQXXXXXXSSFDGKXACE

SEQ ID NO: 18 - protein, 401 aa, Homo sapiens
  SITE (41)..(41): Xaa at position 41 is Cys, Ala, Val, Gly, Ser, or Thr
  SITE (44)..(44): Xaa at position 44 is Cys, Ala, Val, Gly, Ser, or Thr
  SITE (65)..(65): Xaa at position 65 is Cys, Ala, Val, Gly, Ser, or Thr
  SITE (124)..(124): Xaa at position 124 is Cys, Ala, Val, Gly, Ser, or Thr
MNNLLCCALVFLDISIKWTTQETFPPKYLHYDEETSHQLLXDKXPPGTYLKQHCTAKWKTVCAPXPDHYYTDSWHTSDECLYCSPVCKELQYVKQECNRTHNRVCECKEGRYLEIEFCLKHRSXPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 19 - protein, 736 aa, Homo sapiens
  SITE (10)..(10): Xaa at position 10 is Ala, Gly, or Pro
  SITE (12)..(12): Xaa at position 12 is Val, Ala, Gly, Leu, or Ile
  SITE (13)..(13): Xaa at position 13 is Ala, Gly, or Pro
  SITE (14)..(14): Xaa at position 14 is Val, Ala, Gly, Leu, or Ile
  SITE (15)..(15): Xaa at position 15 is Ile, Ala, Val, Leu, or Gly
  SITE (28)..(28): Xaa at position 28 is Tyr, Phe, Met, His, Ile, Leu, Val Ala, or Gly
  SITE (33)..(33): Xaa at position 33 is Tyr, Phe, Met, His, Ile, Leu, Val Ala, or Gly
  SITE (35)..(35): Xaa at position 35 is Ile, Ala, Val, Leu, or Gly
  SITE (36)..(36): Xaa at position 36 is Leu, Ala, Val, Gly, or Ile
  SITE (37)..(37): Xaa at position 37 is Leu, Ala, Val, Gly, or Ile
  SITE (54)..(54): Xaa at position 54 is Leu, Ala, Val, Gly, or Ile
  SITE (68)..(68): Xaa at position 68 is Ile, Ala, Val, Leu, or Gly
  SITE (72)..(72): Xaa at position 72 is Val, Ala, Gly, Leu, or Ile
  SITE (108)..(108): Xaa at position 108 is Ala, Gly, or Pro
  SITE (110)..(110): Xaa at position 110 is Leu, Ala, Val, Gly, or Ile
  SITE (112)..(112): Xaa at position 112 is Ile, Ala, Val, Leu, or Gly
  SITE (113)..(113): Xaa at position 113 is Val, Ala, Gly, Leu, or Ile
  SITE (135)..(135): Xaa at position 135 is Leu, Ala, Val, Gly, or Ile
  SITE (152)..(152): Xaa at position 152 is Leu, Ala, Val, Gly, or Ile
  SITE (156)..(156): Xaa at position 156 is Met, Ile, Leu, Val, Ala, or Gly
  SITE (157)..(157): Xaa at position 157 is Leu, Ala, Val, Gly, or Ile
  SITE (160)..(160): Xaa at position 160 is Leu, Ala, Val, Gly, or Ile
  SITE (164)..(164): Xaa at position 164 is Leu, Ala, Val, Gly, or Ile
  SITE (174)..(174): Xaa at position 174 is Ile, Ala, Val, Leu, or Gly
  SITE (292)..(292): Xaa at position 292 is Leu, Ala, Val, Gly, or Ile
  SITE (293)..(293): Xaa at position 293 is His, Phe, Tyr, Lys, Arg, Gly, Ser Thr, Ala, Val, Leu, Ile, Asn, Met, or Gln
  SITE (296)..(296): Xaa at position 296 is Ala, Gly, or Pro
  SITE (304)..(304): Xaa at position 304 is Leu, Ala, Val, Gly, or Ile
  SITE (323)..(323): Xaa at position 323 is Ala, Gly, or Pro
  SITE (325)..(325): Xaa at position 325 is Ile, Ala, Val, Leu, or Gly
  SITE (326)..(326): Xaa at position 326 is His, Phe, Tyr, Lys, Arg, Gly, Ser Thr, Ala, Val, Leu, Ile, Asn, Met, or Gln
  SITE (328)..(328): Xaa at position 328 is Ala, Gly, or Pro
  SITE (329)..(329): Xaa at position 329 is Cys, Ala, Val, Gly, Ser, or Thr
  SITE (336)..(336): Xaa at position 336 is Ala, Gly, or Pro
  SITE (340)..(340): Xaa at position 340 is Leu, Ala, Val, Gly, or Ile
  SITE (346)..(346): Xaa at position 346 is Cys, Ala, Val, Gly, Ser, or Thr
  SITE (362)..(362): Xaa at position 362 is Ala, Gly, or Pro
  SITE (363)..(363): Xaa at position 363 is Ala, Gly, or Pro
  SITE (370)..(370): Xaa at position 370 is Ile, Ala, Val, Leu, or Gly
  SITE (371)..(371): Xaa at position 371 is Val, Ala, Gly, Leu, or Ile
  SITE (374)..(374): Xaa at position 374 is Leu, Ala, Val, Gly, or Ile
  SITE (396)..(396): Xaa at position 396 is Cys, Ala, Val, Gly, Ser, or Thr
  SITE (407)..(407): Xaa at position 407 is Ala, Gly, or Pro
  SITE (424)..(424): Xaa at position 424 is Ile, Ala, Val, Leu, or Gly
  SITE (434)..(434): Xaa at position 434 is Val, Ala, Gly, Leu, or Ile
  SITE (444)..(444): Xaa at position 444 is Val, Ala, Gly, Leu, or Ile
  SITE (447)..(447): Xaa at position 447 is Ile, Ala, Val, Leu, or Gly
  SITE (463)..(463): Xaa at position 463 is Ile, Ala, Val, Leu, or Gly
  SITE (465)..(465): Xaa at position 465 is Ile, Ala, Val, Leu, or Gly
  SITE (487)..(487): Xaa at position 487 is Trp, Tyr, Phe, Met, His, Ile, Leu Val, Ala, or Gly
  SITE (491)..(491): Xaa at position 491 is Leu, Ala, Val, Gly, or Ile
  SITE (508)..(508): Xaa at position 508 is Leu, Ala, Val, Gly, or Ile
  SITE (522)..(522): Xaa at position 522 is Ile, Ala, Val, Leu, or Gly
  SITE (527)..(527): Xaa at position 527 is Ala, Gly, or Pro
  SITE (528)..(528): Xaa at position 528 is Ile, Ala, Val, Leu, or Gly
  SITE (530)..(530): Xaa at position 530 is Ile, Ala, Val, Leu, or Gly
  SITE (531)..(531): Xaa at position 531 is Leu, Ala, Val, Gly, or Ile
  SITE (535)..(535): Xaa at position 535 is Ala, Gly, or Pro
  SITE (539)..(539): Xaa at position 539 is Leu, Ala, Val, Gly, or Ile
  SITE (546)..(546): Xaa at position 546 is Ala, Gly, or Pro
  SITE (551)..(551): Xaa at position 551 is Leu, Ala, Val, Gly, or Ile
  SITE (552)..(552): Xaa at position 552 is Ile, Ala, Val, Leu, or Gly
  SITE (554)..(554): Xaa at position 554 is Leu, Ala, Val, Gly, or Ile
  SITE (555)..(555): Xaa at position 555 is Ala, Gly, or Pro
  SITE (557)..(557): Xaa at position 557 is Leu, Ala, Val, Gly, or Ile
  SITE (558)..(558): Xaa at position 558 is Leu, Ala, Val, Gly, or Ile
  SITE (559)..(559): Xaa at position 559 is Leu, Ala, Val, Gly, or Ile
  SITE (571)..(571): Xaa at position 571 is His, Phe, Tyr, Lys, Arg, Gly, Ser Thr, Ala, Val, Leu, Ile, Asn, Met, or Gln
  SITE (584)..(584): Xaa at position 584 is Ile, Ala, Val, Leu, or Gly
  SITE (585)..(585): Xaa at position 585 is Val, Ala, Gly, Leu, or Ile
  SITE (590)..(590): Xaa at position 590 is Leu, Ala, Val, Gly, or Ile
  SITE (594)..(594): Xaa at position 594 is Ala, Gly, or Pro
  SITE (601)..(601): Xaa at position 601 is Ile, Ala, Val, Leu, or Gly
  SITE (605)..(605): Xaa at position 605 is Tyr, Phe, Met, His, Ile, Leu, Val Ala, or Gly
  SITE (621)..(621): Xaa at position 621 is Leu, Ala, Val, Gly, or Ile
  SITE (625)..(625): Xaa at position 625 is Phe, Tyr, Met, His, Ile, Leu, Val Ala, or Gly
  SITE (626)..(626): Xaa at position 626 is Leu, Ala, Val, Gly, or Ile
  SITE (629)..(629): Xaa at position 629 is Cys, Ala, Val, Gly, Ser, or Thr
  SITE (632)..(632): Xaa at position 632 is Ile, Ala, Val, Leu, or Gly
  SITE (658)..(658): Xaa at position 658 is Val, Ala, Gly, Leu, or Ile
  SITE (660)..(660): Xaa at position 660 is Val, Ala, Gly, Leu, or Ile
  SITE (662)..(662): Xaa at position 662 is Val, Ala, Gly, Leu, or Ile
  SITE (667)..(667): Xaa at position 667 is Leu, Ala, Val, Gly, or Ile
  SITE (668)..(668): Xaa at position 668 is His, Phe, Tyr, Lys, Arg, Gly, Ser Thr, Ala, Val, Leu, Ile, Asn, Met, or Gln
  SITE (669)..(669): Xaa at position 669 is Leu, Ala, Val, Gly, or Ile
  SITE (670)..(670): Xaa at position 670 is Leu, Ala, Val, Gly, or Ile
  SITE (697)..(697): Xaa at position 697 is Phe, Tyr, Met, His, Ile, Leu, Val Ala, or Gly
  SITE (699)..(699): Xaa at position 699 is Ile, Ala, Val, Leu, or Gly
  SITE (710)..(710): Xaa at position 710 is Val, Ala, Gly, Leu, or Ile
  SITE (715)..(715): Xaa at position 715 is Ala, Gly, or Pro
  SITE (718)..(718): Xaa at position 718 is Val, Ala, Gly, Leu, or Ile
  SITE (722)..(722): Xaa at position 722 is Leu, Ala, Val, Gly, or Ile
  SITE (725)..(725): Xaa at position 725 is Leu, Ala, Val, Gly, or Ile
MGNPENIEDXYXXXXRPKNTASLNSREXRAKSXEXXXHEVPIEGQKKKRKKVLXETKLQGNSEITQGXLDYXVETTKPISPANQGIRGKRVVLMKKFPLDGEKMGREXSXFXXPSVVKDNTKYTYTPGCPIFYCXQDIMRVCSESSTHFATXTARXXIAXDKWXDERHAQSHFXPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPXXRSXCEGDSELXSRLLSERFSVNQLDSDHWXPXXYXXWYGKVEXTRIXLEKGKXNPNLLNGQLSSPLHFXXGGGHAEXXQIXLNHPETDRHITDQQGRSPLNIXEENKQNNWEEXAKLLKEAINKPYEKVRXYRMDGSYRSXELKHGNNTTXQQXMEGMRLSQETQQYFTXWXCSENLSLQLKPYHKPLQHVRDXPEIXAELTNLDPQRETPQLFXRRDVRLPLEVEKQXEDPLXXLXXFDEXRYNXLKGFYTXPDAKXXTXXSXXXQIVYGNYESKKXKQGFLNEENLKSXXPVTKXKSKXPHWTNRXLHEXKNLSTSEGVSKEMHHXQRMXXQNXWEXPTYGAAFFTGQIFTKASPSNHKVIPXYXGXNIKGXXXXNMETKALLISLKYGCFMWQLGDTDTCXQXHSMENKMSFIXHTKQXGLXVKLXMKXNGQLMPTERNS

SEQ ID NO: 20 - protein, 134 aa, Homo sapiens
  SITE (63)..(63): Xaa at position 63 is Leu, Ala, Val, Gly, or Ile
  SITE (64)..(64): Xaa at position 64 is Phe, Tyr, Met, His, Ile, Leu, Val Ala, or Gly
  SITE (75)..(75): Xaa at position 75 is Cys, Ala, Val, Gly, Ser, or Thr
  SITE (76)..(76): Xaa at position 76 is Ala, Gly, or Pro
  SITE (83)..(83): Xaa at position 83 is Val, Ala, Gly, Leu, or Ile
MAQSLALSLLILVLAFGIPRTQGSDGGAQDCCLKYSQRKIPAKVVRSYRKQEPSLGCSIPAIXXLPRKRSQAELXXDPKELWXQQLMQHLDKTPSPQKPAQGCRKDRGASKTGKKGKGSKGCKRTERSQTPKGP

SEQ ID NO: 21 - protein, 1011 aa, Homo sapiens
  SITE (241)..(241): Xaa at position 241 is Ala, Gly, or Pro
  SITE (306)..(306): Xaa at position 306 is Tyr, Phe, Met, His, Ile, Leu, Val Ala, or Gly
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRXSTSLKPPTADLFTGVLPNGYNPPRNLCWDVLCVDQPLVEDPRSPEYNAKELVDYFLNVATAQGRXYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 22 - protein, 1441 aa, Homo sapiens
  SITE (74)..(74): Xaa at position 74 is Phe, Tyr, Met, His, Ile, Leu, Val Ala, or Gly
  SITE (75)..(75): Xaa at position 75 is Met, Ile, Leu, Val, Ala, or Gly
  SITE (77)..(77): Xaa at position 77 is Val, Ala, Gly, Leu, or Ile
  SITE (88)..(88): Xaa at position 88 is Ala, Gly, or Pro
  SITE (90)..(90): Xaa at position 90 is Leu, Ala, Val, Gly, or Ile
  SITE (92)..(92): Xaa at position 92 is Leu, Ala, Val, Gly, or Ile
  SITE (101)..(101): Xaa at position 101 is His, Phe, Tyr, Lys, Arg, Gly, Ser Thr, Ala, Val, Leu, Ile, Asn, Met, or Gln
  SITE (105)..(105): Xaa at position 105 is Phe, Tyr, Met, His, Ile, Leu, Val Ala, or Gly
  SITE (120)..(120): Xaa at position 120 is Leu, Ala, Val, Gly, or Ile
  SITE (122)..(122): Xaa at position 122 is Val, Ala, Gly, Leu, or Ile
  SITE (124)..(124): Xaa at position 124 is Val, Ala, Gly, Leu, or Ile
  SITE (135)..(135): Xaa at position 135 is Val, Ala, Gly, Leu, or Ile
  SITE (149)..(149): Xaa at position 149 is Ala, Gly, or Pro
  SITE (151)..(151): Xaa at position 151 is Leu, Ala, Val, Gly, or Ile
  SITE (152)..(152): Xaa at position 152 is Ala, Gly, or Pro
  SITE (153)..(153): Xaa at position 153 is Ile, Ala, Val, Leu, or Gly
  SITE (161)..(161): Xaa at position 161 is Tyr, Phe, Met, His, Ile, Leu, Val Ala, or Gly
  SITE (163)..(163): Xaa at position 163 is Val, Ala, Gly, Leu, or Ile
  SITE (165)..(165): Xaa at position 165 is Phe, Tyr, Met, His, Ile, Leu, Val Ala, or Gly
  SITE (177)..(177): Xaa at position 177 is Ile, Ala, Val, Leu, or Gly
  SITE (178)..(178): Xaa at position 178 is Ala, Gly, or Pro
  SITE (179)..(179): Xaa at position 179 is Val, Ala, Gly, Leu, or Ile
  SITE (184)..(184): Xaa at position 184 is Val, Ala, Gly, Leu, or Ile
  SITE (211)..(211): Xaa at position 211 is Phe, Tyr, Met, His, Ile, Leu, Val Ala, or Gly
  SITE (213)..(213): Xaa at position 213 is Cys, Ala, Val, Gly, Ser, or Thr
  SITE (227)..(227): Xaa at position 227 is Leu, Ala, Val, Gly, or Ile
  SITE (250)..(250): Xaa at position 250 is Ala, Gly, or Pro
  SITE (252)..(252): Xaa at position 252 is Val, Ala, Gly, Leu, or Ile
  SITE (265)..(265): Xaa at position 265 is Tyr, Phe, Met, His, Ile, Leu, Val Ala, or Gly
  SITE (267)..(267): Xaa at position 267 is Cys, Ala, Val, Gly, Ser, or Thr
  SITE (268)..(268): Xaa at position 268 is Val, Ala, Gly, Leu, or Ile
  SITE (269)..(269): Xaa at position 269 is Ile, Ala, Val, Leu, or Gly
  SITE (277)..(277): Xaa at position 277 is Val, Ala, Gly, Leu, or Ile
  SITE (281)..(281): Xaa at position 281 is Ala, Gly, or Pro
  SITE (305)..(305): Xaa at position 305 is Leu, Ala, Val, Gly, or Ile
  SITE (307)..(307): Xaa at position 307 is Ile, Ala, Val, Leu, or Gly
  SITE (325)..(325): Xaa at position 325 is Val, Ala, Gly, Leu, or Ile
  SITE (358)..(358): Xaa at position 358 is Ile, Ala, Val, Leu, or Gly
  SITE (362)..(362): Xaa at position 362 is Leu, Ala, Val, Gly, or Ile
  SITE (403)..(403): Xaa at position 403 is Leu, Ala, Val, Gly, or Ile
  SITE (405)..(405): Xaa at position 405 is Leu, Ala, Val, Gly, or Ile
  SITE (417)..(417): Xaa at position 417 is Cys, Ala, Val, Gly, Ser, or Thr
  SITE (424)..(424): Xaa at position 424 is Val, Ala, Gly, Leu, or Ile
  SITE (449)..(449): Xaa at position 449 is Leu, Ala, Val, Gly, or Ile
  SITE (458)..(458): Xaa at position 458 is Ile, Ala, Val, Leu, or Gly
  SITE (460)..(460): Xaa at position 460 is Leu, Ala, Val, Gly, or Ile
  SITE (462)..(462): Xaa at position 462 is Leu, Ala, Val, Gly, or Ile
  SITE (464)..(464): Xaa at position 464 is Leu, Ala, Val, Gly, or Ile
  SITE (502)..(502): Xaa at position 502 is Ile, Ala, Val, Leu, or Gly
  SITE (504)..(504): Xaa at position 504 is Ile, Ala, Val, Leu, or Gly
  SITE (519)..(519): Xaa at position 519 is Tyr, Phe, Met, His, Ile, Leu, Val Ala, or Gly
  SITE (521)..(521): Xaa at position 521 is Ile, Ala, Val, Leu, or Gly
  SITE (553)..(553): Xaa at position 553 is Phe, Tyr, Met, His, Ile, Leu, Val Ala, or Gly
  SITE (562)..(562): Xaa at position 562 is Tyr, Phe, Met, His, Ile, Leu, Val Ala, or Gly
  SITE (564)..(564): Xaa at position 564 is Phe, Tyr, Met, His, Ile, Leu, Val Ala, or Gly
  SITE (566)..(566): Xaa at position 566 is Ile, Ala, Val, Leu, or Gly
  SITE (568)..(568): Xaa at position 568 is Ala, Gly, or Pro
  SITE (578)..(578): Xaa at position 578 is Val, Ala, Gly, Leu, or Ile
MASLAALALSLLLRLQLPPLPGARAQSAAGGCSFDEHYSNCGYSVALGTNGFTWEQINTWEKPMLDQAVPTGSXXMXNSSGRASGQKXHXLXPTLKENDTXCIDXHYYFSSRDRSSPGAXNXYXKVNGGPQGNPXWNVSGVVTEGWVKXEXXXSTFWPHFXQXIXESVSLKGHPGYXXXDEVRXLAHPCRKAPHFLRLQNVEVNVGQNATXQXIAGGKWSQHDKLWXQQWNGRDTALMVTRVVNHRRFSXTXSVADTAQRSVSKXRXXXRSDGGSGXSNYXELIVKEPPTPIAPPELLAVGATYXWXKPNANSIIGDGPIILKEXEYRTTTGTWAETHIVDSPNYKLWHLDPDVEYEXRVLXTRPGEGGTGPPGPPLTTRTKCADPVHGPQNVEIVDIRARQXTXQWEPFGYAVTRXHSYNLTXQYQYVFNQQQYEAEEVIQTSSHYTXRGLRPFMTXRXRXLXSNPEGRMESEELVVQTEEDVPGAVPLESIQGGPFEEKXYXQWKPPNETNGVITLXEXNYKAVGSLDPSADLSSQRGKVFKLRNETHHLXVGLYPGTTXSXTXKXSTAKGFGPPXTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 23 - protein, 440 aa, Homo sapiens
  SITE (81)..(81): Xaa at position 81 is Cys, Ala, Val, Gly, Ser, or Thr
  SITE (139)..(139): Xaa at position 139 is Cys, Ala, Val, Gly, Ser, or Thr
MEQRGQNAPAASGARKRHGPGPREARGARPGPRVPKTLVLVVAAVLLLVSAESALITQQDLAPQQRAAPQQKRSSPSEGLXPPGHHISEDGRDCISCKYGQDYSTHWNDLLFCLRCTRCDSGEVELSPCTTTRNTVCQXEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 24 - protein, 563 aa, Homo sapiens
  SITE (49)..(49): Xaa at position 49 is Leu, Ala, Val, Gly, or Ile
  SITE (51)..(51): Xaa at position 51 is Phe, Tyr, Met, His, Ile, Leu, Val Ala, or Gly
  SITE (52)..(52): Xaa at position 52 is Ala, Gly, or Pro
  SITE (61)..(61): Xaa at position 61 is Leu, Ala, Val, Gly, or Ile
  SITE (65)..(65): Xaa at position 65 is Val, Ala, Gly, Leu, or Ile
  SITE (80)..(80): Xaa at position 80 is Leu, Ala, Val, Gly, or Ile
  SITE (82)..(82): Xaa at position 82 is Leu, Ala, Val, Gly, or Ile
  SITE (85)..(85): Xaa at position 85 is Val, Ala, Gly, Leu, or Ile
  SITE (86)..(86): Xaa at position 86 is Ala, Gly, or Pro
  SITE (89)..(89): Xaa at position 89 is Val, Ala, Gly, Leu, or Ile
  SITE (99)..(99): Xaa at position 99 is Val, Ala, Gly, Leu, or Ile
  SITE (105)..(105): Xaa at position 105 is Ala, Gly, or Pro
  SITE (119)..(119): Xaa at position 119 is Phe, Tyr, Met, His, Ile, Leu, Val Ala, or Gly
  SITE (122)..(122): Xaa at position 122 is Cys, Ala, Val, Gly, Ser, or Thr
  SITE (124)..(124): Xaa at position 124 is Leu, Ala, Val, Gly, or Ile
  SITE (126)..(126): Xaa at position 126 is Ile, Ala, Val, Leu, or Gly
  SITE (129)..(129): Xaa at position 129 is Ala, Gly, or Pro
  SITE (133)..(133): Xaa at position 133 is Leu, Ala, Val, Gly, or Ile
  SITE (138)..(138): Xaa at position 138 is Phe, Tyr, Met, His, Ile, Leu, Val Ala, or Gly
  SITE (150)..(150): Xaa at position 150 is Val, Ala, Gly, Leu, or Ile
  SITE (157)..(157): Xaa at position 157 is Tyr, Phe, Met, His, Ile, Leu, Val Ala, or Gly
  SITE (159)..(159): Xaa at position 159 is Leu, Ala, Val, Gly, or Ile
  SITE (167)..(167): Xaa at position 167 is Val, Ala, Gly, Leu, or Ile
  SITE (169)..(169): Xaa at position 169 is Phe, Tyr, Met, His, Ile, Leu, Val Ala, or Gly
  SITE (170)..(170): Xaa at position 170 is Val, Ala, Gly, Leu, or Ile
  SITE (173)..(173): Xaa at position 173 is Leu, Ala, Val, Gly, or Ile
  SITE (200)..(200): Xaa at position 200 is Val, Ala, Gly, Leu, or Ile
  SITE (209)..(209): Xaa at position 209 is Tyr, Phe, Met, His, Ile, Leu, Val Ala, or Gly
  SITE (226)..(226): Xaa at position 226 is Ala, Gly, or Pro
  SITE (227)..(227): Xaa at position 227 is Cys, Ala, Val, Gly, Ser, or Thr
  SITE (228)..(228): Xaa at position 228 is Ala, Gly, or Pro
  SITE (230)..(230): Xaa at position 230 is Phe, Tyr, Met, His, Ile, Leu, Val Ala, or Gly
  SITE (240)..(240): Xaa at position 240 is Leu, Ala, Val, Gly, or Ile
  SITE (243)..(243): Xaa at position 243 is Phe, Tyr, Met, His, Ile, Leu, Val Ala, or Gly
  SITE (277)..(277): Xaa at position 277 is Val, Ala, Gly, Leu, or Ile
  SITE (279)..(279): Xaa at position 279 is Tyr, Phe, Met, His, Ile, Leu, Val Ala, or Gly
  SITE (280)..(280): Xaa at position 280 is Leu, Ala, Val, Gly, or Ile
  SITE (281)..(281): Xaa at position 281 is Met, Ile, Leu, Val, Ala, or Gly
  SITE (283)..(283): Xaa at position 283 is Ala, Gly, or Pro
  SITE (285)..(285): Xaa at position 285 is Ala, Gly, or Pro
  SITE (287)..(287): Xaa at position 287 is Ile, Ala, Val, Leu, or Gly
  SITE (304)..(304): Xaa at position 304 is Phe, Tyr, Met, His, Ile, Leu, Val Ala, or Gly
  SITE (305)..(305): Xaa at position 305 is Leu, Ala, Val, Gly, or Ile
  SITE (307)..(307): Xaa at position 307 is Trp, Tyr, Phe, Met, His, Ile, Leu Val, Ala, or Gly
  SITE (308)..(308): Xaa at position 308 is Leu, Ala, Val, Gly, or Ile
  SITE (320)..(320): Xaa at position 320 is Val, Ala, Gly, Leu, or Ile
  SITE (321)..(321): Xaa at position 321 is His, Phe, Tyr, Lys, Arg, Gly, Ser Thr, Ala, Val, Leu, Ile, Asn, Met, or Gln
  SITE (323)..(323): Xaa at position 323 is Val, Ala, Gly, Leu, or Ile
  SITE (336)..(336): Xaa at position 336 is Tyr, Phe, Met, His, Ile, Leu, Val Ala, or Gly
  SITE (337)..(337): Xaa at position 337 is Ile, Ala, Val, Leu, or Gly
  SITE (340)..(340): Xaa at position 340 is Val, Ala, Gly, Leu, or Ile
  SITE (344)..(344): Xaa at position 344 is Leu, Ala, Val, Gly, or Ile
  SITE (347)..(347): Xaa at position 347 is Ala, Gly, or Pro
  SITE (348)..(348): Xaa at position 348 is Ala, Gly, or Pro
  SITE (349)..(349): Xaa at position 349 is Ala, Gly, or Pro
  SITE (355)..(355): Xaa at position 355 is Leu, Ala, Val, Gly, or Ile
  SITE (356)..(356): Xaa at position 356 is Phe, Tyr, Met, His, Ile, Leu, Val Ala, or Gly
  SITE (363)..(363): Xaa at position 363 is Ala, Gly, or Pro
  SITE (378)..(378): Xaa at position 378 is Phe, Tyr, Met, His, Ile, Leu, Val Ala, or Gly
  SITE (380)..(380): Xaa at position 380 is Ala, Gly, or Pro
  SITE (385)..(385): Xaa at position 385 is Val, Ala, Gly, Leu, or Ile
  SITE (388)..(388): Xaa at position 388 is Val, Ala, Gly, Leu, or Ile
  SITE (397)..(397): Xaa at position 397 is Phe, Tyr, Met, His, Ile, Leu, Val Ala, or Gly
  SITE (404)..(404): Xaa at position 404 is Val, Ala, Gly, Leu, or Ile
  SITE (426)..(426): Xaa at position 426 is Val, Ala, Gly, Leu, or Ile
  SITE (448)..(448): Xaa at position 448 is Ala, Gly, or Pro
  SITE (452)..(452): Xaa at position 452 is Val, Ala, Gly, Leu, or Ile
  SITE (453)..(453): Xaa at position 453 is Ala, Gly, or Pro
  SITE (454)..(454): Xaa at position 454 is Ala, Gly, or Pro
  SITE (455)..(455): Xaa at position 455 is Leu, Ala, Val, Gly, or Ile
  SITE (459)..(459): Xaa at position 459 is Tyr, Phe, Met, His, Ile, Leu, Val Ala, or Gly
  SITE (461)..(461): Xaa at position 461 is Val, Ala, Gly, Leu, or Ile
  SITE (462)..(462): Xaa at position 462 is Val, Ala, Gly, Leu, or Ile
  SITE (471)..(471): Xaa at position 471 is Val, Ala, Gly, Leu, or Ile
  SITE (476)..(476): Xaa at position 476 is Ala, Gly, or Pro
  SITE (480)..(480): Xaa at position 480 is Val, Ala, Gly, Leu, or Ile
  SITE (481)..(481): Xaa at position 481 is Phe, Tyr, Met, His, Ile, Leu, Val Ala, or Gly
  SITE (484)..(484): Xaa at position 484 is Ile, Ala, Val, Leu, or Gly
  SITE (485)..(485): Xaa at position 485 is Leu, Ala, Val, Gly, or Ile
  SITE (487)..(487): Xaa at position 487 is Leu, Ala, Val, Gly, or Ile
  SITE (488)..(488): Xaa at position 488 is Ile, Ala, Val, Leu, or Gly
  SITE (518)..(518): Xaa at position 518 is Val, Ala, Gly, Leu, or Ile
  SITE (523)..(523): Xaa at position 523 is His, Phe, Tyr, Lys, Arg, Gly, Ser Thr, Ala, Val, Leu, Ile, Asn, Met, or Gln
  SITE (526)..(526): Xaa at position 526 is Cys, Ala, Val, Gly, Ser, or Thr
  SITE (536)..(536): Xaa at position 536 is Phe, Tyr, Met, His, Ile, Leu, Val Ala, or Gly
  SITE (545)..(545): Xaa at position 545 is Val, Ala, Gly, Leu, or Ile
  SITE (556)..(556): Xaa at position 556 is Leu, Ala, Val, Gly, or Ile
  SITE (560)..(560): Xaa at position 560 is Leu, Ala, Val, Gly, or Ile
MGLQACLLGLFALILSGKCSYSPEPDQRRTLPPGWVSLGRADPEEELSXTXXLRQQNVERXSELXQAVSDPSSPQYGKYXTXENXXDLXRPSPLTLHTXQKWLLXAGAQKCHSVITQDXLTXWXSXRQXELLXPGAEXHHYVGGPTETHXVRSPHPXQXPQALAPHXDXXGGXHRFPPTSSLRQRPEPQVTGTVGLHLGXTPSVIRKRXNLTSQDVGSGTSNNSQXXXQXLEQYFHDSDXAQXMRLFGGNFAHQASVARVVGQQGRGRAGIEASLDXQXXXSXGXNXSTWVYSSPGRHEGQEPXXQXXMLLSNESALPHXXTXSYGDDEDSLSSAXXQRXNTEXMKXXXRGLTLXXASGDSGXGCWSVSGRHQFRPTXPXSSPYXTTXGGTSFQEPXLITNEIXDYISGGGFSNVFPRPSYQEEAXTKFLSSSPHLPPSSYFNASGRXYPDXXXXSDGXWXXSNRVPIPWXSGTSXSTPXXGGXXSXXNEHRILSGRPPLGFLNPRLYQQHGAGLFDXTRGCXESXLDEEVEGQGXCSGPGWDPXTGWGTPNFPAXLKTXLNP

SEQ ID NO: 25 - protein, 317 aa, Homo sapiens
  SITE (168)..(168): Xaa at position 168 is Leu, Ala, Val, Gly, or Ile
  SITE (170)..(170): Xaa at position 170 is Ile, Ala, Val, Leu, or Gly
  SITE (184)..(184): Xaa at position 184 is Leu, Ala, Val, Gly, or Ile
  SITE (206)..(206): Xaa at position 206 is Leu, Ala, Val, Gly, or Ile
  SITE (208)..(208): Xaa at position 208 is Val, Ala, Gly, Leu, or Ile
  SITE (214)..(214): Xaa at position 214 is Tyr, Phe, Met, His, Ile, Leu, Val Ala, or Gly
  SITE (216)..(216): Xaa at position 216 is Leu, Ala, Val, Gly, or Ile
  SITE (218)..(218): Xaa at position 218 is Ala, Gly, or Pro
  SITE (220)..(220): Xaa at position 220 is Ile, Ala, Val, Leu, or Gly
  SITE (222)..(222): Xaa at position 222 is Phe, Tyr, Met, His, Ile, Leu, Val Ala, or Gly
  SITE (238)..(238): Xaa at position 238 is Leu, Ala, Val, Gly, or Ile
  SITE (240)..(240): Xaa at position 240 is Val, Ala, Gly, Leu, or Ile
  SITE (242)..(242): Xaa at position 242 is Val, Ala, Gly, Leu, or Ile
  SITE (283)..(283): Xaa at position 283 is Leu, Ala, Val, Gly, or Ile
  SITE (289)..(289): Xaa at position 289 is Ile, Ala, Val, Leu, or Gly
  SITE (291)..(291): Xaa at position 291 is Ile, Ala, Val, Leu, or Gly
  SITE (293)..(293): Xaa at position 293 is Val, Ala, Gly, Leu, or Ile
  SITE (310)..(310): Xaa at position 310 is Ala, Gly, or Pro
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHXTXNATDIPSGSHKVSXSSWYHDRGWAKISNMTFSNGKXIXNQDGFXYXYXNXCXRHHETSGDLATEYLQXMXYXTKTSIKIPSSHTLMKGGSTKYWSGNSEFHFYSINVGGFFKXRSGEEXSXEXSNPSLLDPDQDATYFGXFKVRDID

SEQ ID NO: 26 - protein, 375 aa, Homo sapiens
  SITE (281)..(281): Xaa at position 281 is Cys, Ala, Val, Gly, Ser, or Thr
  SITE (282)..(282): Xaa at position 282 is Cys, Ala, Val, Gly, Ser, or Thr
  SITE (372)..(372): Xaa at position 372 is Cys, Ala, Val, Gly, Ser, or Thr
  SITE (374)..(374): Xaa at position 374 is Cys, Ala, Val, Gly, Ser, or Thr
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRXXRYPLTVDFEAFGWDWIIAPKRYKANYCSGECEFVFLQKYPHTHLVHQANPRGSAGPCCTPTKMSPINMLYFNGKEQIIYGKIPAMVVDRXGXS

SEQ ID NO: 27 - protein, 208 aa, Homo sapiens
  SITE (11)..(11): Xaa at position 11 is Leu, Ala, Val, Gly, or Ile
  SITE (14)..(14): Xaa at position 14 is Tyr, Phe, Met, His, Ile, Leu, Val Ala, or Gly
  SITE (16)..(16): Xaa at position 16 is Leu, Ala, Val, Gly, or Ile
  SITE (17)..(17): Xaa at position 17 is Val, Ala, Gly, Leu, or Ile
  SITE (18)..(18): Xaa at position 18 is Val, Ala, Gly, Leu, or Ile
  SITE (19)..(19): Xaa at position 19 is Val, Ala, Gly, Leu, or Ile
  SITE (24)..(24): Xaa at position 24 is Val, Ala, Gly, Leu, or Ile
  SITE (29)..(29): Xaa at position 29 is Leu, Ala, Val, Gly, or Ile
  SITE (33)..(33): Xaa at position 33 is Phe, Tyr, Met, His, Ile, Leu, Val Ala, or Gly
  SITE (39)..(39): Xaa at position 39 is Val, Ala, Gly, Leu, or Ile
  SITE (56)..(56): Xaa at position 56 is Ile, Ala, Val, Leu, or Gly
  SITE (61)..(61): Xaa at position 61 is Ala, Gly, or Pro
  SITE (62)..(62): Xaa at position 62 is Ile, Ala, Val, Leu, or Gly
  SITE (63)..(63): Xaa at position 63 is Leu, Ala, Val, Gly, or Ile
  SITE (65)..(65): Xaa at position 65 is Val, Ala, Gly, Leu, or Ile
  SITE (66)..(66): Xaa at position 66 is Leu, Ala, Val, Gly, or Ile
  SITE (69)..(69): Xaa at position 69 is Ala, Gly, or Pro
  SITE (77)..(77): Xaa at position 77 is Met, Ile, Leu, Val, Ala, or Gly
  SITE (82)..(82): Xaa at position 82 is Met, Ile, Leu, Val, Ala, or Gly
  SITE (88)..(88): Xaa at position 88 is Phe, Tyr, Met, His, Ile, Leu, Val Ala, or Gly
  SITE (89)..(89): Xaa at position 89 is Leu, Ala, Val, Gly, or Ile
  SITE (90)..(90): Xaa at position 90 is Ile, Ala, Val, Leu, or Gly
  SITE (91)..(91): Xaa at position 91 is Val, Ala, Gly, Leu, or Ile
  SITE (92)..(92): Xaa at position 92 is Tyr, Phe, Met, His, Ile, Leu, Val Ala, or Gly
  SITE (94)..(94): Xaa at position 94 is Val, Ala, Gly, Leu, or Ile
  SITE (103)..(103): Xaa at position 103 is Val, Ala, Gly, Leu, or Ile
  SITE (106)..(106): Xaa at position 106 is Phe, Tyr, Met, His, Ile, Leu, Val Ala, or Gly
  SITE (110)..(110): Xaa at position 110 is Ile, Ala, Val, Leu, or Gly
  SITE (113)..(113): Xaa at position 113 is Val, Ala, Gly, Leu, or Ile
  SITE (119)..(119): Xaa at position 119 is Phe, Tyr, Met, His, Ile, Leu, Val Ala, or Gly
  SITE (121)..(121): Xaa at position 121 is Met, Ile, Leu, Val, Ala, or Gly
  SITE (122)..(122): Xaa at position 122 is Ile, Ala, Val, Leu, or Gly
  SITE (123)..(123): Xaa at position 123 is Leu, Ala, Val, Gly, or Ile
  SITE (124)..(124): Xaa at position 124 is Val, Ala, Gly, Leu, or Ile
  SITE (125)..(125): Xaa at position 125 is Ala, Gly, or Pro
  SITE (136)..(136): Xaa at position 136 is Ile, Ala, Val, Leu, or Gly
  SITE (145)..(145): Xaa at position 145 is Ala, Gly, or Pro
  SITE (157)..(157): Xaa at position 157 is Ala, Gly, or Pro
  SITE (164)..(164): Xaa at position 164 is Val, Ala, Gly, Leu, or Ile
  SITE (167)..(167): Xaa at position 167 is Ala, Gly, or Pro
  SITE (168)..(168): Xaa at position 168 is Phe, Tyr, Met, His, Ile, Leu, Val Ala, or Gly
  SITE (171)..(171): Xaa at position 171 is Leu, Ala, Val, Gly, or Ile
  SITE (172)..(172): Xaa at position 172 is Val, Ala, Gly, Leu, or Ile
MATSAVPSDNXPTXKXXXXGDGGXGKSAXTIQXFQKIFXPDYDPTIEDSYLKHTEXDNQWXXXDXXDTXGQEEFSAXREQYXRTGDGXXXXXSXTDKASFEHXDRXHQLXLRXKDRESXPXXXXXNKVDLMHLRKXTREQGKEMXTKHNIPYIETSXKDPPLNXDKXXHDXXRVIRQQIPEKSQKKKKKTKWRGDRATGTHKLQCVIL

SEQ ID NO: 28 - protein, 293 aa, Homo sapiens
  SITE (89)..(89): Xaa at position 89 is Cys, Ala, Val, Gly, Ser, or Thr
  SITE (100)..(100): Xaa at position 100 is Cys, Ala, Val, Gly, Ser, or Thr
  SITE (101)..(101): Xaa at position 101 is Ala, Gly, or Pro
MSGLGRSRRGGRSRVDQEERFPQGLWTGVAMRSCPEEQYWDPLLGTCMSCKTICNHQSQRTCAAFCRSLSCRKEQGKFYDHLLRDCISXASICGQHPKQXXYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 29 - protein, 467 aa, Homo sapiens
  SITE (449)..(449): Xaa at position 449 is Trp, Tyr, Phe, Met, His, Ile, Leu Val, Ala, or Gly
MALHPRRVRLKPWLVAQVDSGLYPGLIWLHRDSKRFQIPWKHATRHSPQQEEENTIFKAWAVETGKYQEGVDDPDPAKWKAQLRCALNKSREFNLMYDGTKEVPMNPVKIYQVCDIPQPQGSIINPGSTGSAPWDEKDNDVDEEDEEDELDQSQHHVPIQDTFPFLNINGSPMAPASVGNCSVGNCSPEAVWPKTEPLEMEVPQAPIQPFYSSPELWISSLPMTDLDIKFQYRGKEYGQTMTVSNPQGCRLFYGDLGPMPDQEELFGPVSLEQVKFPGPEHITNEKQKLFTSKLLDVMDRGLILEVSGHAIYAIRLCQCKVYWSGPCAPSLVAPNLIERQKKVKLFCLETFLSDLIAHQKGQIEKQPPFEIYLCFGEEWPDGKPLERKLILVQVIPVVARMIYEMFSGDFTRSFDSGSVRLQISTPDIKDNIVAQLKQLYRILQTQESXQPMQPTPSMQLPPALPPQ

SEQ ID NO: 30 - protein, 201 aa, Homo sapiens
  SITE (35)..(35): Xaa at position 35 is Ala, Gly, or Pro
  SITE (37)..(37): Xaa at position 37 is Leu, Ala, Val, Gly, or Ile
  SITE (39)..(39): Xaa at position 39 is Cys, Ala, Val, Gly, Ser, or Thr
  SITE (49)..(49): Xaa at position 49 is Ala, Gly, or Pro
  SITE (56)..(56): Xaa at position 56 is Phe, Tyr, Met, His, Ile, Leu, Val Ala, or Gly
  SITE (89)..(89): Xaa at position 89 is His, Phe, Tyr, Lys, Arg, Gly, Ser Thr, Ala, Val, Leu, Ile, Asn, Met, or Gln
  SITE (91)..(91): Xaa at position 91 is Ala, Gly, or Pro
  SITE (95)..(95): Xaa at position 95 is Ile, Ala, Val, Leu, or Gly
  SITE (98)..(98): Xaa at position 98 is Val, Ala, Gly, Leu, or Ile
  SITE (105)..(105): Xaa at position 105 is Ile, Ala, Val, Leu, or Gly
  SITE (106)..(106): Xaa at position 106 is Tyr, Phe, Met, His, Ile, Leu, Val Ala, or Gly
  SITE (108)..(108): Xaa at position 108 is Cys, Ala, Val, Gly, Ser, or Thr
  SITE (110)..(110): Xaa at position 110 is Val, Ala, Gly, Leu, or Ile
  SITE (112)..(112): Xaa at position 112 is Val, Ala, Gly, Leu, or Ile
  SITE (125)..(125): Xaa at position 125 is Leu, Ala, Val, Gly, or Ile
MAWMLLLILIMVHPGSCALWVSQPPEIRTLEGSSXFXPXSFNASQGRLXIGSVTWXRDEVVPGKEVRNGTPEFRGRLAPLASSRFLHDXQXELHXRDXRGHDASXXVXRXEXLGLGVGTGNGTRXVVEKEHPQLGAGTVLLLRAGFYAVSFLSVAVGSTVYYQGKCLTWKGPRRQLPAVVPAPLPPPCGSSAHLLPPVPGG

SEQ ID NO: 31 - protein, 926 aa, Homo sapiens
  SITE (8)..(8): Xaa at position 8 is Phe, Tyr, Met, His, Ile, Leu, Val Ala, or Gly
  SITE (15)..(15): Xaa at position 15 is Cys, Ala, Val, Gly, Ser, or Thr
  SITE (26)..(26): Xaa at position 26 is Val, Ala, Gly, Leu, or Ile
  SITE (29)..(29): Xaa at position 29 is Cys, Ala, Val, Gly, Ser, or Thr
  SITE (40)..(40): Xaa at position 40 is Val, Ala, Gly, Leu, or Ile
  SITE (45)..(45): Xaa at position 45 is Val, Ala, Gly, Leu, or Ile
  SITE (48)..(48): Xaa at position 48 is Phe, Tyr, Met, His, Ile, Leu, Val Ala, or Gly
  SITE (59)..(59): Xaa at position 59 is Leu, Ala, Val, Gly, or Ile
  SITE (69)..(69): Xaa at position 69 is Leu, Ala, Val, Gly, or Ile
  SITE (74)..(74): Xaa at position 74 is Ile, Ala, Val, Leu, or Gly
  SITE (77)..(77): Xaa at position 77 is Leu, Ala, Val, Gly, or Ile
  SITE (87)..(87): Xaa at position 87 is Leu, Ala, Val, Gly, or Ile
  SITE (89)..(89): Xaa at position 89 is Met, Ile, Leu, Val, Ala, or Gly
  SITE (90)..(90): Xaa at position 90 is Val, Ala, Gly, Leu, or Ile
  SITE (91)..(91): Xaa at position 91 is Phe, Tyr, Met, His, Ile, Leu, Val Ala, or Gly
  SITE (99)..(99): Xaa at position 99 is Leu, Ala, Val, Gly, or Ile
  SITE (100)..(100): Xaa at position 100 is Cys, Ala, Val, Gly, Ser, or Thr
  SITE (103)..(103): Xaa at position 103 is Ile, Ala, Val, Leu, or Gly
  SITE (113)..(113): Xaa at position 113 is Tyr, Phe, Met, His, Ile, Leu, Val Ala, or Gly
  SITE (118)..(118): Xaa at position 118 is Ala, Gly, or Pro
  SITE (122)..(122): Xaa at position 122 is Met, Ile, Leu, Val, Ala, or Gly
  SITE (125)..(125): Xaa at position 125 is Ile, Ala, Val, Leu, or Gly
  SITE (126)..(126): Xaa at position 126 is Leu, Ala, Val, Gly, or Ile
  SITE (128)..(128): Xaa at position 128 is Ala, Gly, or Pro
  SITE (129)..(129): Xaa at position 129 is Leu, Ala, Val, Gly, or Ile
  SITE (132)..(132): Xaa at position 132 is Cys, Ala, Val, Gly, Ser, or Thr
  SITE (137)..(137): Xaa at position 137 is Ile, Ala, Val, Leu, or Gly
  SITE (138)..(138): Xaa at position 138 is Ile, Ala, Val, Leu, or Gly
  SITE (139)..(139): Xaa at position 139 is His, Phe, Tyr, Lys, Arg, Gly, Ser Thr, Ala, Val, Leu, Ile, Asn, Met, or Gln
  SITE (142)..(142): Xaa at position 142 is Val, Ala, Gly, Leu, or Ile
  SITE (146)..(146): Xaa at position 146 is Cys, Ala, Val, Gly, Ser, or Thr
  SITE (147)..(147): Xaa at position 147 is Val, Ala, Gly, Leu, or Ile
  SITE (148)..(148): Xaa at position 148 is Leu, Ala, Val, Gly, or Ile
  SITE (149)..(149): Xaa at position 149 is Leu, Ala, Val, Gly, or Ile
  SITE (158)..(158): Xaa at position 158 is Val, Ala, Gly, Leu, or Ile
  SITE (160)..(160): Xaa at position 160 is Leu, Ala, Val, Gly, or Ile
  SITE (166)..(166): Xaa at position 166 is Ala, Gly, or Pro
  SITE (187)..(187): Xaa at position 187 is Ala, Gly, or Pro
  SITE (191)..(191): Xaa at position 191 is Val, Ala, Gly, Leu, or Ile
  SITE (202)..(202): Xaa at position 202 is Val, Ala, Gly, Leu, or Ile
  SITE (203)..(203): Xaa at position 203 is Trp, Tyr, Phe, Met, His, Ile, Leu Val, Ala, or Gly
  SITE (205)..(205): Xaa at position 205 is Cys, Ala, Val, Gly, Ser, or Thr
  SITE (207)..(207): Xaa at position 207 is Val, Ala, Gly, Leu, or Ile
  SITE (208)..(208): Xaa at position 208 is Ile, Ala, Val, Leu, or Gly
  SITE (209)..(209): Xaa at position 209 is Leu, Ala, Val, Gly, or Ile
  SITE (210)..(210): Xaa at position 210 is Phe, Tyr, Met, His, Ile, Leu, Val Ala, or Gly
  SITE (211)..(211): Xaa at position 211 is Ile, Ala, Val, Leu, or Gly
  SITE (212)..(212): Xaa at position 212 is Leu, Ala, Val, Gly, or Ile
  SITE (213)..(213): Xaa at position 213 is Leu, Ala, Val, Gly, or Ile
  SITE (227)..(227): Xaa at position 227 is Phe, Tyr, Met, His, Ile, Leu, Val Ala, or Gly
  SITE (230)..(230): Xaa at position 230 is Ile, Ala, Val, Leu, or Gly
  SITE (242)..(242): Xaa at position 242 is Trp, Tyr, Phe, Met, His, Ile, Leu Val, Ala, or Gly
  SITE (249)..(249): Xaa at position 249 is Ala, Gly, or Pro
  SITE (252)..(252): Xaa at position 252 is Leu, Ala, Val, Gly, or Ile
  SITE (253)..(253): Xaa at position 253 is Val, Ala, Gly, Leu, or Ile
  SITE (256)..(256): Xaa at position 256 is Met, Ile, Leu, Val, Ala, or Gly
  SITE (267)..(267): Xaa at position 267 is Val, Ala, Gly, Leu, or Ile
  SITE (270)..(270): Xaa at position 270 is Ala, Gly, or Pro
  SITE (275)..(275): Xaa at position 275 is Trp, Tyr, Phe, Met, His, Ile, Leu Val, Ala, or Gly
  SITE (276)..(276): Xaa at position 276 is Leu, Ala, Val, Gly, or Ile
  SITE (295)..(295): Xaa at position 295 is Leu, Ala, Val, Gly, or Ile
  SITE (310)..(310): Xaa at position 310 is Ala, Gly, or Pro
  SITE (312)..(312): Xaa at position 312 is Val, Ala, Gly, Leu, or Ile
MADDDVLXEDVYELXEVIGKGPFSVXRRXINRETGQQFAXKIVDXAKXTSSPGLSTEDXKREASICHMXKHPHXVEXLETYSSDGMXYXXXEFMDGADXXFEXVKRADAGFVXSEAVXSHYXRQXXEXXRYXHDNNXXXRDXKPHXXXXASKENSAPXKXGGFGVXIQLGESGLVAGGRVGTPHFMXPEVXKREPYGKPVDXXGXGXXXXXXXSGCLPFYGTKERLXEGXIKGKYKMNPRQXSHISESXKDXXRRXLMLDPAERITXYEXLNHPXXKERDRYAYKIHLPETVEQXRKFNARRKLKGAVLXAXSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 32 - protein, 1311 aa, Homo sapiens
  SITE (40)..(40): Xaa at position 40 is Leu, Ala, Val, Gly, or Ile
  SITE (42)..(42): Xaa at position 42 is Val, Ala, Gly, Leu, or Ile
  SITE (57)..(57): Xaa at position 57 is Ala, Gly, or Pro
  SITE (68)..(68): Xaa at position 68 is Leu, Ala, Val, Gly, or Ile
  SITE (71)..(71): Xaa at position 71 is Leu, Ala, Val, Gly, or Ile
  SITE (82)..(82): Xaa at position 82 is Ile, Ala, Val, Leu, or Gly
  SITE (92)..(92): Xaa at position 92 is Leu, Ala, Val, Gly, or Ile
  SITE (98)..(98): Xaa at position 98 is Ile, Ala, Val, Leu, or Gly
  SITE (107)..(107): Xaa at position 107 is Ile, Ala, Val, Leu, or Gly
  SITE (122)..(122): Xaa at position 122 is Leu, Ala, Val, Gly, or Ile
  SITE (130)..(130): Xaa at position 130 is Leu, Ala, Val, Gly, or Ile
  SITE (145)..(145): Xaa at position 145 is Cys, Ala, Val, Gly, Ser, or Thr
  SITE (148)..(148): Xaa at position 148 is Val, Ala, Gly, Leu, or Ile
  SITE (149)..(149): Xaa at position 149 is Leu, Ala, Val, Gly, or Ile
  SITE (151)..(151): Xaa at position 151 is Ile, Ala, Val, Leu, or Gly
  SITE (152)..(152): Xaa at position 152 is Phe, Tyr, Met, His, Ile, Leu, Val Ala, or Gly
  SITE (156)..(156): Xaa at position 156 is Cys, Ala, Val, Gly, Ser, or Thr
  SITE (158)..(158): Xaa at position 158 is Ala, Gly, or Pro
  SITE (159)..(159): Xaa at position 159 is Val, Ala, Gly, Leu, or Ile
  SITE (162)..(162): Xaa at position 162 is Met, Ile, Leu, Val, Ala, or Gly
  SITE (171)..(171): Xaa at position 171 is His, Phe, Tyr, Lys, Arg, Gly, Ser Thr, Ala, Val, Leu, Ile, Asn, Met, or Gln
  SITE (179)..(179): Xaa at position 179 is Leu, Ala, Val, Gly, or Ile
  SITE (181)..(181): Xaa at position 181 is Leu, Ala, Val, Gly, or Ile
  SITE (187)..(187): Xaa at position 187 is Ile, Ala, Val, Leu, or Gly
  SITE (189)..(189): Xaa at position 189 is Leu, Ala, Val, Gly, or Ile
  SITE (192)..(192): Xaa at position 192 is Phe, Tyr, Met, His, Ile, Leu, Val Ala, or Gly
  SITE (198)..(198): Xaa at position 198 is Ile, Ala, Val, Leu, or Gly
  SITE (246)..(246): Xaa at position 246 is Ile, Ala, Val, Leu, or Gly
  SITE (249)..(249): Xaa at position 249 is Leu, Ala, Val, Gly, or Ile
  SITE (253)..(253): Xaa at position 253 is Leu, Ala, Val, Gly, or Ile
  SITE (256)..(256): Xaa at position 256 is Leu, Ala, Val, Gly, or Ile
  SITE (288)..(288): Xaa at position 288 is Phe, Tyr, Met, His, Ile, Leu, Val Ala, or Gly
  SITE (292)..(292): Xaa at position 292 is Ile, Ala, Val, Leu, or Gly
  SITE (295)..(295): Xaa at position 295 is Met, Ile, Leu, Val, Ala, or Gly
  SITE (309)..(309): Xaa at position 309 is Val, Ala, Gly, Leu, or Ile
  SITE (313)..(313): Xaa at position 313 is Leu, Ala, Val, Gly, or Ile
  SITE (317)..(317): Xaa at position 317 is Ala, Gly, or Pro
  SITE (328)..(328): Xaa at position 328 is Ile, Ala, Val, Leu, or Gly
  SITE (525)..(525): Xaa at position 525 is Phe, Tyr, Met, His, Ile, Leu, Val Ala, or Gly
  SITE (640)..(640): Xaa at position 640 is Val, Ala, Gly, Leu, or Ile
MSLLQSALDFLAGPGSLGGASGRDQSDFVGQTVELGELRXRXRRVLAEGGFAFVYEXQDVGSGREYAXKRXLSNEEEKNRAXIQEVCFMKKXSGHPNXVQFCSAASXGKEESDTGQAEFLLXTELCKGQXVEFLKKMESRGPLSXDTXXKXXYQTXRXXQHXHRQKPPIIXRDLKVENXLXSNQGTXKXCDXGSATTXSHYPDYSWSAQRRALVEEEITRNTTPMYRTPEIIDLYSNFPIGEKQDXWAXGCIXYLXCFRQHPFEDGAKLRIVNGKYSIPPHDTQYTVXHSLXRAXLQVNPEERLSIAEXVHQXQEIXAARNVNPKSPXTELLEQNGGYGSATLSRGPPPPVGPAGSGYSGGLALAEYDQPYGGFLDILRGGTERLFTNLKDTSSKVIQSVANYAKGDLDISYITSRIAVMSFPAEGVESALKNNIEDVRLFLDSKHPGHYAVYNLSPRTYRPSRFHNRVSECGWAARRAPHLHTLYNICRNMHAWLRQDHKNVCVVHCMDGRAASAVAVCSFLCXCRLFSTAEAAVYMFSMKRCPPGIWPSHKRYIEYMCDMVAEEPITPHSKPILVRAVVMTPVPLFSKQRSGCRPFCEVYVGDERVASTSQEYDKMRDFKIEDGKAVIPLGVTVQGDXLIVIYHARSTLGGRLQAKMASMKMFQIQFHTGFVPRNATTVKFAKYDLDACDIQEKYPDLFQVNLEVEVEPRDRPSREAPPWENSSMRGLNPKILFSSREEQQDILSKFGKPELPRQPGSTAQYDAGAGSPEAEPTDSDSPPSSSADASRFLHTLDWQEEKEAETGAENASSKESESALMEDRDESEVSDEGGSPISSEGQEPRADPEPPGLAAGLVQQDLVFEVETPAVLPEPVPQEDGVDLLGLHSEVGAGPAVPPQACKAPSSNTDLLSCLLGPPEAASQGPPEDLLSEDPLLLASPAPPLSVQSTPRGGPPAAADPFGPLLPSSGNNSQPCSNPDLFGEFLNSDSVTVPPSFPSAHSAPPPSCSADFLHLGDLPGEPSKMTASSSNPDLLGGWAAWTETAASAVAPTPATEGPLFSPGGQPAPCGSQASWTKSQNPDPFADLGDLSSGLQGSPAGFPPGGFIPKTATTPKGSSSWQTSRPPAQGASWPPQAKPPPKACTQPRPNYASNFSVIGAREERGVRAPSFAQKPKVSENDFEDLLSNQGFSSRSDKKGPKTIAEMRKQDLAKDTDPLKLKLLDWIEGKERNIRALLSTLHTVLWDGESRWTPVGMADLVAPEQVKKHYRRAVLAVHPDKAAGQPYEQHAKMIFMELNDAWSEFENQGSRPLF

SEQ ID NO: 33 - protein, 580 aa, Homo sapiens
  SITE (94)..(94): Xaa at position 94 is Leu, Ala, Val, Gly, or Ile
  SITE (95)..(95): Xaa at position 95 is Leu, Ala, Val, Gly, or Ile
  SITE (96)..(96): Xaa at position 96 is Val, Ala, Gly, Leu, or Ile
  SITE (97)..(97): Xaa at position 97 is Ile, Ala, Val, Leu, or Gly
  SITE (104)..(104): Xaa at position 104 is Trp, Tyr, Phe, Met, His, Ile, Leu Val, Ala, or Gly
  SITE (126)..(126): Xaa at position 126 is Phe, Tyr, Met, His, Ile, Leu, Val Ala, or Gly
  SITE (139)..(139): Xaa at position 139 is Cys, Ala, Val, Gly, Ser, or Thr
  SITE (141)..(141): Xaa at position 141 is Val, Ala, Gly, Leu, or Ile
  SITE (162)..(162): Xaa at position 162 is Ile, Ala, Val, Leu, or Gly
  SITE (163)..(163): Xaa at position 163 is Leu, Ala, Val, Gly, or Ile
  SITE (164)..(164): Xaa at position 164 is Val, Ala, Gly, Leu, or Ile
  SITE (181)..(181): Xaa at position 181 is Val, Ala, Gly, Leu, or Ile
  SITE (192)..(192): Xaa at position 192 is Val, Ala, Gly, Leu, or Ile
  SITE (211)..(211): Xaa at position 211 is Leu, Ala, Val, Gly, or Ile
  SITE (223)..(223): Xaa at position 223 is Phe, Tyr, Met, His, Ile, Leu, Val Ala, or Gly
  SITE (226)..(226): Xaa at position 226 is Val, Ala, Gly, Leu, or Ile
  SITE (246)..(246): Xaa at position 246 is Val, Ala, Gly, Leu, or Ile
  SITE (247)..(247): Xaa at position 247 is Val, Ala, Gly, Leu, or Ile
  SITE (261)..(261): Xaa at position 261 is Val, Ala, Gly, Leu, or Ile
  SITE (267)..(267): Xaa at position 267 is Phe, Tyr, Met, His, Ile, Leu, Val Ala, or Gly
  SITE (273)..(273): Xaa at position 273 is Val, Ala, Gly, Leu, or Ile
  SITE (274)..(274): Xaa at position 274 is Val, Ala, Gly, Leu, or Ile
  SITE (281)..(281): Xaa at position 281 is Ala, Gly, or Pro
  SITE (295)..(295): Xaa at position 295 is Ile, Ala, Val, Leu, or Gly
  SITE (304)..(304): Xaa at position 304 is Ala, Gly, or Pro
  SITE (305)..(305): Xaa at position 305 is Tyr, Phe, Met, His, Ile, Leu, Val Ala, or Gly
  SITE (335)..(335): Xaa at position 335 is Trp, Tyr, Phe, Met, His, Ile, Leu Val, Ala, or Gly
  SITE (336)..(336): Xaa at position 336 is Val, Ala, Gly, Leu, or Ile
  SITE (339)..(339): Xaa at position 339 is Cys, Ala, Val, Gly, Ser, or Thr
  SITE (348)..(348): Xaa at position 348 is Ile, Ala, Val, Leu, or Gly
  SITE (349)..(349): Xaa at position 349 is Cys, Ala, Val, Gly, Ser, or Thr
  SITE (350)..(350): Xaa at position 350 is Ala, Gly, or Pro
  SITE (351)..(351): Xaa at position 351 is Val, Ala, Gly, Leu, or Ile
  SITE (353)..(353): Xaa at position 353 is Ala, Gly, or Pro
  SITE (363)..(363): Xaa at position 363 is Ile, Ala, Val, Leu, or Gly
  SITE (371)..(371): Xaa at position 371 is Met, Ile, Leu, Val, Ala, or Gly
  SITE (385)..(385): Xaa at position 385 is Met, Ile, Leu, Val, Ala, or Gly
  SITE (386)..(386): Xaa at position 386 is Ala, Gly, or Pro
  SITE (389)..(389): Xaa at position 389 is Val, Ala, Gly, Leu, or Ile
MNFLRRRLSDSSFMANLPNGYMTDLQRPDSSTSSPASPAMERRHPQPLAASFSSPGSSLFSSLSSAMKQAPQATSGLMEPPGPSTPIVQRPRIXXXXDDAHTDXSKYFHGKKVNGEIEIRVEQAEXSELNLAAYVTGGXMXDMQVVRNGTKVVSRSFKPDFXXXRQHAYSMALGEDYRSLXIGLQYGGLPAXNSLYSVYNFCSKPWVFSQXIKIFHSLGPEKXPLXEQTFFPNHKPMVTAPHFPVXXKLGHAHAGMGKIKXENQLDXQDITSXXAMAKTYXTTEAFIDSKYDIRXQKIGSNYKXXMRTSISGNWKANTGSAMLEQVAMTERYRLXXDSXSEMFGGLDXXXXKXVHSKDGRDYXIEVMDSSXPLIGEHVEEDRQLXXDLXVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 34 - protein, 2390 aa, Homo sapiens
  SITE (63)..(63): Xaa at position 63 is Phe, Tyr, Met, His, Ile, Leu, Val Ala, or Gly
  SITE (66)..(66): Xaa at position 66 is Trp, Tyr, Phe, Met, His, Ile, Leu Val, Ala, or Gly
  SITE (67)..(67): Xaa at position 67 is Val, Ala, Gly, Leu, or Ile
  SITE (71)..(71): Xaa at position 71 is Leu, Ala, Val, Gly, or Ile
  SITE (81)..(81): Xaa at position 81 is Leu, Ala, Val, Gly, or Ile
  SITE (85)..(85): Xaa at position 85 is Leu, Ala, Val, Gly, or Ile
  SITE (91)..(91): Xaa at position 91 is Leu, Ala, Val, Gly, or Ile
  SITE (92)..(92): Xaa at position 92 is Leu, Ala, Val, Gly, or Ile
  SITE (94)..(94): Xaa at position 94 is Leu, Ala, Val, Gly, or Ile
  SITE (95)..(95): Xaa at position 95 is Leu, Ala, Val, Gly, or Ile
  SITE (119)..(119): Xaa at position 119 is Val, Ala, Gly, Leu, or Ile
  SITE (122)..(122): Xaa at position 122 is Ala, Gly, or Pro
  SITE (123)..(123): Xaa at position 123 is Leu, Ala, Val, Gly, or Ile
  SITE (126)..(126): Xaa at position 126 is Leu, Ala, Val, Gly, or Ile
  SITE (133)..(133): Xaa at position 133 is Leu, Ala, Val, Gly, or Ile
  SITE (141)..(141): Xaa at position 141 is Ile, Ala, Val, Leu, or Gly
  SITE (142)..(142): Xaa at position 142 is Val, Ala, Gly, Leu, or Ile
  SITE (152)..(152): Xaa at position 152 is Leu, Ala, Val, Gly, or Ile
  SITE (153)..(153): Xaa at position 153 is Val, Ala, Gly, Leu, or Ile
  SITE (156)..(156): Xaa at position 156 is Ile, Ala, Val, Leu, or Gly
  SITE (157)..(157): Xaa at position 157 is Ile, Ala, Val, Leu, or Gly
  SITE (162)..(162): Xaa at position 162 is Ile, Ala, Val, Leu, or Gly
  SITE (165)..(165): Xaa at position 165 is Ile, Ala, Val, Leu, or Gly
  SITE (182)..(182): Xaa at position 182 is Leu, Ala, Val, Gly, or Ile
  SITE (186)..(186): Xaa at position 186 is Cys, Ala, Val, Gly, Ser, or Thr
  SITE (198)..(198): Xaa at position 198 is Val, Ala, Gly, Leu, or Ile
  SITE (201)..(201): Xaa at position 201 is Phe, Tyr, Met, His, Ile, Leu, Val Ala, or Gly
  SITE (205)..(205): Xaa at position 205 is Trp, Tyr, Phe, Met, His, Ile, Leu Val, Ala, or Gly
  SITE (210)..(210): Xaa at position 210 is Ala, Gly, or Pro
  SITE (211)..(211): Xaa at position 211 is Phe, Tyr, Met, His, Ile, Leu, Val Ala, or Gly
  SITE (213)..(213): Xaa at position 213 is Ala, Gly, or Pro
  SITE (214)..(214): Xaa at position 214 is Ile, Ala, Val, Leu, or Gly
  SITE (215)..(215): Xaa at position 215 is Val, Ala, Gly, Leu, or Ile
  SITE (228)..(228): Xaa at position 228 is Leu, Ala, Val, Gly, or Ile
  SITE (234)..(234): Xaa at position 234 is His, Phe, Tyr, Lys, Arg, Gly, Ser Thr, Ala, Val, Leu, Ile, Asn, Met, or Gln
  SITE (237)..(237): Xaa at position 237 is Leu, Ala, Val, Gly, or Ile
  SITE (240)..(240): Xaa at position 240 is Ala, Gly, or Pro
  SITE (241)..(241): Xaa at position 241 is Phe, Tyr, Met, His, Ile, Leu, Val Ala, or Gly
  SITE (244)..(244): Xaa at position 244 is Ala, Gly, or Pro
  SITE (253)..(253): Xaa at position 253 is Leu, Ala, Val, Gly, or Ile
  SITE (254)..(254): Xaa at position 254 is Leu, Ala, Val, Gly, or Ile
  SITE (259)..(259): Xaa at position 259 is Val, Ala, Gly, Leu, or Ile
  SITE (269)..(269): Xaa at position 269 is Ile, Ala, Val, Leu, or Gly
  SITE (270)..(270): Xaa at position 270 is Ile, Ala, Val, Leu, or Gly
  SITE (272)..(272): Xaa at position 272 is Tyr, Phe, Met, His, Ile, Leu, Val Ala, or Gly
  SITE (273)..(273): Xaa at position 273 is Val, Ala, Gly, Leu, or Ile
  SITE (274)..(274): Xaa at position 274 is Ala, Gly, or Pro
  SITE (276)..(276): Xaa at position 276 is Tyr, Phe, Met, His, Ile, Leu, Val Ala, or Gly
  SITE (277)..(277): Xaa at position 277 is Tyr, Phe, Met, His, Ile, Leu, Val Ala, or Gly
  SITE (2225)..(2225): Xaa at position 2225 is Leu, Ala, Val, Gly, or Ile
  SITE (2238)..(2238): Xaa at position 2238 is Ala, Gly, or Pro
  SITE (2246)..(2246): Xaa at position 2246 is Val, Ala, Gly, Leu, or Ile
  SITE (2248)..(2248): Xaa at position 2248 is Cys, Ala, Val, Gly, Ser, or Thr
  SITE (2250)..(2250): Xaa at position 2250 is Leu, Ala, Val, Gly, or Ile
  SITE (2255)..(2255): Xaa at position 2255 is Leu, Ala, Val, Gly, or Ile
  SITE (2257)..(2257): Xaa at position 2257 is Phe, Tyr, Met, His, Ile, Leu Val, Ala, or Gly
  SITE (2278)..(2278): Xaa at position 2278 is Leu, Ala, Val, Gly, or Ile
  SITE (2295)..(2295): Xaa at position 2295 is Val, Ala, Gly, Leu, or Ile
  SITE (2296)..(2296): Xaa at position 2296 is Phe, Tyr, Met, His, Ile, Leu Val, Ala, or Gly
  SITE (2298)..(2298): Xaa at position 2298 is Leu, Ala, Val, Gly, or Ile
  SITE (2308)..(2308): Xaa at position 2308 is Phe, Tyr, Met, His, Ile, Leu Val, Ala, or Gly
  SITE (2310)..(2310): Xaa at position 2310 is Ala, Gly, or Pro
  SITE (2319)..(2319): Xaa at position 2319 is Trp, Tyr, Phe, Met, His, Ile Leu, Val, Ala, or Gly
  SITE (2323)..(2323): Xaa at position 2323 is Val, Ala, Gly, Leu, or Ile
  SITE (2326)..(2326): Xaa at position 2326 is Ala, Gly, or Pro
MSSTLSPTDFDSLEIQGQYSDINNRWDLPDSDWDNDSSSARLFERSRIKALADEREAVQKKTXTKXXNSHXARVTCRVGDXYSDXRDGRNXXRXXEVLSGEILPKPTKGRMRIHCLENXDKXXQFXKEQKVHXENMGSHDXXDGNHRLTLGXXWTXXLRFQXQDXSVETEDNKEKKSAKDAXLLWXQMKTAGYPNVNXHNXTTSXRDGLXXNXXXHKHRPDLLDFESXKKCNAXYNXQNXXNLXEKELGLTKXXDPEDXNVDQPDEKSXXTXXXTXXHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMXCRKQEMEAFGKKXANRSWQNXYXVXRRGSXGXYKDAKAASAGVPYHGEVPVSXARAQGSVAFDYRKRKHXXKXGLQDGKEYLXQXKDEAEMSSXLRVXNAXIATASSASGEPEEPVVPSTTRGMTRAMTMPPVSPVGAEGPVVLRSKDGREREREKRFSFFKKNK

SEQ ID NO: 35 - protein, 1278 aa, Homo sapiens
  SITE (27)..(27): Xaa at position 27 is Trp, Tyr, Phe, Met, His, Ile, Leu Val, Ala, or Gly
  SITE (59)..(59): Xaa at position 59 is Val, Ala, Gly, Leu, or Ile
  SITE (63)..(63): Xaa at position 63 is Cys, Ala, Val, Gly, Ser, or Thr
  SITE (73)..(73): Xaa at position 73 is Leu, Ala, Val, Gly, or Ile
  SITE (74)..(74): Xaa at position 74 is Cys, Ala, Val, Gly, Ser, or Thr
  SITE (75)..(75): Xaa at position 75 is Cys, Ala, Val, Gly, Ser, or Thr
  SITE (80)..(80): Xaa at position 80 is Leu, Ala, Val, Gly, or Ile
  SITE (94)..(94): Xaa at position 94 is Leu, Ala, Val, Gly, or Ile
  SITE (97)..(97): Xaa at position 97 is Cys, Ala, Val, Gly, Ser, or Thr
  SITE (100)..(100): Xaa at position 100 is Cys, Ala, Val, Gly, Ser, or Thr
  SITE (104)..(104): Xaa at position 104 is Leu, Ala, Val, Gly, or Ile
  SITE (107)..(107): Xaa at position 107 is Leu, Ala, Val, Gly, or Ile
  SITE (113)..(113): Xaa at position 113 is Cys, Ala, Val, Gly, Ser, or Thr
  SITE (121)..(121): Xaa at position 121 is Leu, Ala, Val, Gly, or Ile
  SITE (141)..(141): Xaa at position 141 is Val, Ala, Gly, Leu, or Ile
  SITE (144)..(144): Xaa at position 144 is Leu, Ala, Val, Gly, or Ile
  SITE (146)..(146): Xaa at position 146 is Tyr, Phe, Met, His, Ile, Leu, Val Ala, or Gly
  SITE (148)..(148): Xaa at position 148 is Val, Ala, Gly, Leu, or Ile
  SITE (152)..(152): Xaa at position 152 is Phe, Tyr, Met, His, Ile, Leu, Val Ala, or Gly
  SITE (153)..(153): Xaa at position 153 is Ala, Gly, or Pro
  SITE (156)..(156): Xaa at position 156 is Met, Ile, Leu, Val, Ala, or Gly
  SITE (159)..(159): Xaa at position 159 is Ala, Gly, or Pro
  SITE (160)..(160): Xaa at position 160 is Cys, Ala, Val, Gly, Ser, or Thr
  SITE (163)..(163): Xaa at position 163 is Val, Ala, Gly, Leu, or Ile
  SITE (172)..(172): Xaa at position 172 is Ala, Gly, or Pro
  SITE (173)..(173): Xaa at position 173 is Leu, Ala, Val, Gly, or Ile
  SITE (177)..(177): Xaa at position 177 is Cys, Ala, Val, Gly, Ser, or Thr
  SITE (189)..(189): Xaa at position 189 is Trp, Tyr, Phe, Met, His, Ile, Leu Val, Ala, or Gly
  SITE (190)..(190): Xaa at position 190 is Ile, Ala, Val, Leu, or Gly
  SITE (194)..(194): Xaa at position 194 is Phe, Tyr, Met, His, Ile, Leu, Val Ala, or Gly
  SITE (227)..(227): Xaa at position 227 is Cys, Ala, Val, Gly, Ser, or Thr
  SITE (243)..(243): Xaa at position 243 is Cys, Ala, Val, Gly, Ser, or Thr
  SITE (408)..(408): Xaa at position 408 is Leu, Ala, Val, Gly, or Ile
  SITE (410)..(410): Xaa at position 410 is Ile, Ala, Val, Leu, or Gly
  SITE (431)..(431): Xaa at position 431 is Phe, Tyr, Met, His, Ile, Leu, Val Ala, or Gly
  SITE (435)..(435): Xaa at position 435 is Leu, Ala, Val, Gly, or Ile
  SITE (443)..(443): Xaa at position 443 is Val, Ala, Gly, Leu, or Ile
  SITE (444)..(444): Xaa at position 444 is Leu, Ala, Val, Gly, or Ile
  SITE (446)..(446): Xaa at position 446 is Leu, Ala, Val, Gly, or Ile
  SITE (450)..(450): Xaa at position 450 is Ile, Ala, Val, Leu, or Gly
  SITE (462)..(462): Xaa at position 462 is Val, Ala, Gly, Leu, or Ile
  SITE (464)..(464): Xaa at position 464 is Leu, Ala, Val, Gly, or Ile
  SITE (467)..(467): Xaa at position 467 is Ile, Ala, Val, Leu, or Gly
  SITE (479)..(479): Xaa at position 479 is Cys, Ala, Val, Gly, Ser, or Thr
  SITE (481)..(481): Xaa at position 481 is Ile, Ala, Val, Leu, or Gly
  SITE (484)..(484): Xaa at position 484 is Val, Ala, Gly, Leu, or Ile
  SITE (485)..(485): Xaa at position 485 is Leu, Ala, Val, Gly, or Ile
  SITE (487)..(487): Xaa at position 487 is Tyr, Phe, Met, His, Ile, Leu, Val Ala, or Gly
  SITE (488)..(488): Xaa at position 488 is Phe, Tyr, Met, His, Ile, Leu, Val Ala, or Gly
  SITE (495)..(495): Xaa at position 495 is Leu, Ala, Val, Gly, or Ile
  SITE (507)..(507): Xaa at position 507 is Ala, Gly, or Pro
  SITE (510)..(510): Xaa at position 510 is His, Phe, Tyr, Lys, Arg, Gly, Ser Thr, Ala, Val, Leu, Ile, Asn, Met, or Gln
  SITE (512)..(512): Xaa at position 512 is His, Phe, Tyr, Lys, Arg, Gly, Ser Thr, Ala, Val, Leu, Ile, Asn, Met, or Gln
  SITE (516)..(516): Xaa at position 516 is Cys, Ala, Val, Gly, Ser, or Thr
  SITE (533)..(533): Xaa at position 533 is Cys, Ala, Val, Gly, Ser, or Thr
  SITE (541)..(541): Xaa at position 541 is Val, Ala, Gly, Leu, or Ile
  SITE (545)..(545): Xaa at position 545 is Leu, Ala, Val, Gly, or Ile
  SITE (546)..(546): Xaa at position 546 is Val, Ala, Gly, Leu, or Ile
  SITE (547)..(547): Xaa at position 547 is Leu, Ala, Val, Gly, or Ile
  SITE (558)..(558): Xaa at position 558 is Ala, Gly, or Pro
  SITE (561)..(561): Xaa at position 561 is Leu, Ala, Val, Gly, or Ile
  SITE (563)..(563): Xaa at position 563 is Ile, Ala, Val, Leu, or Gly
  SITE (565)..(565): Xaa at position 565 is Phe, Tyr, Met, His, Ile, Leu, Val Ala, or Gly
  SITE (567)..(567): Xaa at position 567 is Val, Ala, Gly, Leu, or Ile
  SITE (580)..(580): Xaa at position 580 is Ala, Gly, or Pro
  SITE (583)..(583): Xaa at position 583 is Trp, Tyr, Phe, Met, His, Ile, Leu Val, Ala, or Gly
  SITE (587)..(587): Xaa at position 587 is Phe, Tyr, Met, His, Ile, Leu, Val Ala, or Gly
  SITE (649)..(649): Xaa at position 649 is Leu, Ala, Val, Gly, or Ile
  SITE (656)..(656): Xaa at position 656 is Leu, Ala, Val, Gly, or Ile
  SITE (659)..(659): Xaa at position 659 is Ala, Gly, or Pro
  SITE (720)..(720): Xaa at position 720 is Leu, Ala, Val, Gly, or Ile
  SITE (724)..(724): Xaa at position 724 is Leu, Ala, Val, Gly, or Ile
  SITE (727)..(727): Xaa at position 727 is Val, Ala, Gly, Leu, or Ile
  SITE (763)..(763): Xaa at position 763 is Phe, Tyr, Met, His, Ile, Leu, Val Ala, or Gly
  SITE (1035)..(1035): Xaa at position 1035 is Ala, Gly, or Pro
  SITE (1100)..(1100): Xaa at position 1100 is Phe, Tyr, Met, His, Ile, Leu Val, Ala, or Gly
  SITE (1124)..(1124): Xaa at position 1124 is Ala, Gly, or Pro
  SITE (1138)..(1138): Xaa at position 1138 is Met, Ile, Leu, Val, Ala, or Gly
  SITE (1228)..(1228): Xaa at position 1228 is Met, Ile, Leu, Val, Ala, or Gly
MTARGLALGLLLLLLCPAQVFSQSCVXYGECGIAYGDKRYNCEYSGPPKPLPKDGYDLXQELXPGFFFGNVSXXXDVRQXQTLKDNLQLPLQFXSRXPSXFYNXLNXFCELTXSPRQSQFXNVTATEDYVDPVTNQTKTNXKEXQXYXGQSXXNAXYNXXRDXEAPSSNDKXXGLLXGKDADACNATNXXEYMXNKDNGQAPFTITPVFSDFPVHGMEPMNNATKGXDESVDEVTAPCSCQDXSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQXIXRAPLTDKHIYQPYPSGADVPXGPPXDIQILHQXXDXQIAXENITASYDNETXTXQDXCLAPLSPYNTNXTXLSXXNXXQNSHSVXDHKKGDDFFVYXDYXTXFLYXVRAPASLNDTSLLHDPXLGTFGGPXFPWXXXGGYDDQNYNNXTAXVXTXPXNNYYNDTEKLQRXQAXEKEXINFVKNYKNPNLTISFTAERSIEDELNRESDSDVFTVVISYAIMFLYISLALGHMKSCRRLXVDSKVSXGIXGILIVLSSVACSLGVFSYIGLPLTLIVIEVIPFLVLAVGVDNIFILVQAYQRDERLQGETXDQQXGRXLGEVAPSMFLSSFSETVAFFLGALSVMPAVHTFSLXAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGXTYFMTYHTVLQTSADFIDALKKARLIASNVTETMGINGSAYRVFPYSVFYVFYEQYLTIIDDTIXNLGVSLGAIFLVTMVLLGCELWSXVIMCATIAMVLVNXFGVMWLWGISLNAVSLVNLVMSCGISVEFCSHITRAFTVSMKGSRVERAEEALAHMGSSVFSGITLTKFGGIVVLAFAKSQIFQIFYFRXYLAMVLLGATHGLIFLPVLLSYIGPSVNKAKSCATEERYKGTERERLLNF

SEQ ID NO: 36 - protein, 3695 aa, Homo sapiens
  SITE (273)..(273): Xaa at position 273 is Leu, Ala, Val, Gly, or Ile
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHXMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 37 - protein, 246 aa, Homo sapiens
  SITE (8)..(8): Xaa at position 8 is Leu, Ala, Val, Gly, or Ile
  SITE (9)..(9): Xaa at position 9 is Cys, Ala, Val, Gly, Ser, or Thr
  SITE (10)..(10): Xaa at position 10 is Leu, Ala, Val, Gly, or Ile
  SITE (11)..(11): Xaa at position 11 is Phe, Tyr, Met, His, Ile, Leu, Val Ala, or Gly
  SITE (17)..(17): Xaa at position 17 is Leu, Ala, Val, Gly, or Ile
  SITE (28)..(28): Xaa at position 28 is Met, Ile, Leu, Val, Ala, or Gly
  SITE (31)..(31): Xaa at position 31 is Phe, Tyr, Met, His, Ile, Leu, Val Ala, or Gly
  SITE (32)..(32): Xaa at position 32 is Leu, Ala, Val, Gly, or Ile
  SITE (35)..(35): Xaa at position 35 is Leu, Ala, Val, Gly, or Ile
  SITE (41)..(41): Xaa at position 41 is Ile, Ala, Val, Leu, or Gly
  SITE (43)..(43): Xaa at position 43 is Val, Ala, Gly, Leu, or Ile
  SITE (44)..(44): Xaa at position 44 is Val, Ala, Gly, Leu, or Ile
  SITE (52)..(52): Xaa at position 52 is Val, Ala, Gly, Leu, or Ile
  SITE (56)..(56): Xaa at position 56 is Leu, Ala, Val, Gly, or Ile
  SITE (60)..(60): Xaa at position 60 is Val, Ala, Gly, Leu, or Ile
  SITE (64)..(64): Xaa at position 64 is Tyr, Phe, Met, His, Ile, Leu, Val Ala, or Gly
  SITE (67)..(67): Xaa at position 67 is Val, Ala, Gly, Leu, or Ile
  SITE (68)..(68): Xaa at position 68 is Phe, Tyr, Met, His, Ile, Leu, Val Ala, or Gly
  SITE (73)..(73): Xaa at position 73 is Leu, Ala, Val, Gly, or Ile
  SITE (75)..(75): Xaa at position 75 is Ala, Gly, or Pro
  SITE (87)..(87): Xaa at position 87 is Ile, Ala, Val, Leu, or Gly
  SITE (99)..(99): Xaa at position 99 is Leu, Ala, Val, Gly, or Ile
  SITE (103)..(103): Xaa at position 103 is Cys, Ala, Val, Gly, Ser, or Thr
  SITE (126)..(126): Xaa at position 126 is Met, Ile, Leu, Val, Ala, or Gly
  SITE (127)..(127): Xaa at position 127 is Leu, Ala, Val, Gly, or Ile
  SITE (129)..(129): Xaa at position 129 is Val, Ala, Gly, Leu, or Ile
  SITE (132)..(132): Xaa at position 132 is Ile, Ala, Val, Leu, or Gly
  SITE (144)..(144): Xaa at position 144 is Phe, Tyr, Met, His, Ile, Leu, Val Ala, or Gly
  SITE (157)..(157): Xaa at position 157 is Phe, Tyr, Met, His, Ile, Leu, Val Ala, or Gly
  SITE (161)..(161): Xaa at position 161 is Leu, Ala, Val, Gly, or Ile
  SITE (178)..(178): Xaa at position 178 is Ile, Ala, Val, Leu, or Gly
  SITE (180)..(180): Xaa at position 180 is Phe, Tyr, Met, His, Ile, Leu, Val Ala, or Gly
  SITE (182)..(182): Xaa at position 182 is Val, Ala, Gly, Leu, or Ile
  SITE (192)..(192): Xaa at position 192 is Cys, Ala, Val, Gly, Ser, or Thr
  SITE (193)..(193): Xaa at position 193 is Leu, Ala, Val, Gly, or Ile
  SITE (196)..(196): Xaa at position 196 is Val, Ala, Gly, Leu, or Ile
  SITE (206)..(206): Xaa at position 206 is Phe, Tyr, Met, His, Ile, Leu, Val Ala, or Gly
  SITE (207)..(207): Xaa at position 207 is Phe, Tyr, Met, His, Ile, Leu, Val Ala, or Gly
  SITE (220)..(220): Xaa at position 220 is Ile, Ala, Val, Leu, or Gly
  SITE (241)..(241): Xaa at position 241 is Cys, Ala, Val, Gly, Ser, or Thr
MAAPGPAXXXXDVDGTXTAPRQKITKEXDDXXQKXRQKIKXGXXGGSDFEKXQEQXGNDXVEKXDYXXPENGXVXYKDGKLLCRQNXQSHLGEALIQDXINYXLSYIAKIKLPKKRGTFIEFRNGXXNXSPXGRSCSQEERIEXYELDKKENIRQKXVADXRKEFAGKGLTFSIGGQXSXDXFPDGWDKRYXXRHXENDGYKTIYXXGDKTMPGGNDHEXFTDPRTMGYSVTAPEDTRRIXELLFS

SEQ ID NO: 38 - protein, 1258 aa, Homo sapiens
  SITE (31)..(31): Xaa at position 31 is Ala, Gly, or Pro
  SITE (34)..(34): Xaa at position 34 is Leu, Ala, Val, Gly, or Ile
  SITE (35)..(35): Xaa at position 35 is Leu, Ala, Val, Gly, or Ile
  SITE (44)..(44): Xaa at position 44 is Phe, Tyr, Met, His, Ile, Leu, Val Ala, or Gly
  SITE (45)..(45): Xaa at position 45 is Leu, Ala, Val, Gly, or Ile
  SITE (46)..(46): Xaa at position 46 is Val, Ala, Gly, Leu, or Ile
  SITE (55)..(55): Xaa at position 55 is Ala, Gly, or Pro
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (60)..(60): Xaa at position 60 is Val, Ala, Gly, Leu, or Ile
  SITE (71)..(71): Xaa at position 71 is Ile, Ala, Val, Leu, or Gly
  SITE (81)..(81): Xaa at position 81 is Val, Ala, Gly, Leu, or Ile
  SITE (87)..(87): Xaa at position 87 is Val, Ala, Gly, Leu, or Ile
  SITE (98)..(98): Xaa at position 98 is Leu, Ala, Val, Gly, or Ile
  SITE (99)..(99): Xaa at position 99 is Ile, Ala, Val, Leu, or Gly
  SITE (102)..(102): Xaa at position 102 is Tyr, Phe, Met, His, Ile, Leu, Val Ala, or Gly
  SITE (113)..(113): Xaa at position 113 is Leu, Ala, Val, Gly, or Ile
  SITE (117)..(117): Xaa at position 117 is Val, Ala, Gly, Leu, or Ile
  SITE (424)..(424): Xaa at position 424 is Ile, Ala, Val, Leu, or Gly
  SITE (426)..(426): Xaa at position 426 is Val, Ala, Gly, Leu, or Ile
  SITE (427)..(427): Xaa at position 427 is Phe, Tyr, Met, His, Ile, Leu, Val Ala, or Gly
  SITE (428)..(428): Xaa at position 428 is Ile, Ala, Val, Leu, or Gly
  SITE (431)..(431): Xaa at position 431 is Trp, Tyr, Phe, Met, His, Ile, Leu Val, Ala, or Gly
  SITE (466)..(466): Xaa at position 466 is Ile, Ala, Val, Leu, or Gly
  SITE (468)..(468): Xaa at position 468 is Val, Ala, Gly, Leu, or Ile
  SITE (469)..(469): Xaa at position 469 is Phe, Tyr, Met, His, Ile, Leu, Val Ala, or Gly
  SITE (489)..(489): Xaa at position 489 is Leu, Ala, Val, Gly, or Ile
  SITE (508)..(508): Xaa at position 508 is Ile, Ala, Val, Leu, or Gly
  SITE (510)..(510): Xaa at position 510 is Val, Ala, Gly, Leu, or Ile
  SITE (511)..(511): Xaa at position 511 is Ala, Gly, or Pro
  SITE (512)..(512): Xaa at position 512 is Val, Ala, Gly, Leu, or Ile
  SITE (513)..(513): Xaa at position 513 is Leu, Ala, Val, Gly, or Ile
  SITE (514)..(514): Xaa at position 514 is Val, Ala, Gly, Leu, or Ile
  SITE (543)..(543): Xaa at position 543 is Ala, Gly, or Pro
  SITE (544)..(544): Xaa at position 544 is Val, Ala, Gly, Leu, or Ile
  SITE (546)..(546): Xaa at position 546 is Val, Ala, Gly, Leu, or Ile
  SITE (548)..(548): Xaa at position 548 is Phe, Tyr, Met, His, Ile, Leu, Val Ala, or Gly
  SITE (550)..(550): Xaa at position 550 is Phe, Tyr, Met, His, Ile, Leu, Val Ala, or Gly
  SITE (555)..(555): Xaa at position 555 is Phe, Tyr, Met, His, Ile, Leu, Val Ala, or Gly
  SITE (557)..(557): Xaa at position 557 is Phe, Tyr, Met, His, Ile, Leu, Val Ala, or Gly
  SITE (560)..(560): Xaa at position 560 is Cys, Ala, Val, Gly, Ser, or Thr
  SITE (601)..(601): Xaa at position 601 is His, Phe, Tyr, Lys, Arg, Gly, Ser Thr, Ala, Val, Leu, Ile, Asn, Met, or Gln
  SITE (603)..(603): Xaa at position 603 is Phe, Tyr, Met, His, Ile, Leu, Val Ala, or Gly
  SITE (605)..(605): Xaa at position 605 is Phe, Tyr, Met, His, Ile, Leu, Val Ala, or Gly
  SITE (608)..(608): Xaa at position 608 is Leu, Ala, Val, Gly, or Ile
  SITE (610)..(610): Xaa at position 610 is Tyr, Phe, Met, His, Ile, Leu, Val Ala, or Gly
  SITE (619)..(619): Xaa at position 619 is Ile, Ala, Val, Leu, or Gly
  SITE (631)..(631): Xaa at position 631 is Leu, Ala, Val, Gly, or Ile
  SITE (637)..(637): Xaa at position 637 is Leu, Ala, Val, Gly, or Ile
  SITE (646)..(646): Xaa at position 646 is Val, Ala, Gly, Leu, or Ile
  SITE (657)..(657): Xaa at position 657 is Phe, Tyr, Met, His, Ile, Leu, Val Ala, or Gly
  SITE (688)..(688): Xaa at position 688 is Trp, Tyr, Phe, Met, His, Ile, Leu Val, Ala, or Gly
  SITE (689)..(689): Xaa at position 689 is Cys, Ala, Val, Gly, Ser, or Thr
  SITE (692)..(692): Xaa at position 692 is Ile, Ala, Val, Leu, or Gly
  SITE (693)..(693): Xaa at position 693 is Leu, Ala, Val, Gly, or Ile
  SITE (707)..(707): Xaa at position 707 is Tyr, Phe, Met, His, Ile, Leu, Val Ala, or Gly
  SITE (709)..(709): Xaa at position 709 is Cys, Ala, Val, Gly, Ser, or Thr
  SITE (713)..(713): Xaa at position 713 is Ile, Ala, Val, Leu, or Gly
  SITE (721)..(721): Xaa at position 721 is Val, Ala, Gly, Leu, or Ile
  SITE (722)..(722): Xaa at position 722 is Phe, Tyr, Met, His, Ile, Leu, Val Ala, or Gly
  SITE (727)..(727): Xaa at position 727 is Val, Ala, Gly, Leu, or Ile
  SITE (1201)..(1201): Xaa at position 1201 is Met, Ile, Leu, Val, Ala, or Gly
  SITE (1205)..(1205): Xaa at position 1205 is Leu, Ala, Val, Gly, or Ile
  SITE (1217)..(1217): Xaa at position 1217 is Leu, Ala, Val, Gly, or Ile
  SITE (1228)..(1228): Xaa at position 1228 is Leu, Ala, Val, Gly, or Ile
  SITE (1236)..(1236): Xaa at position 1236 is Leu, Ala, Val, Gly, or Ile
  SITE (1241)..(1241): Xaa at position 1241 is Val, Ala, Gly, Leu, or Ile
  SITE (1250)..(1250): Xaa at position 1250 is Leu, Ala, Val, Gly, or Ile
MASACGAPGPGGALGSQAPSWYHRDLSRAAXEEXXARAGRDGSXXXRDSESVAGXFAXXXLYQKHVHTYRXLPDGEDFLAXQTSQGXPVRRFQTLGEXXGLXAQPNQGLVCAXLLPXEGEREPDPPDDRDASDGEDEKPPLPPRSGSTSISAPTGPSSPLPAPETPTAPAAESAPNGLSTVSHDYLKGSYGLDLEAVRGGASHLPHLTRTLATSCRRLHSEVDKVLSGLEILSKVFDQQSSPMVTRLLQQQNLPQTGEQELESLVLKLSVLKDFLSGIQKKALKALQDMSSTAPPAPQPSTRKAKTIPVQAFEVKLDVTLGDLTKIGKSQKFTLSVDVEGGRLVLLRRQRDSQEDWTTFTHDRIRQLIKSQRVQNKLGVVFEKEKDRTQRKDFIFVSARKREAFCQLLQLMKNKHSKQDEPDMXSXXXGTXNMGSVPPPKNVTSWFTSKGLGKTLDEVTVTIPHDXYXXGTQENSVGDREWLDLLRGGXKELTDLDYRPIAMQSLWNXKXXXXXKPEHENRISHVSTSSVKTGIANTLGNKGXXGXSXMXNGTSXGXVNXHLTSGNEKTARRNQNYLDILRLLSLGDRQLNAFDISLRFTXLXWXGDXNXRLDMDIQEXLNYISRKEFEPXLRVDQXNLEREKHKXFLRFSEEEISXPPTYRYERGSRDTYAWHKQKPTGVRTNVPSXXDRXXWKSYPETHIICNSXGXTDDXVTSDHSPXXGTFEXGVTSQFISKKGLSKTSDQAYIEFESIEAIVKTASRTKFFIEFYSTCLEEYKKSFENDAQSSDNINFLKVQWSSRQLPTLKPILADIEYLQDQHLLLTVKSMDGYESYGECVVALKSMIGSTAQQFLTFLSHRGEETGNIRGSMKVRVPTERLGTRERLYEWISIDKDEAGAKSKAPSVSRGSQEPRSGSRKPAFTEASCPLSRLFEEPEKPPPTGRPPAPPRAAPREEPLTPRLKPEGAPEPEGVAAPPPKNSFNNPAYYVLEGVPHQLLPPEPPSPARAPVPSATKNKVAITVPAPQLGHHRHPRVGEGSSSDEESGGTLPPPDFPPPPLPDSAIFLPPSLDPLPGPVVRGRGGAEARGPPPPKAHPRPPLPPGPSPASTFLGEVASGDDRSCSVLQMAKTLSEVDYAPAGPARSALLPGPLELQPPRGLPSDYGRPLSFPPPRIRESIQEDLAEEAPCLQGGRASGLGEAGXSAWXRAIGLERYEEGXVHNGWDDLEFXSDITEEDXEEAGXQDPAHKRLXLDTLQLSK

SEQ ID NO: 39 - protein, 352 aa, Homo sapiens
  SITE (36)..(36): Xaa at position 36 is Val, Ala, Gly, Leu, or Ile
  SITE (39)..(39): Xaa at position 39 is Val, Ala, Gly, Leu, or Ile
  SITE (45)..(45): Xaa at position 45 is Val, Ala, Gly, Leu, or Ile
  SITE (67)..(67): Xaa at position 67 is Leu, Ala, Val, Gly, or Ile
  SITE (78)..(78): Xaa at position 78 is Ile, Ala, Val, Leu, or Gly
MASRKEGTGSTATSSSSTAGAAGKGKGKGGSGDSAXKQXQIDGLXVLKIIKHYQEEGQGTEVVQGVXLGLVVEDRLEXTNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 40 - protein, 837 aa, Homo sapiens
  SITE (32)..(32): Xaa at position 32 is Leu, Ala, Val, Gly, or Ile
  SITE (40)..(40): Xaa at position 40 is Phe, Tyr, Met, His, Ile, Leu, Val Ala, or Gly
  SITE (42)..(42): Xaa at position 42 is Cys, Ala, Val, Gly, Ser, or Thr
  SITE (44)..(44): Xaa at position 44 is Ala, Gly, or Pro
  SITE (53)..(53): Xaa at position 53 is Trp, Tyr, Phe, Met, His, Ile, Leu Val, Ala, or Gly
  SITE (78)..(78): Xaa at position 78 is Leu, Ala, Val, Gly, or Ile
  SITE (80)..(80): Xaa at position 80 is Ile, Ala, Val, Leu, or Gly
  SITE (83)..(83): Xaa at position 83 is Ala, Gly, or Pro
  SITE (93)..(93): Xaa at position 93 is Cys, Ala, Val, Gly, Ser, or Thr
  SITE (95)..(95): Xaa at position 95 is Ala, Gly, or Pro
  SITE (107)..(107): Xaa at position 107 is Val, Ala, Gly, Leu, or Ile
  SITE (132)..(132): Xaa at position 132 is Ala, Gly, or Pro
  SITE (134)..(134): Xaa at position 134 is Val, Ala, Gly, Leu, or Ile
  SITE (136)..(136): Xaa at position 136 is Cys, Ala, Val, Gly, Ser, or Thr
  SITE (173)..(173): Xaa at position 173 is Ile, Ala, Val, Leu, or Gly
  SITE (176)..(176): Xaa at position 176 is Ile, Ala, Val, Leu, or Gly
  SITE (184)..(184): Xaa at position 184 is Tyr, Phe, Met, His, Ile, Leu, Val Ala, or Gly
  SITE (186)..(186): Xaa at position 186 is Cys, Ala, Val, Gly, Ser, or Thr
  SITE (190)..(190): Xaa at position 190 is Val, Ala, Gly, Leu, or Ile
  SITE (201)..(201): Xaa at position 201 is Ile, Ala, Val, Leu, or Gly
  SITE (203)..(203): Xaa at position 203 is Val, Ala, Gly, Leu, or Ile
  SITE (205)..(205): Xaa at position 205 is Val, Ala, Gly, Leu, or Ile
  SITE (220)..(220): Xaa at position 220 is Ala, Gly, or Pro
  SITE (222)..(222): Xaa at position 222 is Ala, Gly, or Pro
  SITE (230)..(230): Xaa at position 230 is Phe, Tyr, Met, His, Ile, Leu, Val Ala, or Gly
  SITE (232)..(232): Xaa at position 232 is Cys, Ala, Val, Gly, Ser, or Thr
  SITE (244)..(244): Xaa at position 244 is Trp, Tyr, Phe, Met, His, Ile, Leu Val, Ala, or Gly
  SITE (266)..(266): Xaa at position 266 is Leu, Ala, Val, Gly, or Ile
  SITE (268)..(268): Xaa at position 268 is Val, Ala, Gly, Leu, or Ile
  SITE (271)..(271): Xaa at position 271 is Ile, Ala, Val, Leu, or Gly
  SITE (279)..(279): Xaa at position 279 is Tyr, Phe, Met, His, Ile, Leu, Val Ala, or Gly
  SITE (281)..(281): Xaa at position 281 is Cys, Ala, Val, Gly, Ser, or Thr
  SITE (283)..(283): Xaa at position 283 is Ala, Gly, or Pro
  SITE (294)..(294): Xaa at position 294 is Ala, Gly, or Pro
  SITE (296)..(296): Xaa at position 296 is Leu, Ala, Val, Gly, or Ile
  SITE (304)..(304): Xaa at position 304 is Ile, Ala, Val, Leu, or Gly
  SITE (320)..(320): Xaa at position 320 is Leu, Ala, Val, Gly, or Ile
  SITE (322)..(322): Xaa at position 322 is Cys, Ala, Val, Gly, Ser, or Thr
  SITE (334)..(334): Xaa at position 334 is Trp, Tyr, Phe, Met, His, Ile, Leu Val, Ala, or Gly
  SITE (343)..(343): Xaa at position 343 is Phe, Tyr, Met, His, Ile, Leu, Val Ala, or Gly
  SITE (354)..(354): Xaa at position 354 is Ile, Ala, Val, Leu, or Gly
  SITE (365)..(365): Xaa at position 365 is Leu, Ala, Val, Gly, or Ile
  SITE (367)..(367): Xaa at position 367 is Ile, Ala, Val, Leu, or Gly
  SITE (370)..(370): Xaa at position 370 is Val, Ala, Gly, Leu, or Ile
  SITE (378)..(378): Xaa at position 378 is Tyr, Phe, Met, His, Ile, Leu, Val Ala, or Gly
  SITE (380)..(380): Xaa at position 380 is Cys, Ala, Val, Gly, Ser, or Thr
  SITE (382)..(382): Xaa at position 382 is Ala, Gly, or Pro
  SITE (393)..(393): Xaa at position 393 is Met, Ile, Leu, Val, Ala, or Gly
  SITE (418)..(418): Xaa at position 418 is Ile, Ala, Val, Leu, or Gly
  SITE (420)..(420): Xaa at position 420 is Ile, Ala, Val, Leu, or Gly
  SITE (422)..(422): Xaa at position 422 is Cys, Ala, Val, Gly, Ser, or Thr
  SITE (424)..(424): Xaa at position 424 is Val, Ala, Gly, Leu, or Ile
  SITE (434)..(434): Xaa at position 434 is Trp, Tyr, Phe, Met, His, Ile, Leu Val, Ala, or Gly
  SITE (460)..(460): Xaa at position 460 is Leu, Ala, Val, Gly, or Ile
  SITE (462)..(462): Xaa at position 462 is Ile, Ala, Val, Leu, or Gly
  SITE (473)..(473): Xaa at position 473 is Tyr, Phe, Met, His, Ile, Leu, Val Ala, or Gly
  SITE (475)..(475): Xaa at position 475 is Cys, Ala, Val, Gly, Ser, or Thr
  SITE (477)..(477): Xaa at position 477 is Ala, Gly, or Pro
  SITE (488)..(488): Xaa at position 488 is Tyr, Phe, Met, His, Ile, Leu, Val Ala, or Gly
  SITE (493)..(493): Xaa at position 493 is Ala, Gly, or Pro
  SITE (512)..(512): Xaa at position 512 is Ala, Gly, or Pro
  SITE (514)..(514): Xaa at position 514 is Val, Ala, Gly, Leu, or Ile
  SITE (516)..(516): Xaa at position 516 is Phe, Tyr, Met, His, Ile, Leu, Val Ala, or Gly
  SITE (530)..(530): Xaa at position 530 is Tyr, Phe, Met, His, Ile, Leu, Val Ala, or Gly
  SITE (532)..(532): Xaa at position 532 is Val, Ala, Gly, Leu, or Ile
  SITE (556)..(556): Xaa at position 556 is Leu, Ala, Val, Gly, or Ile
  SITE (567)..(567): Xaa at position 567 is Ile, Ala, Val, Leu, or Gly
  SITE (569)..(569): Xaa at position 569 is Val, Ala, Gly, Leu, or Ile
  SITE (570)..(570): Xaa at position 570 is Ala, Gly, or Pro
  SITE (571)..(571): Xaa at position 571 is Ala, Gly, or Pro
  SITE (611)..(611): Xaa at position 611 is Leu, Ala, Val, Gly, or Ile
  SITE (613)..(613): Xaa at position 613 is Ile, Ala, Val, Leu, or Gly
  SITE (621)..(621): Xaa at position 621 is Ala, Gly, or Pro
  SITE (628)..(628): Xaa at position 628 is Val, Ala, Gly, Leu, or Ile
  SITE (653)..(653): Xaa at position 653 is Leu, Ala, Val, Gly, or Ile
  SITE (656)..(656): Xaa at position 656 is Leu, Ala, Val, Gly, or Ile
  SITE (664)..(664): Xaa at position 664 is Val, Ala, Gly, Leu, or Ile
  SITE (666)..(666): Xaa at position 666 is Ile, Ala, Val, Leu, or Gly
  SITE (668)..(668): Xaa at position 668 is Ala, Gly, or Pro
MSLLLSFYLLGLLVSSGQALLQVTISLSKVEXSVGESKFXTXTXIGEPESIDXYNPQGEKIISTQRVVVQKEGVRSRXTXYNXNIEDAGIYRXQXTDAKGQTQEATXVLEIYQKLTFREVVSPQEFKQGEDXEXVXRVSSSPAPAVSWLYHNEEVTTISDNRFAMLANNNLQXLNXNKSDEGIXRXEGRXEARGEIDFRDXIXIXNVPPAISMPQKSFNXTXERGEEMTXSXRASGSPEPAISXFRNGKLIEENEKYILKGSNTEXTXRNXINSDGGPXVXRXTNKAGEDEKQXFXQVFVQPHXIQLKNETTYENGQVTXVXDAEGEPIPEITXKRAVDGFTXTEGDKSLDGRXEVKGQHGSSSXHXKDXKLSDSGRXDXEXASRIGGHQKSXYLDIEYAPKFISNQTIYYSWEGNPXNXSXDXKSNPPASIHXRRDKLVLPAKNTTNLKTYSTGRKMIXEXAPTSDNDFGRXNXTXTNHIGTRFQEXILALXDVPSSPYGVKIIELSQTTXKXSXNKPDSHGGVPIHHXQXDVKEVASEIWKIVRSHGVQTMVVXNNLEPNTTYEXRXXXVNGKGQGDYSKIEIFQTLPVREPSPPSIHGQPSSGKSFKXSXTKQDDGGXPILEYIXKYRSKDKEDQWLEKKVQGNKDHIIXEHXQWTMGYEXQXTXANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 41 - protein, 904 aa, Homo sapiens
  SITE (35)..(35): Xaa at position 35 is Ala, Gly, or Pro
  SITE (37)..(37): Xaa at position 37 is Cys, Ala, Val, Gly, Ser, or Thr
  SITE (53)..(53): Xaa at position 53 is Ile, Ala, Val, Leu, or Gly
  SITE (56)..(56): Xaa at position 56 is Leu, Ala, Val, Gly, or Ile
  SITE (58)..(58): Xaa at position 58 is Leu, Ala, Val, Gly, or Ile
  SITE (63)..(63): Xaa at position 63 is Leu, Ala, Val, Gly, or Ile
  SITE (66)..(66): Xaa at position 66 is Leu, Ala, Val, Gly, or Ile
  SITE (71)..(71): Xaa at position 71 is Phe, Tyr, Met, His, Ile, Leu, Val Ala, or Gly
  SITE (74)..(74): Xaa at position 74 is Tyr, Phe, Met, His, Ile, Leu, Val Ala, or Gly
  SITE (77)..(77): Xaa at position 77 is Leu, Ala, Val, Gly, or Ile
  SITE (80)..(80): Xaa at position 80 is Leu, Ala, Val, Gly, or Ile
  SITE (82)..(82): Xaa at position 82 is Val, Ala, Gly, Leu, or Ile
  SITE (87)..(87): Xaa at position 87 is Ile, Ala, Val, Leu, or Gly
  SITE (98)..(98): Xaa at position 98 is Leu, Ala, Val, Gly, or Ile
  SITE (101)..(101): Xaa at position 101 is Leu, Ala, Val, Gly, or Ile
  SITE (103)..(103): Xaa at position 103 is Val, Ala, Gly, Leu, or Ile
  SITE (104)..(104): Xaa at position 104 is Leu, Ala, Val, Gly, or Ile
  SITE (106)..(106): Xaa at position 106 is Leu, Ala, Val, Gly, or Ile
  SITE (111)..(111): Xaa at position 111 is Leu, Ala, Val, Gly, or Ile
  SITE (119)..(119): Xaa at position 119 is Phe, Tyr, Met, His, Ile, Leu, Val Ala, or Gly
  SITE (125)..(125): Xaa at position 125 is Leu, Ala, Val, Gly, or Ile
  SITE (128)..(128): Xaa at position 128 is Leu, Ala, Val, Gly, or Ile
  SITE (130)..(130): Xaa at position 130 is Leu, Ala, Val, Gly, or Ile
  SITE (135)..(135): Xaa at position 135 is Ile, Ala, Val, Leu, or Gly
  SITE (143)..(143): Xaa at position 143 is Phe, Tyr, Met, His, Ile, Leu, Val Ala, or Gly
  SITE (149)..(149): Xaa at position 149 is Leu, Ala, Val, Gly, or Ile
  SITE (152)..(152): Xaa at position 152 is Leu, Ala, Val, Gly, or Ile
  SITE (154)..(154): Xaa at position 154 is Leu, Ala, Val, Gly, or Ile
  SITE (164)..(164): Xaa at position 164 is Leu, Ala, Val, Gly, or Ile
  SITE (170)..(170): Xaa at position 170 is Leu, Ala, Val, Gly, or Ile
  SITE (173)..(173): Xaa at position 173 is Leu, Ala, Val, Gly, or Ile
  SITE (176)..(176): Xaa at position 176 is Leu, Ala, Val, Gly, or Ile
  SITE (178)..(178): Xaa at position 178 is Leu, Ala, Val, Gly, or Ile
  SITE (183)..(183): Xaa at position 183 is Ile, Ala, Val, Leu, or Gly
  SITE (186)..(186): Xaa at position 186 is Leu, Ala, Val, Gly, or Ile
  SITE (191)..(191): Xaa at position 191 is Leu, Ala, Val, Gly, or Ile
  SITE (193)..(193): Xaa at position 193 is Ile, Ala, Val, Leu, or Gly
  SITE (194)..(194): Xaa at position 194 is Phe, Tyr, Met, His, Ile, Leu, Val Ala, or Gly
  SITE (199)..(199): Xaa at position 199 is Leu, Ala, Val, Gly, or Ile
  SITE (202)..(202): Xaa at position 202 is Leu, Ala, Val, Gly, or Ile
  SITE (204)..(204): Xaa at position 204 is Leu, Ala, Val, Gly, or Ile
  SITE (209)..(209): Xaa at position 209 is Ile, Ala, Val, Leu, or Gly
  SITE (216)..(216): Xaa at position 216 is Cys, Ala, Val, Gly, Ser, or Thr
  SITE (217)..(217): Xaa at position 217 is Phe, Tyr, Met, His, Ile, Leu, Val Ala, or Gly
  SITE (223)..(223): Xaa at position 223 is Leu, Ala, Val, Gly, or Ile
  SITE (226)..(226): Xaa at position 226 is Leu, Ala, Val, Gly, or Ile
  SITE (228)..(228): Xaa at position 228 is Leu, Ala, Val, Gly, or Ile
  SITE (231)..(231): Xaa at position 231 is Val, Ala, Gly, Leu, or Ile
  SITE (241)..(241): Xaa at position 241 is Leu, Ala, Val, Gly, or Ile
  SITE (242)..(242): Xaa at position 242 is Cys, Ala, Val, Gly, Ser, or Thr
  SITE (245)..(245): Xaa at position 245 is Leu, Ala, Val, Gly, or Ile
  SITE (250)..(250): Xaa at position 250 is Ile, Ala, Val, Leu, or Gly
  SITE (253)..(253): Xaa at position 253 is Leu, Ala, Val, Gly, or Ile
  SITE (255)..(255): Xaa at position 255 is Leu, Ala, Val, Gly, or Ile
  SITE (260)..(260): Xaa at position 260 is Leu, Ala, Val, Gly, or Ile
  SITE (268)..(268): Xaa at position 268 is Phe, Tyr, Met, His, Ile, Leu, Val Ala, or Gly
  SITE (269)..(269): Xaa at position 269 is Leu, Ala, Val, Gly, or Ile
  SITE (271)..(271): Xaa at position 271 is Leu, Ala, Val, Gly, or Ile
  SITE (276)..(276): Xaa at position 276 is Leu, Ala, Val, Gly, or Ile
  SITE (279)..(279): Xaa at position 279 is Leu, Ala, Val, Gly, or Ile
  SITE (281)..(281): Xaa at position 281 is Leu, Ala, Val, Gly, or Ile
  SITE (286)..(286): Xaa at position 286 is Leu, Ala, Val, Gly, or Ile
  SITE (289)..(289): Xaa at position 289 is Val, Ala, Gly, Leu, or Ile
  SITE (294)..(294): Xaa at position 294 is Phe, Tyr, Met, His, Ile, Leu, Val Ala, or Gly
  SITE (297)..(297): Xaa at position 297 is Leu, Ala, Val, Gly, or Ile
  SITE (300)..(300): Xaa at position 300 is Leu, Ala, Val, Gly, or Ile
  SITE (303)..(303): Xaa at position 303 is Phe, Tyr, Met, His, Ile, Leu, Val Ala, or Gly
  SITE (305)..(305): Xaa at position 305 is Leu, Ala, Val, Gly, or Ile
  SITE (310)..(310): Xaa at position 310 is Ile, Ala, Val, Leu, or Gly
  SITE (313)..(313): Xaa at position 313 is Leu, Ala, Val, Gly, or Ile
  SITE (318)..(318): Xaa at position 318 is Leu, Ala, Val, Gly, or Ile
  SITE (321)..(321): Xaa at position 321 is Leu, Ala, Val, Gly, or Ile
  SITE (324)..(324): Xaa at position 324 is Val, Ala, Gly, Leu, or Ile
  SITE (327)..(327): Xaa at position 327 is Leu, Ala, Val, Gly, or Ile
  SITE (329)..(329): Xaa at position 329 is Leu, Ala, Val, Gly, or Ile
  SITE (351)..(351): Xaa at position 351 is Phe, Tyr, Met, His, Ile, Leu, Val Ala, or Gly
  SITE (354)..(354): Xaa at position 354 is Leu, Ala, Val, Gly, or Ile
  SITE (357)..(357): Xaa at position 357 is Leu, Ala, Val, Gly, or Ile
  SITE (360)..(360): Xaa at position 360 is Leu, Ala, Val, Gly, or Ile
  SITE (362)..(362): Xaa at position 362 is Met, Ile, Leu, Val, Ala, or Gly
  SITE (375)..(375): Xaa at position 375 is Phe, Tyr, Met, His, Ile, Leu, Val Ala, or Gly
  SITE (378)..(378): Xaa at position 378 is Leu, Ala, Val, Gly, or Ile
  SITE (381)..(381): Xaa at position 381 is Leu, Ala, Val, Gly, or Ile
  SITE (384)..(384): Xaa at position 384 is Leu, Ala, Val, Gly, or Ile
  SITE (386)..(386): Xaa at position 386 is Leu, Ala, Val, Gly, or Ile
  SITE (396)..(396): Xaa at position 396 is Leu, Ala, Val, Gly, or Ile
  SITE (401)..(401): Xaa at position 401 is Phe, Tyr, Met, His, Ile, Leu, Val Ala, or Gly
  SITE (404)..(404): Xaa at position 404 is Leu, Ala, Val, Gly, or Ile
  SITE (409)..(409): Xaa at position 409 is Leu, Ala, Val, Gly, or Ile
  SITE (410)..(410): Xaa at position 410 is His, Phe, Tyr, Lys, Arg, Gly, Ser Thr, Ala, Val, Leu, Ile, Asn, Met, or Gln
  SITE (412)..(412): Xaa at position 412 is Leu, Ala, Val, Gly, or Ile
  SITE (414)..(414): Xaa at position 414 is Leu, Ala, Val, Gly, or Ile
  SITE (419)..(419): Xaa at position 419 is Ile, Ala, Val, Leu, or Gly
  SITE (422)..(422): Xaa at position 422 is Ile, Ala, Val, Leu, or Gly
  SITE (426)..(426): Xaa at position 426 is Ala, Gly, or Pro
  SITE (427)..(427): Xaa at position 427 is Phe, Tyr, Met, His, Ile, Leu, Val Ala, or Gly
  SITE (430)..(430): Xaa at position 430 is Leu, Ala, Val, Gly, or Ile
  SITE (433)..(433): Xaa at position 433 is Leu, Ala, Val, Gly, or Ile
  SITE (436)..(436): Xaa at position 436 is Leu, Ala, Val, Gly, or Ile
  SITE (438)..(438): Xaa at position 438 is Leu, Ala, Val, Gly, or Ile
  SITE (440)..(440): Xaa at position 440 is Leu, Ala, Val, Gly, or Ile
  SITE (443)..(443): Xaa at position 443 is Ile, Ala, Val, Leu, or Gly
  SITE (447)..(447): Xaa at position 447 is Leu, Ala, Val, Gly, or Ile
  SITE (452)..(452): Xaa at position 452 is Trp, Tyr, Phe, Met, His, Ile, Leu Val, Ala, or Gly
  SITE (455)..(455): Xaa at position 455 is Leu, Ala, Val, Gly, or Ile
  SITE (458)..(458): Xaa at position 458 is Ile, Ala, Val, Leu, or Gly
  SITE (461)..(461): Xaa at position 461 is Ile, Ala, Val, Leu, or Gly
  SITE (463)..(463): Xaa at position 463 is Leu, Ala, Val, Gly, or Ile
  SITE (469)..(469): Xaa at position 469 is Leu, Ala, Val, Gly, or Ile
  SITE (471)..(471): Xaa at position 471 is Leu, Ala, Val, Gly, or Ile
  SITE (476)..(476): Xaa at position 476 is Phe, Tyr, Met, His, Ile, Leu, Val Ala, or Gly
  SITE (479)..(479): Xaa at position 479 is Val, Ala, Gly, Leu, or Ile
  SITE (482)..(482): Xaa at position 482 is Leu, Ala, Val, Gly, or Ile
  SITE (485)..(485): Xaa at position 485 is Leu, Ala, Val, Gly, or Ile
  SITE (487)..(487): Xaa at position 487 is Leu, Ala, Val, Gly, or Ile
  SITE (490)..(490): Xaa at position 490 is Val, Ala, Gly, Leu, or Ile
  SITE (492)..(492): Xaa at position 492 is Leu, Ala, Val, Gly, or Ile
  SITE (495)..(495): Xaa at position 495 is Val, Ala, Gly, Leu, or Ile
  SITE (502)..(502): Xaa at position 502 is Phe, Tyr, Met, His, Ile, Leu, Val Ala, or Gly
  SITE (505)..(505): Xaa at position 505 is Leu, Ala, Val, Gly, or Ile
  SITE (508)..(508): Xaa at position 508 is Leu, Ala, Val, Gly, or Ile
  SITE (511)..(511): Xaa at position 511 is Leu, Ala, Val, Gly, or Ile
  SITE (513)..(513): Xaa at position 513 is Leu, Ala, Val, Gly, or Ile
  SITE (521)..(521): Xaa at position 521 is Ile, Ala, Val, Leu, or Gly
  SITE (525)..(525): Xaa at position 525 is Met, Ile, Leu, Val, Ala, or Gly
  SITE (526)..(526): Xaa at position 526 is Leu, Ala, Val, Gly, or Ile
  SITE (529)..(529): Xaa at position 529 is Leu, Ala, Val, Gly, or Ile
  SITE (532)..(532): Xaa at position 532 is Leu, Ala, Val, Gly, or Ile
  SITE (535)..(535): Xaa at position 535 is Leu, Ala, Val, Gly, or Ile
  SITE (537)..(537): Xaa at position 537 is Leu, Ala, Val, Gly, or Ile
  SITE (542)..(542): Xaa at position 542 is Leu, Ala, Val, Gly, or Ile
  SITE (545)..(545): Xaa at position 545 is Leu, Ala, Val, Gly, or Ile
  SITE (546)..(546): Xaa at position 546 is Trp, Tyr, Phe, Met, His, Ile, Leu Val, Ala, or Gly
  SITE (557)..(557): Xaa at position 557 is Phe, Tyr, Met, His, Ile, Leu, Val Ala, or Gly
  SITE (558)..(558): Xaa at position 558 is Leu, Ala, Val, Gly, or Ile
  SITE (561)..(561): Xaa at position 561 is Leu, Ala, Val, Gly, or Ile
  SITE (564)..(564): Xaa at position 564 is Leu, Ala, Val, Gly, or Ile
  SITE (567)..(567): Xaa at position 567 is Leu, Ala, Val, Gly, or Ile
  SITE (569)..(569): Xaa at position 569 is Leu, Ala, Val, Gly, or Ile
  SITE (574)..(574): Xaa at position 574 is Phe, Tyr, Met, His, Ile, Leu, Val Ala, or Gly
  SITE (582)..(582): Xaa at position 582 is Phe, Tyr, Met, His, Ile, Leu, Val Ala, or Gly
  SITE (585)..(585): Xaa at position 585 is Leu, Ala, Val, Gly, or Ile
  SITE (588)..(588): Xaa at position 588 is Leu, Ala, Val, Gly, or Ile
  SITE (591)..(591): Xaa at position 591 is Ile, Ala, Val, Leu, or Gly
  SITE (593)..(593): Xaa at position 593 is Leu, Ala, Val, Gly, or Ile
  SITE (595)..(595): Xaa at position 595 is Leu, Ala, Val, Gly, or Ile
  SITE (598)..(598): Xaa at position 598 is Leu, Ala, Val, Gly, or Ile
  SITE (601)..(601): Xaa at position 601 is Leu, Ala, Val, Gly, or Ile
  SITE (606)..(606): Xaa at position 606 is Phe, Tyr, Met, His, Ile, Leu, Val Ala, or Gly
  SITE (612)..(612): Xaa at position 612 is Leu, Ala, Val, Gly, or Ile
  SITE (615)..(615): Xaa at position 615 is Leu, Ala, Val, Gly, or Ile
  SITE (617)..(617): Xaa at position 617 is Leu, Ala, Val, Gly, or Ile
  SITE (622)..(622): Xaa at position 622 is Ile, Ala, Val, Leu, or Gly
  SITE (625)..(625): Xaa at position 625 is Val, Ala, Gly, Leu, or Ile
  SITE (633)..(633): Xaa at position 633 is Ala, Gly, or Pro
  SITE (634)..(634): Xaa at position 634 is Phe, Tyr, Met, His, Ile, Leu, Val Ala, or Gly
  SITE (640)..(640): Xaa at position 640 is Leu, Ala, Val, Gly, or Ile
  SITE (642)..(642): Xaa at position 642 is Met, Ile, Leu, Val, Ala, or Gly
  SITE (647)..(647): Xaa at position 647 is Phe, Tyr, Met, His, Ile, Leu, Val Ala, or Gly
  SITE (654)..(654): Xaa at position 654 is Ile, Ala, Val, Leu, or Gly
  SITE (657)..(657): Xaa at position 657 is Phe, Tyr, Met, His, Ile, Leu, Val Ala, or Gly
  SITE (675)..(675): Xaa at position 675 is Tyr, Phe, Met, His, Ile, Leu, Val Ala, or Gly
  SITE (688)..(688): Xaa at position 688 is Val, Ala, Gly, Leu, or Ile
MRQTLPCIYFWGGLLPFGMLCASSTTKCTVSHEVXDXSHLKLTQVPDDLPTNXTVXNXTHNQXRRXPAANXTRXSQXTSXDXGFNTXSKLEPELCQKXPMXKXXNXQHNEXSQLSDKTXAFCTNXTEXHXMSNSXQKIKNNPXVKQKNXITXDXSHNGLSSTKXGTQVQXENXQEXLXSNNKXQAXKSEEXDXXANSSXKKXEXSSNQXKEFSPGXXHAIGRXFGXFXNNXQLGPSLTEKXXLEXANTSXRNXSXSNSQXSTTSNTTXXGXKWTNXTMXDXSYNNXNVXGNDSXAWXPQXEYXFXEYNNXQHXFSHSXHGXFNXRYXNXKRSFTKQSISLASLPKIDDFSXQWXKCXEHXNXEDNDIPGIKSNMXTGXINXKYXSXSNSFTSLRTXTNETXVSXAHSPXXIXNXTKNKXSKXESDXXSWXGHXEVXDXGXNEXGQEXTGQEXRGXENXFEXYXSYNKYXQXTRNSXALXPSXQRXMXRRXAXKNXDSSPSPXQPXRNXTIXDXSNNNIANXNDDXXEGXEKXEIXDXQHNNXARXXKHANPGGPIYXXKGXSHXHIXNXESNGXDEIPVEVXKDXFEXKIXDXGXNNXNTXPASVXNNQVSXKSXNXQKNLXTSXEKKVFGPXXRNLTEXDXRFNPXDCTCESXAWXVNWINETHTNIPELSSHXLCNTPPHYHGFPXRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 42 - protein, 208 aa, Homo sapiens
  SITE (82)..(82): Xaa at position 82 is Leu, Ala, Val, Gly, or Ile
  SITE (90)..(90): Xaa at position 90 is Leu, Ala, Val, Gly, or Ile
  SITE (92)..(92): Xaa at position 92 is Ile, Ala, Val, Leu, or Gly
  SITE (111)..(111): Xaa at position 111 is Leu, Ala, Val, Gly, or Ile
  SITE (113)..(113): Xaa at position 113 is Ile, Ala, Val, Leu, or Gly
  SITE (123)..(123): Xaa at position 123 is Val, Ala, Gly, Leu, or Ile
  SITE (125)..(125): Xaa at position 125 is Ala, Gly, or Pro
  SITE (132)..(132): Xaa at position 132 is Leu, Ala, Val, Gly, or Ile
  SITE (133)..(133): Xaa at position 133 is Ala, Gly, or Pro
  SITE (134)..(134): Xaa at position 134 is Met, Ile, Leu, Val, Ala, or Gly
  SITE (150)..(150): Xaa at position 150 is Cys, Ala, Val, Gly, Ser, or Thr
  SITE (152)..(152): Xaa at position 152 is Leu, Ala, Val, Gly, or Ile
  SITE (164)..(164): Xaa at position 164 is Tyr, Phe, Met, His, Ile, Leu, Val Ala, or Gly
  SITE (176)..(176): Xaa at position 176 is Met, Ile, Leu, Val, Ala, or Gly
  SITE (178)..(178): Xaa at position 178 is Val, Ala, Gly, Leu, or Ile
  SITE (179)..(179): Xaa at position 179 is Ala, Gly, or Pro
  SITE (180)..(180): Xaa at position 180 is Leu, Ala, Val, Gly, or Ile
  SITE (199)..(199): Xaa at position 199 is Ala, Gly, or Pro
  SITE (201)..(201): Xaa at position 201 is Phe, Tyr, Met, His, Ile, Leu, Val Ala, or Gly
MWKWILTHCASAFPHLPGCCCCCFLLLFLVSSVPVTCQALGQDMVSPEATNSSSSSFSSPSSAGRHVRSYNHLQGDVRWRKXFSFTKYFXKXEKNGKVSGTKKENCPYSIXEXTSVEIGVVAXKXINSNYYXXXNKKGKLYGSKEFNNDXKXKERIEENGYNTXASFNWQHNGRQXYXXXNGKGAPRRGQKTRRKNTSXHXLPMVVHS

SEQ ID NO: 43 - protein, 660 aa, Homo sapiens
  SITE (75)..(75): Xaa at position 75 is Ile, Ala, Val, Leu, or Gly
  SITE (100)..(100): Xaa at position 100 is Leu, Ala, Val, Gly, or Ile
  SITE (121)..(121): Xaa at position 121 is Ile, Ala, Val, Leu, or Gly
  SITE (129)..(129): Xaa at position 129 is Leu, Ala, Val, Gly, or Ile
  SITE (132)..(132): Xaa at position 132 is Leu, Ala, Val, Gly, or Ile
  SITE (135)..(135): Xaa at position 135 is Leu, Ala, Val, Gly, or Ile
  SITE (138)..(138): Xaa at position 138 is Leu, Ala, Val, Gly, or Ile
  SITE (140)..(140): Xaa at position 140 is Leu, Ala, Val, Gly, or Ile
  SITE (159)..(159): Xaa at position 159 is Ile, Ala, Val, Leu, or Gly
  SITE (161)..(161): Xaa at position 161 is Leu, Ala, Val, Gly, or Ile
  SITE (163)..(163): Xaa at position 163 is Leu, Ala, Val, Gly, or Ile
  SITE (164)..(164): Xaa at position 164 is Leu, Ala, Val, Gly, or Ile
  SITE (166)..(166): Xaa at position 166 is Leu, Ala, Val, Gly, or Ile
  SITE (185)..(185): Xaa at position 185 is Leu, Ala, Val, Gly, or Ile
  SITE (193)..(193): Xaa at position 193 is Ala, Gly, or Pro
  SITE (203)..(203): Xaa at position 203 is Leu, Ala, Val, Gly, or Ile
  SITE (206)..(206): Xaa at position 206 is Leu, Ala, Val, Gly, or Ile
  SITE (209)..(209): Xaa at position 209 is Leu, Ala, Val, Gly, or Ile
  SITE (211)..(211): Xaa at position 211 is Val, Ala, Gly, Leu, or Ile
  SITE (215)..(215): Xaa at position 215 is Leu, Ala, Val, Gly, or Ile
  SITE (216)..(216): Xaa at position 216 is Leu, Ala, Val, Gly, or Ile
  SITE (235)..(235): Xaa at position 235 is Phe, Tyr, Met, His, Ile, Leu, Val Ala, or Gly
  SITE (237)..(237): Xaa at position 237 is Ile, Ala, Val, Leu, or Gly
  SITE (254)..(254): Xaa at position 254 is Leu, Ala, Val, Gly, or Ile
  SITE (257)..(257): Xaa at position 257 is Leu, Ala, Val, Gly, or Ile
  SITE (259)..(259): Xaa at position 259 is Leu, Ala, Val, Gly, or Ile
  SITE (278)..(278): Xaa at position 278 is Leu, Ala, Val, Gly, or Ile
  SITE (281)..(281): Xaa at position 281 is Leu, Ala, Val, Gly, or Ile
  SITE (288)..(288): Xaa at position 288 is Leu, Ala, Val, Gly, or Ile
  SITE (291)..(291): Xaa at position 291 is Leu, Ala, Val, Gly, or Ile
  SITE (296)..(296): Xaa at position 296 is Phe, Tyr, Met, His, Ile, Leu, Val Ala, or Gly
  SITE (299)..(299): Xaa at position 299 is Leu, Ala, Val, Gly, or Ile
  SITE (305)..(305): Xaa at position 305 is Leu, Ala, Val, Gly, or Ile
  SITE (318)..(318): Xaa at position 318 is Ile, Ala, Val, Leu, or Gly
  SITE (325)..(325): Xaa at position 325 is Leu, Ala, Val, Gly, or Ile
MGLQTTKWPSHGAFFLKSWLIISLGLYSQVSKLLACPSVCRCDRNFVYCNERSLTSVPLGIPEGVTVLYLHNNQXNNAGFPAELHNVQSVHTVYLYGNQXDEFPMNLPKNVRVLHLQENNXQTISRAAXAQXLKXEEXHXDDNSISTVGVEDGAFREAXSXKXXFXSKNHLSSVPVGLPVDLQEXRVDENRIXVISDMAFQNXTSXERXIXDGNXXTNKGIAEGTFSHLTKLKEXSXVRNSLSHPPPDLPGTHXIRXYXQDNQINHIPLTAFSNLRKXERXDISNNQXRMXTQGVXDNXSNLKQXTARNNPWFCDCSXKWVTEWXKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 44 - protein, 252 aa, Homo sapiens
  SITE (84)..(84): Xaa at position 84 is Cys, Ala, Val, Gly, Ser, or Thr
  SITE (133)..(133): Xaa at position 133 is Cys, Ala, Val, Gly, Ser, or Thr
  SITE (179)..(179): Xaa at position 179 is Cys, Ala, Val, Gly, Ser, or Thr
MAQLCGLRRSRAFLALLGSLLLSGVLAADRERSIHDFCLVSKVVGRCRASMPRWWYNVTDGSCQLFVYGGCDGNSNNYLTKEEXLKKCATVTENATGDLATSRNAADSSVPSAPRRQDSEDHSSDMFNYEEYXTANAVTGPCRASFPRWYFDVERNSCNNFIYGGCRGNKNSYRSEEAXMLRCFRQQENPPLPLGSKVVVLAGLFVMVLILFLGASMVYLIRVARRNQERALRTVWSSGDDKEQLVKNTYVL

SEQ ID NO: 45 - protein, 396 aa, Homo sapiens
  SITE (59)..(59): Xaa at position 59 is Ala, Gly, or Pro
  SITE (67)..(67): Xaa at position 67 is Val, Ala, Gly, Leu, or Ile
  SITE (95)..(95): Xaa at position 95 is Ala, Gly, or Pro
  SITE (99)..(99): Xaa at position 99 is Met, Ile, Leu, Val, Ala, or Gly
  SITE (103)..(103): Xaa at position 103 is Cys, Ala, Val, Gly, Ser, or Thr
  SITE (107)..(107): Xaa at position 107 is Val, Ala, Gly, Leu, or Ile
  SITE (110)..(110): Xaa at position 110 is Leu, Ala, Val, Gly, or Ile
  SITE (111)..(111): Xaa at position 111 is Ala, Gly, or Pro
  SITE (114)..(114): Xaa at position 114 is Val, Ala, Gly, Leu, or Ile
  SITE (123)..(123): Xaa at position 123 is Leu, Ala, Val, Gly, or Ile
  SITE (125)..(125): Xaa at position 125 is Val, Ala, Gly, Leu, or Ile
  SITE (129)..(129): Xaa at position 129 is Trp, Tyr, Phe, Met, His, Ile, Leu Val, Ala, or Gly
  SITE (140)..(140): Xaa at position 140 is Leu, Ala, Val, Gly, or Ile
  SITE (141)..(141): Xaa at position 141 is His, Phe, Tyr, Lys, Arg, Gly, Ser Thr, Ala, Val, Leu, Ile, Asn, Met, or Gln
  SITE (146)..(146): Xaa at position 146 is Ala, Gly, or Pro
  SITE (147)..(147): Xaa at position 147 is Leu, Ala, Val, Gly, or Ile
  SITE (149)..(149): Xaa at position 149 is Ile, Ala, Val, Leu, or Gly
  SITE (159)..(159): Xaa at position 159 is Tyr, Phe, Met, His, Ile, Leu, Val Ala, or Gly
  SITE (161)..(161): Xaa at position 161 is Leu, Ala, Val, Gly, or Ile
  SITE (162)..(162): Xaa at position 162 is Leu, Ala, Val, Gly, or Ile
  SITE (163)..(163): Xaa at position 163 is Ala, Gly, or Pro
  SITE (166)..(166): Xaa at position 166 is Ala, Gly, or Pro
  SITE (174)..(174): Xaa at position 174 is Val, Ala, Gly, Leu, or Ile
  SITE (182)..(182): Xaa at position 182 is Val, Ala, Gly, Leu, or Ile
  SITE (184)..(184): Xaa at position 184 is Val, Ala, Gly, Leu, or Ile
  SITE (186)..(186): Xaa at position 186 is Val, Ala, Gly, Leu, or Ile
  SITE (188)..(188): Xaa at position 188 is Ala, Gly, or Pro
  SITE (194)..(194): Xaa at position 194 is Val, Ala, Gly, Leu, or Ile
MALLTNLLPLCCLALLALPAQSCGPGRGPVGRRRYARKQLVPLLYKQFVPGVPERTLGXSGPAEGRXARGSERFRDLVPNYNPDIIFKDEENSGXDRLXTERXKERXNAXXIAXMNMWPGVRXRXTEGXDEDGHHAQDSXXYEGRXXDXTTSDRDRNKXGXXXRLXVEAGFDWXYYESRNHXHXSXKXDNSLAXRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 46 - protein, 1007 aa, Homo sapiens
  SITE (445)..(445): Xaa at position 445 is Val, Ala, Gly, Leu, or Ile
  SITE (446)..(446): Xaa at position 446 is Val, Ala, Gly, Leu, or Ile
  SITE (453)..(453): Xaa at position 453 is Phe, Tyr, Met, His, Ile, Leu, Val Ala, or Gly
  SITE (454)..(454): Xaa at position 454 is Val, Ala, Gly, Leu, or Ile
  SITE (470)..(470): Xaa at position 470 is Phe, Tyr, Met, His, Ile, Leu, Val Ala, or Gly
  SITE (474)..(474): Xaa at position 474 is Val, Ala, Gly, Leu, or Ile
  SITE (475)..(475): Xaa at position 475 is Leu, Ala, Val, Gly, or Ile
  SITE (478)..(478): Xaa at position 478 is Leu, Ala, Val, Gly, or Ile
  SITE (491)..(491): Xaa at position 491 is Ala, Gly, or Pro
  SITE (508)..(508): Xaa at position 508 is Leu, Ala, Val, Gly, or Ile
  SITE (509)..(509): Xaa at position 509 is Val, Ala, Gly, Leu, or Ile
  SITE (517)..(517): Xaa at position 517 is Ala, Gly, or Pro
  SITE (519)..(519): Xaa at position 519 is Ile, Ala, Val, Leu, or Gly
  SITE (521)..(521): Xaa at position 521 is Ile, Ala, Val, Leu, or Gly
  SITE (524)..(524): Xaa at position 524 is Leu, Ala, Val, Gly, or Ile
  SITE (534)..(534): Xaa at position 534 is Val, Ala, Gly, Leu, or Ile
  SITE (547)..(547): Xaa at position 547 is Val, Ala, Gly, Leu, or Ile
  SITE (548)..(548): Xaa at position 548 is Leu, Ala, Val, Gly, or Ile
  SITE (549)..(549): Xaa at position 549 is Leu, Ala, Val, Gly, or Ile
  SITE (562)..(562): Xaa at position 562 is Leu, Ala, Val, Gly, or Ile
  SITE (671)..(671): Xaa at position 671 is Leu, Ala, Val, Gly, or Ile
  SITE (679)..(679): Xaa at position 679 is Tyr, Phe, Met, His, Ile, Leu, Val Ala, or Gly
  SITE (708)..(708): Xaa at position 708 is Met, Ile, Leu, Val, Ala, or Gly
  SITE (712)..(712): Xaa at position 712 is Ile, Ala, Val, Leu, or Gly
  SITE (732)..(732): Xaa at position 732 is Val, Ala, Gly, Leu, or Ile
  SITE (738)..(738): Xaa at position 738 is Ala, Gly, or Pro
  SITE (739)..(739): Xaa at position 739 is Phe, Tyr, Met, His, Ile, Leu, Val Ala, or Gly
  SITE (740)..(740): Xaa at position 740 is Val, Ala, Gly, Leu, or Ile
  SITE (745)..(745): Xaa at position 745 is Val, Ala, Gly, Leu, or Ile
  SITE (746)..(746): Xaa at position 746 is Leu, Ala, Val, Gly, or Ile
  SITE (758)..(758): Xaa at position 758 is Phe, Tyr, Met, His, Ile, Leu, Val Ala, or Gly
  SITE (770)..(770): Xaa at position 770 is Tyr, Phe, Met, His, Ile, Leu, Val Ala, or Gly
  SITE (772)..(772): Xaa at position 772 is Ile, Ala, Val, Leu, or Gly
  SITE (773)..(773): Xaa at position 773 is Ala, Gly, or Pro
  SITE (774)..(774): Xaa at position 774 is Leu, Ala, Val, Gly, or Ile
  SITE (784)..(784): Xaa at position 784 is Phe, Tyr, Met, His, Ile, Leu, Val Ala, or Gly
  SITE (788)..(788): Xaa at position 788 is Ile, Ala, Val, Leu, or Gly
  SITE (797)..(797): Xaa at position 797 is Met, Ile, Leu, Val, Ala, or Gly
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRXXTVLEEPXXMVSENVLGKPKKYQGXSIDXXDAXSNYLGFNYEIYVXPDHKYGSPQEDGTWNGXXGELVFKRXDXGXSAXTITPDRENVXDFTTRYMDYSVGXXXRRAEKTVDMFACXAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDXSKQTEIPXGTVLDSAVYEHVRMKGLNPFERDSMYSQXWRMXNRSNGSENNVLESQAGIQKXKYGNYXXXWDAAXXEYVAINDPDCSXYTIGNTVADRGXGXXXQHGSPYRDVXSQRXLELQQNGDXDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 47 - protein, 240 aa, Homo sapiens
  SITE (96)..(96): Xaa at position 96 is Ala, Gly, or Pro
  SITE (98)..(98): Xaa at position 98 is Leu, Ala, Val, Gly, or Ile
  SITE (112)..(112): Xaa at position 112 is Leu, Ala, Val, Gly, or Ile
  SITE (132)..(132): Xaa at position 132 is Ala, Gly, or Pro
  SITE (133)..(133): Xaa at position 133 is Leu, Ala, Val, Gly, or Ile
  SITE (135)..(135): Xaa at position 135 is Val, Ala, Gly, Leu, or Ile
  SITE (141)..(141): Xaa at position 141 is Tyr, Phe, Met, His, Ile, Leu, Val Ala, or Gly
  SITE (143)..(143): Xaa at position 143 is Ile, Ala, Val, Leu, or Gly
  SITE (147)..(147): Xaa at position 147 is Val, Ala, Gly, Leu, or Ile
  SITE (149)..(149): Xaa at position 149 is Leu, Ala, Val, Gly, or Ile
  SITE (162)..(162): Xaa at position 162 is Ile, Ala, Val, Leu, or Gly
  SITE (164)..(164): Xaa at position 164 is His, Phe, Tyr, Lys, Arg, Gly, Ser Thr, Ala, Val, Leu, Ile, Asn, Met, or Gln
  SITE (166)..(166): Xaa at position 166 is Leu, Ala, Val, Gly, or Ile
  SITE (180)..(180): Xaa at position 180 is Leu, Ala, Val, Gly, or Ile
  SITE (215)..(215): Xaa at position 215 is Val, Ala, Gly, Leu, or Ile
  SITE (216)..(216): Xaa at position 216 is Val, Ala, Gly, Leu, or Ile
  SITE (217)..(217): Xaa at position 217 is Val, Ala, Gly, Leu, or Ile
  SITE (224)..(224): Xaa at position 224 is Leu, Ala, Val, Gly, or Ile
  SITE (235)..(235): Xaa at position 235 is Phe, Tyr, Met, His, Ile, Leu, Val Ala, or Gly
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAXHXTGANSSLTGSGGPXLWETQLGLAFLRGLSYHDGXXVXTKAGYXYXYSKXQXGGVGCPLGLASTXTXGXYKRTPRYPEELELXVSQQSPCGRATSSSRVWWDSSFLGGVVHLEAGEKXXXRVLDERXVRLRDGTRSYXGAFMV

SEQ ID NO: 48 - protein, 354 aa, Homo sapiens
  SITE (43)..(43): Xaa at position 43 is Trp, Tyr, Phe, Met, His, Ile, Leu Val, Ala, or Gly
  SITE (58)..(58): Xaa at position 58 is Ile, Ala, Val, Leu, or Gly
  SITE (60)..(60): Xaa at position 60 is Leu, Ala, Val, Gly, or Ile
  SITE (79)..(79): Xaa at position 79 is Tyr, Phe, Met, His, Ile, Leu, Val Ala, or Gly
  SITE (89)..(89): Xaa at position 89 is Leu, Ala, Val, Gly, or Ile
  SITE (96)..(96): Xaa at position 96 is Val, Ala, Gly, Leu, or Ile
  SITE (98)..(98): Xaa at position 98 is Leu, Ala, Val, Gly, or Ile
  SITE (104)..(104): Xaa at position 104 is Met, Ile, Leu, Val, Ala, or Gly
  SITE (106)..(106): Xaa at position 106 is Ile, Ala, Val, Leu, or Gly
  SITE (118)..(118): Xaa at position 118 is Leu, Ala, Val, Gly, or Ile
  SITE (120)..(120): Xaa at position 120 is Leu, Ala, Val, Gly, or Ile
  SITE (121)..(121): Xaa at position 121 is His, Phe, Tyr, Lys, Arg, Gly, Ser Thr, Ala, Val, Leu, Ile, Asn, Met, or Gln
  SITE (122)..(122): Xaa at position 122 is Trp, Tyr, Phe, Met, His, Ile, Leu Val, Ala, or Gly
  SITE (133)..(133): Xaa at position 133 is His, Phe, Tyr, Lys, Arg, Gly, Ser Thr, Ala, Val, Leu, Ile, Asn, Met, or Gln
  SITE (142)..(142): Xaa at position 142 is Ala, Gly, or Pro
  SITE (144)..(144): Xaa at position 144 is Leu, Ala, Val, Gly, or Ile
  SITE (145)..(145): Xaa at position 145 is His, Phe, Tyr, Lys, Arg, Gly, Ser Thr, Ala, Val, Leu, Ile, Asn, Met, or Gln
  SITE (146)..(146): Xaa at position 146 is Ile, Ala, Val, Leu, or Gly
  SITE (148)..(148): Xaa at position 148 is His, Phe, Tyr, Lys, Arg, Gly, Ser Thr, Ala, Val, Leu, Ile, Asn, Met, or Gln
  SITE (160)..(160): Xaa at position 160 is Ala, Gly, or Pro
  SITE (168)..(168): Xaa at position 168 is Ala, Gly, or Pro
  SITE (170)..(170): Xaa at position 170 is Leu, Ala, Val, Gly, or Ile
  SITE (171)..(171): Xaa at position 171 is Ala, Gly, or Pro
  SITE (172)..(172): Xaa at position 172 is Val, Ala, Gly, Leu, or Ile
  SITE (173)..(173): Xaa at position 173 is Leu, Ala, Val, Gly, or Ile
  SITE (174)..(174): Xaa at position 174 is Ile, Ala, Val, Leu, or Gly
  SITE (183)..(183): Xaa at position 183 is Tyr, Phe, Met, His, Ile, Leu, Val Ala, or Gly
  SITE (186)..(186): Xaa at position 186 is Ile, Ala, Val, Leu, or Gly
  SITE (190)..(190): Xaa at position 190 is Leu, Ala, Val, Gly, or Ile
  SITE (193)..(193): Xaa at position 193 is Val, Ala, Gly, Leu, or Ile
  SITE (202)..(202): Xaa at position 202 is Val, Ala, Gly, Leu, or Ile
  SITE (207)..(207): Xaa at position 207 is Ile, Ala, Val, Leu, or Gly
  SITE (210)..(210): Xaa at position 210 is Leu, Ala, Val, Gly, or Ile
  SITE (230)..(230): Xaa at position 230 is Cys, Ala, Val, Gly, Ser, or Thr
  SITE (234)..(234): Xaa at position 234 is Val, Ala, Gly, Leu, or Ile
  SITE (236)..(236): Xaa at position 236 is Trp, Tyr, Phe, Met, His, Ile, Leu Val, Ala, or Gly
  SITE (238)..(238): Xaa at position 238 is Val, Ala, Gly, Leu, or Ile
  SITE (239)..(239): Xaa at position 239 is Phe, Tyr, Met, His, Ile, Leu, Val Ala, or Gly
  SITE (245)..(245): Xaa at position 245 is Ile, Ala, Val, Leu, or Gly
  SITE (250)..(250): Xaa at position 250 is Leu, Ala, Val, Gly, or Ile
  SITE (251)..(251): Xaa at position 251 is Leu, Ala, Val, Gly, or Ile
  SITE (253)..(253): Xaa at position 253 is Leu, Ala, Val, Gly, or Ile
  SITE (256)..(256): Xaa at position 256 is Ala, Gly, or Pro
  SITE (257)..(257): Xaa at position 257 is Leu, Ala, Val, Gly, or Ile
  SITE (270)..(270): Xaa at position 270 is Met, Ile, Leu, Val, Ala, or Gly
  SITE (285)..(285): Xaa at position 285 is Val, Ala, Gly, Leu, or Ile
MPRRSLHAAAVLLLVILKEQPSSPAPVNGSKWTYFGPDGENSXSKKYPSCGGLLQSPXDXHSDILQYDASLTPLEFQGXNLSANKQFLXTNNGHSXKXNLPSDXHXQGLQSRYSATQXHXXXGNPNDPHGSEXTVSGQHFAXEXXXVXYNSDLYPDASTXSNKSEGLXVXXXXXEMGSFNPSXDKXFSHXQHXKYKGQEAFXPGFNXEEXLPERTAEYYRYRGSLTTPPXNPTXLXTXXRNPVQXSQEQXXAXETXXYCTHMDDPSPREXINNFRQVQKFDERLXYTSFSQVQVCTAAGLSLGIILSLALAGILGICIVVVVSIWLFRRKSIKKGDNKGVIYKPATKMETEAHA

SEQ ID NO: 49 - protein, 911 aa, Homo sapiens
  SITE (56)..(56): Xaa at position 56 is Phe, Tyr, Met, His, Ile, Leu, Val Ala, or Gly
  SITE (59)..(59): Xaa at position 59 is Trp, Tyr, Phe, Met, His, Ile, Leu Val, Ala, or Gly
  SITE (60)..(60): Xaa at position 60 is Cys, Ala, Val, Gly, Ser, or Thr
  SITE (64)..(64): Xaa at position 64 is Leu, Ala, Val, Gly, or Ile
  SITE (78)..(78): Xaa at position 78 is Phe, Tyr, Met, His, Ile, Leu, Val Ala, or Gly
  SITE (82)..(82): Xaa at position 82 is Leu, Ala, Val, Gly, or Ile
  SITE (84)..(84): Xaa at position 84 is Leu, Ala, Val, Gly, or Ile
  SITE (87)..(87): Xaa at position 87 is Leu, Ala, Val, Gly, or Ile
  SITE (88)..(88): Xaa at position 88 is Leu, Ala, Val, Gly, or Ile
  SITE (112)..(112): Xaa at position 112 is Val, Ala, Gly, Leu, or Ile
  SITE (115)..(115): Xaa at position 115 is Ala, Gly, or Pro
  SITE (116)..(116): Xaa at position 116 is Leu, Ala, Val, Gly, or Ile
  SITE (119)..(119): Xaa at position 119 is Ile, Ala, Val, Leu, or Gly
  SITE (126)..(126): Xaa at position 126 is Leu, Ala, Val, Gly, or Ile
  SITE (131)..(131): Xaa at position 131 is Ala, Gly, or Pro
  SITE (134)..(134): Xaa at position 134 is Ile, Ala, Val, Leu, or Gly
  SITE (135)..(135): Xaa at position 135 is Val, Ala, Gly, Leu, or Ile
  SITE (143)..(143): Xaa at position 143 is Leu, Ala, Val, Gly, or Ile
  SITE (145)..(145): Xaa at position 145 is Met, Ile, Leu, Val, Ala, or Gly
  SITE (146)..(146): Xaa at position 146 is Ile, Ala, Val, Leu, or Gly
  SITE (149)..(149): Xaa at position 149 is Ile, Ala, Val, Leu, or Gly
  SITE (150)..(150): Xaa at position 150 is Ile, Ala, Val, Leu, or Gly
  SITE (154)..(154): Xaa at position 154 is Ala, Gly, or Pro
  SITE (155)..(155): Xaa at position 155 is Ile, Ala, Val, Leu, or Gly
  SITE (158)..(158): Xaa at position 158 is Ile, Ala, Val, Leu, or Gly
  SITE (169)..(169): Xaa at position 169 is Leu, Ala, Val, Gly, or Ile
  SITE (173)..(173): Xaa at position 173 is Cys, Ala, Val, Gly, Ser, or Thr
  SITE (185)..(185): Xaa at position 185 is Val, Ala, Gly, Leu, or Ile
  SITE (188)..(188): Xaa at position 188 is Phe, Tyr, Met, His, Ile, Leu, Val Ala, or Gly
  SITE (192)..(192): Xaa at position 192 is Trp, Tyr, Phe, Met, His, Ile, Leu Val, Ala, or Gly
  SITE (197)..(197): Xaa at position 197 is Ala, Gly, or Pro
  SITE (198)..(198): Xaa at position 198 is Phe, Tyr, Met, His, Ile, Leu, Val Ala, or Gly
  SITE (200)..(200): Xaa at position 200 is Ala, Gly, or Pro
  SITE (201)..(201): Xaa at position 201 is Leu, Ala, Val, Gly, or Ile
  SITE (202)..(202): Xaa at position 202 is Ile, Ala, Val, Leu, or Gly
  SITE (215)..(215): Xaa at position 215 is Leu, Ala, Val, Gly, or Ile
  SITE (221)..(221): Xaa at position 221 is Val, Ala, Gly, Leu, or Ile
  SITE (224)..(224): Xaa at position 224 is Leu, Ala, Val, Gly, or Ile
  SITE (227)..(227): Xaa at position 227 is Ala, Gly, or Pro
  SITE (228)..(228): Xaa at position 228 is Phe, Tyr, Met, His, Ile, Leu, Val Ala, or Gly
  SITE (231)..(231): Xaa at position 231 is Ala, Gly, or Pro
  SITE (240)..(240): Xaa at position 240 is Met, Ile, Leu, Val, Ala, or Gly
  SITE (243)..(243): Xaa at position 243 is Ala, Gly, or Pro
  SITE (246)..(246): Xaa at position 246 is Ile, Ala, Val, Leu, or Gly
  SITE (256)..(256): Xaa at position 256 is Ala, Gly, or Pro
  SITE (257)..(257): Xaa at position 257 is Ile, Ala, Val, Leu, or Gly
  SITE (258)..(258): Xaa at position 258 is Met, Ile, Leu, Val, Ala, or Gly
  SITE (260)..(260): Xaa at position 260 is Tyr, Phe, Met, His, Ile, Leu, Val Ala, or Gly
  SITE (261)..(261): Xaa at position 261 is Val, Ala, Gly, Leu, or Ile
  SITE (264)..(264): Xaa at position 264 is Phe, Tyr, Met, His, Ile, Leu, Val Ala, or Gly
  SITE (265)..(265): Xaa at position 265 is Tyr, Phe, Met, His, Ile, Leu, Val Ala, or Gly
  SITE (274)..(274): Xaa at position 274 is Ala, Gly, or Pro
  SITE (415)..(415): Xaa at position 415 is Ala, Gly, or Pro
  SITE (418)..(418): Xaa at position 418 is Phe, Tyr, Met, His, Ile, Leu, Val Ala, or Gly
  SITE (422)..(422): Xaa at position 422 is Ala, Gly, or Pro
  SITE (436)..(436): Xaa at position 436 is Leu, Ala, Val, Gly, or Ile
  SITE (449)..(449): Xaa at position 449 is Ile, Ala, Val, Leu, or Gly
  SITE (473)..(473): Xaa at position 473 is Ile, Ala, Val, Leu, or Gly
  SITE (480)..(480): Xaa at position 480 is Leu, Ala, Val, Gly, or Ile
  SITE (491)..(491): Xaa at position 491 is Val, Ala, Gly, Leu, or Ile
  SITE (498)..(498): Xaa at position 498 is Ile, Ala, Val, Leu, or Gly
  SITE (505)..(505): Xaa at position 505 is Leu, Ala, Val, Gly, or Ile
  SITE (516)..(516): Xaa at position 516 is Leu, Ala, Val, Gly, or Ile
  SITE (530)..(530): Xaa at position 530 is His, Phe, Tyr, Lys, Arg, Gly, Ser Thr, Ala, Val, Leu, Ile, Asn, Met, or Gln
  SITE (533)..(533): Xaa at position 533 is Tyr, Phe, Met, His, Ile, Leu, Val Ala, or Gly
  SITE (537)..(537): Xaa at position 537 is Ala, Gly, or Pro
  SITE (544)..(544): Xaa at position 544 is Met, Ile, Leu, Val, Ala, or Gly
  SITE (563)..(563): Xaa at position 563 is Ile, Ala, Val, Leu, or Gly
  SITE (577)..(577): Xaa at position 577 is Leu, Ala, Val, Gly, or Ile
  SITE (587)..(587): Xaa at position 587 is Ile, Ala, Val, Leu, or Gly
  SITE (594)..(594): Xaa at position 594 is Ala, Gly, or Pro
  SITE (605)..(605): Xaa at position 605 is Leu, Ala, Val, Gly, or Ile
  SITE (619)..(619): Xaa at position 619 is Ile, Ala, Val, Leu, or Gly
  SITE (626)..(626): Xaa at position 626 is Val, Ala, Gly, Leu, or Ile
  SITE (637)..(637): Xaa at position 637 is Leu, Ala, Val, Gly, or Ile
  SITE (679)..(679): Xaa at position 679 is Met, Ile, Leu, Val, Ala, or Gly
  SITE (719)..(719): Xaa at position 719 is Ile, Ala, Val, Leu, or Gly
  SITE (743)..(743): Xaa at position 743 is Ile, Ala, Val, Leu, or Gly
  SITE (815)..(815): Xaa at position 815 is Met, Ile, Leu, Val, Ala, or Gly
  SITE (880)..(880): Xaa at position 880 is Ile, Ala, Val, Leu, or Gly
MVDYHAANQSYQYGPSSAGNGAGGGGSMGDYMAQEDDWDRDLLLDPAWEKQQRKTXTAXXNSHXRKAGTQIENIDEDXRDGXKXMLXXEVISGERLPKPERGKMRVHKINNXNKXXDFXASKGVKXVSIGXEEXXDGNAKMTXGXXWTXXLRFXXQDXSVEETSAKEGXLLWXQRKTAPYKNVNXQNXHISXKDGLXXNXXXHRHRPELIEYDKXRKDDPXTNXNNXXEVXEKYLDIPKXLDXEDXVNTARPDEKXXXTXXSSXXHAFSGAQKXETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLXEKXRQKXSIHEAWTDGKEAMXKHRDYETATLSDXKALIRKHEAFESDLAAHQDRVEQXAAIAQEXNELDYYDSHNXNTRCQKXCDQWDAXGSLTHSRREAXEKTEKQLEAIDQLXLEXAKRXAPFNNWXESAMEDLQDMFIVHTIEEXEGLISAHDQFKSTXPDADREREAXLAIHKEXQRIAESNHIKXSGSNPYTTVTPQIXNSKWEKXQQLVPKRDHAXLEEQSKQQSNEHLRRQFASQANVVGPWIQTKMEEIGRISIEXNGTLEDQLSHLKQYERSIVDYKPNLDLLEQQHQLIQEALXFDNKHTNYTMEHIRVGWEQLLTTXARTINEVENQILTRDAKGISQEQMQEFRASFNHFDKDHGGALGPEEFKACLISLGYDVENDRQGEAEFNRIXSLVDPNHSGLVTFQAFIDFMSRETTDTDTADQVIASFKVLAGDKNFITAEELRRELPPDQAEYCXARMAPYQGPDAVPGALDYKSFSTALYGESDL

SEQ ID NO: 50 - protein, 480 aa, Homo sapiens
  SITE (59)..(59): Xaa at position 59 is Cys, Ala, Val, Gly, Ser, or Thr
  SITE (116)..(116): Xaa at position 116 is Cys, Ala, Val, Gly, Ser, or Thr
  SITE (154)..(154): Xaa at position 154 is Cys, Ala, Val, Gly, Ser, or Thr
  SITE (325)..(325): Xaa at position 325 is Met, Ile, Leu, Val, Ala, or Gly
  SITE (351)..(351): Xaa at position 351 is Trp, Tyr, Phe, Met, His, Ile, Leu Val, Ala, or Gly
  SITE (356)..(356): Xaa at position 356 is Ala, Gly, or Pro
  SITE (366)..(366): Xaa at position 366 is Ala, Gly, or Pro
  SITE (367)..(367): Xaa at position 367 is Trp, Tyr, Phe, Met, His, Ile, Leu Val, Ala, or Gly
  SITE (378)..(378): Xaa at position 378 is Leu, Ala, Val, Gly, or Ile
  SITE (380)..(380): Xaa at position 380 is Val, Ala, Gly, Leu, or Ile
  SITE (388)..(388): Xaa at position 388 is Val, Ala, Gly, Leu, or Ile
  SITE (391)..(391): Xaa at position 391 is Ile, Ala, Val, Leu, or Gly
  SITE (396)..(396): Xaa at position 396 is Ala, Gly, or Pro
  SITE (405)..(405): Xaa at position 405 is Val, Ala, Gly, Leu, or Ile
  SITE (408)..(408): Xaa at position 408 is Tyr, Phe, Met, His, Ile, Leu, Val Ala, or Gly
  SITE (410)..(410): Xaa at position 410 is Leu, Ala, Val, Gly, or Ile
  SITE (411)..(411): Xaa at position 411 is Ala, Gly, or Pro
  SITE (422)..(422): Xaa at position 422 is Tyr, Phe, Met, His, Ile, Leu, Val Ala, or Gly
  SITE (453)..(453): Xaa at position 453 is Ala, Gly, or Pro
  SITE (456)..(456): Xaa at position 456 is Ile, Ala, Val, Leu, or Gly
  SITE (458)..(458): Xaa at position 458 is Ile, Ala, Val, Leu, or Gly
  SITE (467)..(467): Xaa at position 467 is Ile, Ala, Val, Leu, or Gly
  SITE (469)..(469): Xaa at position 469 is Leu, Ala, Val, Gly, or Ile
  SITE (473)..(473): Xaa at position 473 is Leu, Ala, Val, Gly, or Ile
MKRSVAVWLLVGLSLGVPQFGKGDICDPNPCENGGICLPGLADGSFSCECPDGFTDPNXSSVVEVASDEEEPTSAGPCTPNPCHNGGTCEISEAYRGDTFIGYVCKCPRGFNGIHXQHNINECEVEPCKNGGICTDLVANYSCECPGEFMGRNXQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGXKSGHIQDYQITASSIFRTLNMDMFTXEPRKXRLDKQGKVNXXTSGHNDQSQWXQXDLLVPTKXTGXITQGXKDFGHVQFXGSXKXXYSNDGEHWTVXQDEKQRKDKVFQGNFDNDTHRKNVIDPPIYXRHXRXLPWSWYGRXTXRSEXLGCTEEE

SEQ ID NO: 51 - protein, 1013 aa, Homo sapiens
  SITE (148)..(148): Xaa at position 148 is Ala, Gly, or Pro
  SITE (149)..(149): Xaa at position 149 is Ala, Gly, or Pro
  SITE (157)..(157): Xaa at position 157 is Trp, Tyr, Phe, Met, His, Ile, Leu Val, Ala, or Gly
  SITE (162)..(162): Xaa at position 162 is Ile, Ala, Val, Leu, or Gly
  SITE (178)..(178): Xaa at position 178 is Phe, Tyr, Met, His, Ile, Leu, Val Ala, or Gly
  SITE (181)..(181): Xaa at position 181 is Ala, Gly, or Pro
  SITE (185)..(185): Xaa at position 185 is Trp, Tyr, Phe, Met, His, Ile, Leu Val, Ala, or Gly
  SITE (191)..(191): Xaa at position 191 is Val, Ala, Gly, Leu, or Ile
  SITE (203)..(203): Xaa at position 203 is Ile, Ala, Val, Leu, or Gly
  SITE (205)..(205): Xaa at position 205 is Phe, Tyr, Met, His, Ile, Leu, Val Ala, or Gly
  SITE (226)..(226): Xaa at position 226 is Ile, Ala, Val, Leu, or Gly
  SITE (238)..(238): Xaa at position 238 is Val, Ala, Gly, Leu, or Ile
  SITE (239)..(239): Xaa at position 239 is Val, Ala, Gly, Leu, or Ile
  SITE (242)..(242): Xaa at position 242 is Leu, Ala, Val, Gly, or Ile
  SITE (245)..(245): Xaa at position 245 is Val, Ala, Gly, Leu, or Ile
  SITE (246)..(246): Xaa at position 246 is Ile, Ala, Val, Leu, or Gly
  SITE (248)..(248): Xaa at position 248 is Phe, Tyr, Met, His, Ile, Leu, Val Ala, or Gly
  SITE (250)..(250): Xaa at position 250 is His, Phe, Tyr, Lys, Arg, Gly, Ser Thr, Ala, Val, Leu, Ile, Asn, Met, or Gln
  SITE (252)..(252): Xaa at position 252 is His, Phe, Tyr, Lys, Arg, Gly, Ser Thr, Ala, Val, Leu, Ile, Asn, Met, or Gln
  SITE (261)..(261): Xaa at position 261 is Val, Ala, Gly, Leu, or Ile
  SITE (268)..(268): Xaa at position 268 is Ile, Ala, Val, Leu, or Gly
  SITE (276)..(276): Xaa at position 276 is Phe, Tyr, Met, His, Ile, Leu, Val Ala, or Gly
  SITE (296)..(296): Xaa at position 296 is Ile, Ala, Val, Leu, or Gly
  SITE (297)..(297): Xaa at position 297 is Met, Ile, Leu, Val, Ala, or Gly
  SITE (298)..(298): Xaa at position 298 is His, Phe, Tyr, Lys, Arg, Gly, Ser Thr, Ala, Val, Leu, Ile, Asn, Met, or Gln
  SITE (313)..(313): Xaa at position 313 is Ile, Ala, Val, Leu, or Gly
  SITE (340)..(340): Xaa at position 340 is Ala, Gly, or Pro
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRXXTSRTERIXPGGVXPYVIGGNFTGSQRAMXKQXMRHXEKHTCXTFIERSDEESYXVXTYRPCGCCSYVGRRGNGPQAXSIGKNCDKFGIXXHEXGHXXGXWXEXTRPDRDNHXTIIRENXQPGQEYNXLKMEPGEVNSLGERYDFDSXXXYARNTFSRGMFLDTXLPSRDDNGIRPAIGQRTRLSKGDIAQXRKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 52 - protein, 1283 aa, Homo sapiens
  SITE (19)..(19): Xaa at position 19 is Val, Ala, Gly, Leu, or Ile
  SITE (108)..(108): Xaa at position 108 is Val, Ala, Gly, Leu, or Ile
  SITE (155)..(155): Xaa at position 155 is Ile, Ala, Val, Leu, or Gly
MWGSDRLAGAGGGGAAVTXAFTNARDCFLHLPRRLVAQLHLLQNQAIEVVWSHQPAFLSWVEGRHFSDQGENVAEINRQVGQKLGLSNGGQVFLKPCSHVVSCQQVEXEPLSADDWEILELHAVSLEQHLLDQIRIVFPKAIFPVWVDQQTYIFXQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 53 - protein, 2985 aa, Homo sapiens
  SITE (2148)..(2148): Xaa at position 2148 is Leu, Ala, Val, Gly, or Ile
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFXFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 54 - protein, 3623 aa, Homo sapiens
  SITE (952)..(952): Xaa at position 952 is Tyr, Phe, Met, His, Ile, Leu, Val Ala, or Gly
  SITE (962)..(962): Xaa at position 962 is Ile, Ala, Val, Leu, or Gly
  SITE (970)..(970): Xaa at position 970 is Ile, Ala, Val, Leu, or Gly
  SITE (1020)..(1020): Xaa at position 1020 is Leu, Ala, Val, Gly, or Ile
  SITE (1024)..(1024): Xaa at position 1024 is Phe, Tyr, Met, His, Ile, Leu Val, Ala, or Gly
  SITE (1037)..(1037): Xaa at position 1037 is Ile, Ala, Val, Leu, or Gly
  SITE (1068)..(1068): Xaa at position 1068 is Tyr, Phe, Met, His, Ile, Leu Val, Ala, or Gly
  SITE (1074)..(1074): Xaa at position 1074 is Cys, Ala, Val, Gly, Ser, or Thr
  SITE (1076)..(1076): Xaa at position 1076 is Tyr, Phe, Met, His, Ile, Leu Val, Ala, or Gly
  SITE (1086)..(1086): Xaa at position 1086 is Ile, Ala, Val, Leu, or Gly
  SITE (1095)..(1095): Xaa at position 1095 is Leu, Ala, Val, Gly, or Ile
  SITE (1107)..(1107): Xaa at position 1107 is Leu, Ala, Val, Gly, or Ile
  SITE (1109)..(1109): Xaa at position 1109 is Ile, Ala, Val, Leu, or Gly
  SITE (1143)..(1143): Xaa at position 1143 is Phe, Tyr, Met, His, Ile, Leu Val, Ala, or Gly
  SITE (1154)..(1154): Xaa at position 1154 is Phe, Tyr, Met, His, Ile, Leu Val, Ala, or Gly
  SITE (1156)..(1156): Xaa at position 1156 is Ala, Gly, or Pro
  SITE (1191)..(1191): Xaa at position 1191 is Cys, Ala, Val, Gly, Ser, or Thr
  SITE (1193)..(1193): Xaa at position 1193 is Trp, Tyr, Phe, Met, His, Ile Leu, Val, Ala, or Gly
  SITE (1195)..(1195): Xaa at position 1195 is Leu, Ala, Val, Gly, or Ile
  SITE (1202)..(1202): Xaa at position 1202 is Ala, Gly, or Pro
  SITE (1203)..(1203): Xaa at position 1203 is Phe, Tyr, Met, His, Ile, Leu Val, Ala, or Gly
  SITE (1255)..(1255): Xaa at position 1255 is Met, Ile, Leu, Val, Ala, or Gly
  SITE (1270)..(1270): Xaa at position 1270 is Phe, Tyr, Met, His, Ile, Leu Val, Ala, or Gly
  SITE (1272)..(1272): Xaa at position 1272 is Ala, Gly, or Pro
  SITE (1281)..(1281): Xaa at position 1281 is Val, Ala, Gly, Leu, or Ile
  SITE (1291)..(1291): Xaa at position 1291 is Leu, Ala, Val, Gly, or Ile
  SITE (1306)..(1306): Xaa at position 1306 is Cys, Ala, Val, Gly, Ser, or Thr
  SITE (1308)..(1308): Xaa at position 1308 is Trp, Tyr, Phe, Met, His, Ile Leu, Val, Ala, or Gly
  SITE (1318)..(1318): Xaa at position 1318 is Val, Ala, Gly, Leu, or Ile
  SITE (1368)..(1368): Xaa at position 1368 is Val, Ala, Gly, Leu, or Ile
  SITE (1370)..(1370): Xaa at position 1370 is Leu, Ala, Val, Gly, or Ile
  SITE (1382)..(1382): Xaa at position 1382 is Phe, Tyr, Met, His, Ile, Leu Val, Ala, or Gly
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVXPHGINCTWHXLVQPNHLXHLMFETFHLEFHYNCTNDYLEVYDTDSETSLGRYCGKSIPPSLTSSGNSXMLVXVTDSDLAYEGFLXNYEAISAATACLQDYTDDLGTFTSPNFPNNXPNNWEXIXRITVRTGQLXAVHFTNFSXEEAIGNYYTDFXEXRDGGYEKSPLLGIFYGSNLPPTIISHSNKLWLKXKSDQIDTRSGXSXYWDGSSTGCGGNLTTSSGTFISPNYPMPYYHSSEXYXWXKSSHGSXXELEFKDFHLEHHPNCTLDYLAVYDGPSSNSHLLTQLCGDEKPPLIRSSGDSXFIKLRTDEGQQGRGXKXEYRQTCENXVIVNQTYGIXESIGYPNPYSENQHXNXTIRATTGNTXNYTFLAFDLEHHINCSTDYLELYDGPRQMGRYCGVDLPPPGSTTSSKLQXLXLTDGVGRREKGXQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 55 - protein, 184 aa, Homo sapiens
  SITE (178)..(178): Xaa at position 178 is Cys, Ala, Val, Gly, Ser, or Thr
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRXISIDLD

SEQ ID NO: 56 - protein, 858 aa, Homo sapiens
  SITE (72)..(72): Xaa at position 72 is Leu, Ala, Val, Gly, or Ile
  SITE (75)..(75): Xaa at position 75 is Leu, Ala, Val, Gly, or Ile
  SITE (94)..(94): Xaa at position 94 is Leu, Ala, Val, Gly, or Ile
  SITE (97)..(97): Xaa at position 97 is Leu, Ala, Val, Gly, or Ile
  SITE (114)..(114): Xaa at position 114 is Ala, Gly, or Pro
  SITE (121)..(121): Xaa at position 121 is Leu, Ala, Val, Gly, or Ile
  SITE (124)..(124): Xaa at position 124 is Leu, Ala, Val, Gly, or Ile
  SITE (144)..(144): Xaa at position 144 is Leu, Ala, Val, Gly, or Ile
  SITE (147)..(147): Xaa at position 147 is Leu, Ala, Val, Gly, or Ile
  SITE (157)..(157): Xaa at position 157 is Ile, Ala, Val, Leu, or Gly
  SITE (169)..(169): Xaa at position 169 is Leu, Ala, Val, Gly, or Ile
  SITE (175)..(175): Xaa at position 175 is Ile, Ala, Val, Leu, or Gly
  SITE (177)..(177): Xaa at position 177 is Phe, Tyr, Met, His, Ile, Leu, Val Ala, or Gly
  SITE (182)..(182): Xaa at position 182 is Ile, Ala, Val, Leu, or Gly
  SITE (190)..(190): Xaa at position 190 is Leu, Ala, Val, Gly, or Ile
  SITE (314)..(314): Xaa at position 314 is Leu, Ala, Val, Gly, or Ile
  SITE (317)..(317): Xaa at position 317 is Leu, Ala, Val, Gly, or Ile
  SITE (338)..(338): Xaa at position 338 is Leu, Ala, Val, Gly, or Ile
  SITE (341)..(341): Xaa at position 341 is Leu, Ala, Val, Gly, or Ile
  SITE (359)..(359): Xaa at position 359 is Leu, Ala, Val, Gly, or Ile
  SITE (362)..(362): Xaa at position 362 is Val, Ala, Gly, Leu, or Ile
  SITE (365)..(365): Xaa at position 365 is Ile, Ala, Val, Leu, or Gly
  SITE (425)..(425): Xaa at position 425 is Ala, Gly, or Pro
  SITE (447)..(447): Xaa at position 447 is Val, Ala, Gly, Leu, or Ile
  SITE (450)..(450): Xaa at position 450 is Leu, Ala, Val, Gly, or Ile
  SITE (475)..(475): Xaa at position 475 is Leu, Ala, Val, Gly, or Ile
  SITE (497)..(497): Xaa at position 497 is Val, Ala, Gly, Leu, or Ile
  SITE (507)..(507): Xaa at position 507 is Leu, Ala, Val, Gly, or Ile
  SITE (531)..(531): Xaa at position 531 is Leu, Ala, Val, Gly, or Ile
  SITE (553)..(553): Xaa at position 553 is Leu, Ala, Val, Gly, or Ile
  SITE (555)..(555): Xaa at position 555 is Ile, Ala, Val, Leu, or Gly
MGDHLDLLLGVVLMAGPVFGIPSCSFDGRIAFYRFCNLTQVPQVLNTTERLLLSFNYIRTVTASSFPFLEQXQLXELGSQYTPLTIDKEAFRNXPNXRILDLGSSKIYFLHPDXFQGLFHXFEXRLYFCGLSDAVLKDGYFRNXKAXTRLDLSKNQXRSLYLHPSFGKXNSLKSXDXSSNQXFLVCEHEXEPLQGKTLSFFSLAANSLYSRVSVDWGKCMNPFRNMVLEILDVSGNGWTVDITGNFSNAISKSQAFSLILAHHIMGAGFGFHNIKDPDQNTFAGLARSSVRHLDLSHGFVFSLNSRVFETLKDXKVXNLAYNKINKIADEAFYGLDNXQVXNLSYNLLGELYSSNFYGXPKXAYXDLQKNHIAIIQDQTFKFLEKLQTLDLRDNALTTIHFIPSIPDIFLSGNKLVTLPKINLTXNLIHLSENRLENLDILYFLLRXPHXQILILNQNRFSSCSGDQTPSENPSXEQLFLGENMLQLAWETELCWDXFEGLSHLQVXYLNHNYLNSLPPGVFSHLTALRGXSLNSNRLTVLSHNDLPANLEIXDXSRNQLLAPNPDVFVSLSVLDITHNKFICECELSTFINWLNHTNVTIAGPPADIYCVYPDSFSGVSLFSLSTEGCDEEEVLKSLKFSLFIVCTVTLTLFLMTILTVTKFRGFCFICYKTAQRLVFKDHPQGTEPDMYKYDAYLCFSSKDFTWVQNALLKHLDTQYSDQNRFNLCFEERDFVPGENRIANIQDAIWNSRKIVCLVSRHFLRDGWCLEAFSYAQGRCLSDLNSALIMVVVGSLSQYQLMKHQSIRGFVQKQQYLRWPEDFQDVGWFLHKLSQQILKKEKEKKKDNNIPLQTVATIS

SEQ ID NO: 57 - protein, 1549 aa, Homo sapiens
  SITE (702)..(702): Xaa at position 702 is Met, Ile, Leu, Val, Ala, or Gly
  SITE (703)..(703): Xaa at position 703 is Ile, Ala, Val, Leu, or Gly
  SITE (704)..(704): Xaa at position 704 is Val, Ala, Gly, Leu, or Ile
  SITE (709)..(709): Xaa at position 709 is Cys, Ala, Val, Gly, Ser, or Thr
  SITE (714)..(714): Xaa at position 714 is Leu, Ala, Val, Gly, or Ile
  SITE (715)..(715): Xaa at position 715 is Leu, Ala, Val, Gly, or Ile
  SITE (717)..(717): Xaa at position 717 is Ala, Gly, or Pro
  SITE (718)..(718): Xaa at position 718 is Ile, Ala, Val, Leu, or Gly
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTXXXGQVGXGKSSXXLXXLGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 58 - protein, 1977 aa, Homo sapiens
  SITE (252)..(252): Xaa at position 252 is Ala, Gly, or Pro
  SITE (700)..(700): Xaa at position 700 is Ala, Gly, or Pro
  SITE (707)..(707): Xaa at position 707 is Ile, Ala, Val, Leu, or Gly
  SITE (1015)..(1015): Xaa at position 1015 is Ala, Gly, or Pro
  SITE (1082)..(1082): Xaa at position 1082 is Val, Ala, Gly, Leu, or Ile
  SITE (1095)..(1095): Xaa at position 1095 is Ala, Gly, or Pro
  SITE (1120)..(1120): Xaa at position 1120 is Tyr, Phe, Met, His, Ile, Leu Val, Ala, or Gly
  SITE (1372)..(1372): Xaa at position 1372 is Ala, Gly, or Pro
  SITE (1389)..(1389): Xaa at position 1389 is Met, Ile, Leu, Val, Ala, or Gly
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYXIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQXLLTVFQXLTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFXCIGVQLFKGKFYTCTDEAKHTPQECKGSFLVYPDGDVSRPLVRERLWVNSDFNFDNVLSAMMALFTXSTFEGWPALLYKXIDAYAEDHGPIYNYRVEISVFFIVXIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQXVLLLFRCATGEAWQEIXLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 59 - protein, 483 aa, Homo sapiens
  SITE (45)..(45): Xaa at position 45 is Leu, Ala, Val, Gly, or Ile
  SITE (49)..(49): Xaa at position 49 is Tyr, Phe, Met, His, Ile, Leu, Val Ala, or Gly
  SITE (75)..(75): Xaa at position 75 is Leu, Ala, Val, Gly, or Ile
  SITE (81)..(81): Xaa at position 81 is Leu, Ala, Val, Gly, or Ile
  SITE (122)..(122): Xaa at position 122 is Leu, Ala, Val, Gly, or Ile
  SITE (126)..(126): Xaa at position 126 is Ile, Ala, Val, Leu, or Gly
  SITE (138)..(138): Xaa at position 138 is Val, Ala, Gly, Leu, or Ile
  SITE (141)..(141): Xaa at position 141 is Ala, Gly, or Pro
  SITE (142)..(142): Xaa at position 142 is Val, Ala, Gly, Leu, or Ile
  SITE (145)..(145): Xaa at position 145 is Ala, Gly, or Pro
  SITE (146)..(146): Xaa at position 146 is Leu, Ala, Val, Gly, or Ile
  SITE (148)..(148): Xaa at position 148 is Ala, Gly, or Pro
  SITE (149)..(149): Xaa at position 149 is Trp, Tyr, Phe, Met, His, Ile, Leu Val, Ala, or Gly
  SITE (153)..(153): Xaa at position 153 is Val, Ala, Gly, Leu, or Ile
  SITE (155)..(155): Xaa at position 155 is Leu, Ala, Val, Gly, or Ile
  SITE (165)..(165): Xaa at position 165 is Ala, Gly, or Pro
  SITE (167)..(167): Xaa at position 167 is Ile, Ala, Val, Leu, or Gly
  SITE (169)..(169): Xaa at position 169 is Ile, Ala, Val, Leu, or Gly
  SITE (171)..(171): Xaa at position 171 is Phe, Tyr, Met, His, Ile, Leu, Val Ala, or Gly
  SITE (190)..(190): Xaa at position 190 is Ala, Gly, or Pro
  SITE (193)..(193): Xaa at position 193 is Phe, Tyr, Met, His, Ile, Leu, Val Ala, or Gly
  SITE (205)..(205): Xaa at position 205 is Phe, Tyr, Met, His, Ile, Leu, Val Ala, or Gly
  SITE (211)..(211): Xaa at position 211 is Trp, Tyr, Phe, Met, His, Ile, Leu Val, Ala, or Gly
  SITE (220)..(220): Xaa at position 220 is Leu, Ala, Val, Gly, or Ile
  SITE (221)..(221): Xaa at position 221 is Phe, Tyr, Met, His, Ile, Leu, Val Ala, or Gly
  SITE (223)..(223): Xaa at position 223 is Val, Ala, Gly, Leu, or Ile
  SITE (224)..(224): Xaa at position 224 is Ala, Gly, or Pro
  SITE (225)..(225): Xaa at position 225 is Ala, Gly, or Pro
  SITE (228)..(228): Xaa at position 228 is Phe, Tyr, Met, His, Ile, Leu, Val Ala, or Gly
  SITE (231)..(231): Xaa at position 231 is Ala, Gly, or Pro
  SITE (232)..(232): Xaa at position 232 is Leu, Ala, Val, Gly, or Ile
  SITE (234)..(234): Xaa at position 234 is Leu, Ala, Val, Gly, or Ile
  SITE (242)..(242): Xaa at position 242 is Ala, Gly, or Pro
  SITE (243)..(243): Xaa at position 243 is Leu, Ala, Val, Gly, or Ile
  SITE (244)..(244): Xaa at position 244 is Met, Ile, Leu, Val, Ala, or Gly
  SITE (245)..(245): Xaa at position 245 is Tyr, Phe, Met, His, Ile, Leu, Val Ala, or Gly
  SITE (250)..(250): Xaa at position 250 is Tyr, Phe, Met, His, Ile, Leu, Val Ala, or Gly
  SITE (258)..(258): Xaa at position 258 is Leu, Ala, Val, Gly, or Ile
  SITE (263)..(263): Xaa at position 263 is Val, Ala, Gly, Leu, or Ile
  SITE (266)..(266): Xaa at position 266 is Ile, Ala, Val, Leu, or Gly
  SITE (269)..(269): Xaa at position 269 is Leu, Ala, Val, Gly, or Ile
MKVLPASGLAVFLIMALKFSTAAPSLVAASPRTWRNNYRLAQAYXDKYXTNKEGHQIGEMVARGSNSMIRKIKEXQAFFGXQVTGKLDQTTMNVIKKPRCGVPDVANYRLFPGEPKWKKNTXTYRXSKYTPSMSSVEXDKXXEMXXQXXSSAXPXSFVRINSGEXDXMXSXENGDHGDSYPFDGPRGTLXHAXAPGEGLGGDTHXDNAEKXTMGTNGFNXXTXXXHEXGHXXGXAHSTDPSXXXXPTYKXKNPYGFHXPKDDXKGXQAXYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 60 - protein, 1615 aa, Homo sapiens
  SITE (35)..(35): Xaa at position 35 is Leu, Ala, Val, Gly, or Ile
  SITE (36)..(36): Xaa at position 36 is Leu, Ala, Val, Gly, or Ile
  SITE (37)..(37): Xaa at position 37 is Phe, Tyr, Met, His, Ile, Leu, Val Ala, or Gly
  SITE (38)..(38): Xaa at position 38 is Ala, Gly, or Pro
  SITE (43)..(43): Xaa at position 43 is Val, Ala, Gly, Leu, or Ile
  SITE (62)..(62): Xaa at position 62 is Leu, Ala, Val, Gly, or Ile
  SITE (65)..(65): Xaa at position 65 is Ala, Gly, or Pro
  SITE (67)..(67): Xaa at position 67 is Ala, Gly, or Pro
  SITE (68)..(68): Xaa at position 68 is Val, Ala, Gly, Leu, or Ile
  SITE (77)..(77): Xaa at position 77 is Val, Ala, Gly, Leu, or Ile
  SITE (78)..(78): Xaa at position 78 is Tyr, Phe, Met, His, Ile, Leu, Val Ala, or Gly
  SITE (79)..(79): Xaa at position 79 is Trp, Tyr, Phe, Met, His, Ile, Leu Val, Ala, or Gly
  SITE (82)..(82): Xaa at position 82 is Val, Ala, Gly, Leu, or Ile
  SITE (86)..(86): Xaa at position 86 is Ala, Gly, or Pro
  SITE (87)..(87): Xaa at position 87 is Ile, Ala, Val, Leu, or Gly
  SITE (113)..(113): Xaa at position 113 is Leu, Ala, Val, Gly, or Ile
  SITE (122)..(122): Xaa at position 122 is Leu, Ala, Val, Gly, or Ile
  SITE (123)..(123): Xaa at position 123 is Tyr, Phe, Met, His, Ile, Leu, Val Ala, or Gly
  SITE (124)..(124): Xaa at position 124 is Trp, Tyr, Phe, Met, His, Ile, Leu Val, Ala, or Gly
  SITE (132)..(132): Xaa at position 132 is Ile, Ala, Val, Leu, or Gly
  SITE (134)..(134): Xaa at position 134 is Val, Ala, Gly, Leu, or Ile
  SITE (165)..(165): Xaa at position 165 is Met, Ile, Leu, Val, Ala, or Gly
  SITE (166)..(166): Xaa at position 166 is Tyr, Phe, Met, His, Ile, Leu, Val Ala, or Gly
  SITE (167)..(167): Xaa at position 167 is Trp, Tyr, Phe, Met, His, Ile, Leu Val, Ala, or Gly
  SITE (176)..(176): Xaa at position 176 is Ile, Ala, Val, Leu, or Gly
  SITE (179)..(179): Xaa at position 179 is Ala, Gly, or Pro
  SITE (181)..(181): Xaa at position 181 is Met, Ile, Leu, Val, Ala, or Gly
  SITE (190)..(190): Xaa at position 190 is Val, Ala, Gly, Leu, or Ile
  SITE (212)..(212): Xaa at position 212 is Ala, Gly, or Pro
  SITE (219)..(219): Xaa at position 219 is Ile, Ala, Val, Leu, or Gly
  SITE (242)..(242): Xaa at position 242 is Ala, Gly, or Pro
  SITE (250)..(250): Xaa at position 250 is Leu, Ala, Val, Gly, or Ile
  SITE (252)..(252): Xaa at position 252 is Trp, Tyr, Phe, Met, His, Ile, Leu Val, Ala, or Gly
  SITE (260)..(260): Xaa at position 260 is Ile, Ala, Val, Leu, or Gly
  SITE (261)..(261): Xaa at position 261 is His, Phe, Tyr, Lys, Arg, Gly, Ser Thr, Ala, Val, Leu, Ile, Asn, Met, or Gln
  SITE (284)..(284): Xaa at position 284 is Ile, Ala, Val, Leu, or Gly
  SITE (286)..(286): Xaa at position 286 is Val, Ala, Gly, Leu, or Ile
  SITE (309)..(309): Xaa at position 309 is Leu, Ala, Val, Gly, or Ile
  SITE (311)..(311): Xaa at position 311 is Leu, Ala, Val, Gly, or Ile
  SITE (312)..(312): Xaa at position 312 is Leu, Ala, Val, Gly, or Ile
  SITE (321)..(321): Xaa at position 321 is Cys, Ala, Val, Gly, Ser, or Thr
  SITE (323)..(323): Xaa at position 323 is Cys, Ala, Val, Gly, Ser, or Thr
  SITE (344)..(344): Xaa at position 344 is Leu, Ala, Val, Gly, or Ile
  SITE (345)..(345): Xaa at position 345 is Leu, Ala, Val, Gly, or Ile
  SITE (346)..(346): Xaa at position 346 is Leu, Ala, Val, Gly, or Ile
  SITE (347)..(347): Xaa at position 347 is Ala, Gly, or Pro
  SITE (355)..(355): Xaa at position 355 is Ile, Ala, Val, Leu, or Gly
  SITE (357)..(357): Xaa at position 357 is Leu, Ala, Val, Gly, or Ile
  SITE (375)..(375): Xaa at position 375 is Ala, Gly, or Pro
  SITE (388)..(388): Xaa at position 388 is Tyr, Phe, Met, His, Ile, Leu, Val Ala, or Gly
  SITE (389)..(389): Xaa at position 389 is Trp, Tyr, Phe, Met, His, Ile, Leu Val, Ala, or Gly
  SITE (396)..(396): Xaa at position 396 is Ala, Gly, or Pro
  SITE (397)..(397): Xaa at position 397 is Ile, Ala, Val, Leu, or Gly
  SITE (430)..(430): Xaa at position 430 is Leu, Ala, Val, Gly, or Ile
  SITE (431)..(431): Xaa at position 431 is Tyr, Phe, Met, His, Ile, Leu, Val Ala, or Gly
  SITE (432)..(432): Xaa at position 432 is Trp, Tyr, Phe, Met, His, Ile, Leu Val, Ala, or Gly
  SITE (440)..(440): Xaa at position 440 is Ile, Ala, Val, Leu, or Gly
  SITE (442)..(442): Xaa at position 442 is Val, Ala, Gly, Leu, or Ile
  SITE (473)..(473): Xaa at position 473 is Met, Ile, Leu, Val, Ala, or Gly
  SITE (474)..(474): Xaa at position 474 is Tyr, Phe, Met, His, Ile, Leu, Val Ala, or Gly
  SITE (475)..(475): Xaa at position 475 is Trp, Tyr, Phe, Met, His, Ile, Leu Val, Ala, or Gly
  SITE (484)..(484): Xaa at position 484 is Ile, Ala, Val, Leu, or Gly
  SITE (487)..(487): Xaa at position 487 is Ala, Gly, or Pro
  SITE (489)..(489): Xaa at position 489 is Leu, Ala, Val, Gly, or Ile
  SITE (517)..(517): Xaa at position 517 is Leu, Ala, Val, Gly, or Ile
  SITE (519)..(519): Xaa at position 519 is Trp, Tyr, Phe, Met, His, Ile, Leu Val, Ala, or Gly
  SITE (530)..(530): Xaa at position 530 is Ile, Ala, Val, Leu, or Gly
  SITE (545)..(545): Xaa at position 545 is Leu, Ala, Val, Gly, or Ile
  SITE (568)..(568): Xaa at position 568 is Ile, Ala, Val, Leu, or Gly
  SITE (588)..(588): Xaa at position 588 is Leu, Ala, Val, Gly, or Ile
  SITE (589)..(589): Xaa at position 589 is Met, Ile, Leu, Val, Ala, or Gly
  SITE (605)..(605): Xaa at position 605 is Cys, Ala, Val, Gly, Ser, or Thr
  SITE (615)..(615): Xaa at position 615 is Leu, Ala, Val, Gly, or Ile
  SITE (616)..(616): Xaa at position 616 is Cys, Ala, Val, Gly, Ser, or Thr
  SITE (617)..(617): Xaa at position 617 is Phe, Tyr, Met, His, Ile, Leu, Val Ala, or Gly
  SITE (627)..(627): Xaa at position 627 is Cys, Ala, Val, Gly, Ser, or Thr
  SITE (1274)..(1274): Xaa at position 1274 is Ile, Ala, Val, Leu, or Gly
  SITE (1323)..(1323): Xaa at position 1323 is Cys, Ala, Val, Gly, Ser, or Thr
MEAAPPGPPWPLLLLLLLLLALCGCPAPAAASPLXXXXNRRDXRLVDAGGVKLESTIVVSGXEDXAXXDFQFSKGAXXXTDXSEEXXKQTYLNQTGAAVQNVVISGLVSPDGXACDWVGKKXXXTDSETNRXEXANLNGTSRKVLFWQDLDQPRAIALDPAHGYXXXTDWGETPRXERXGXDGSTRKIIXDSDIYWPNGLTIDLEEQKLYWXDAKLSFXHRANLDGSFRQKVVEGSLTHPFXLTLSGDTXYXTDWQTRSXXACNKRTGGKRKEILSALYSPMDXQXLSQERQPFFHTRCEEDNGGCSHXCXXSPSEPFYTXAXPTGVQLQDNGRTCKAGAEEVXXXXRRTDLRRXSXDTPDFTDIVLQVDDIRHXIAIDYDPLEGYVXXTDDEVRXXRRAYLDGSGAQTLVNTEINDPDGIAVDWVARNXXXTDTGTDRXEXTRLNGTSRKILVSEDLDEPRAIALHPVMGLXXXTDWGENPKXECXNXDGQERRVLVNASLGWPNGLALDLQEGKXYXGDAKTDKIEVXNVDGTKRRTLLEDKXPHIFGFTLLGDFIYWTDWQRRSXERVHKVKASRDVIIDQLPDXXGLKAVNVAKVVGTNPXADRNGGCSHXXXFTPHATRCGXPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCXPGAWRCDGFPECDDQSDEEGCPVCSAAQFPCARGQCVDLRLRCDGEADXQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 61 - protein, 372 aa, Homo sapiens
  SITE (19)..(19): Xaa at position 19 is Ala, Gly, or Pro
  SITE (23)..(23): Xaa at position 23 is Phe, Tyr, Met, His, Ile, Leu, Val Ala, or Gly
  SITE (25)..(25): Xaa at position 25 is Val, Ala, Gly, Leu, or Ile
  SITE (28)..(28): Xaa at position 28 is Met, Ile, Leu, Val, Ala, or Gly
  SITE (32)..(32): Xaa at position 32 is Ile, Ala, Val, Leu, or Gly
  SITE (36)..(36): Xaa at position 36 is His, Phe, Tyr, Lys, Arg, Gly, Ser Thr, Ala, Val, Leu, Ile, Asn, Met, or Gln
  SITE (43)..(43): Xaa at position 43 is Val, Ala, Gly, Leu, or Ile
  SITE (45)..(45): Xaa at position 45 is Ala, Gly, or Pro
  SITE (47)..(47): Xaa at position 47 is Val, Ala, Gly, Leu, or Ile
  SITE (48)..(48): Xaa at position 48 is Tyr, Phe, Met, His, Ile, Leu, Val Ala, or Gly
  SITE (49)..(49): Xaa at position 49 is Met, Ile, Leu, Val, Ala, or Gly
  SITE (50)..(50): Xaa at position 50 is Ala, Gly, or Pro
  SITE (51)..(51): Xaa at position 51 is Ala, Gly, or Pro
  SITE (52)..(52): Xaa at position 52 is Val, Ala, Gly, Leu, or Ile
  SITE (53)..(53): Xaa at position 53 is Leu, Ala, Val, Gly, or Ile
  SITE (56)..(56): Xaa at position 56 is Leu, Ala, Val, Gly, or Ile
  SITE (60)..(60): Xaa at position 60 is Ile, Ala, Val, Leu, or Gly
  SITE (61)..(61): Xaa at position 61 is Leu, Ala, Val, Gly, or Ile
  SITE (64)..(64): Xaa at position 64 is Ala, Gly, or Pro
  SITE (67)..(67): Xaa at position 67 is Ala, Gly, or Pro
  SITE (68)..(68): Xaa at position 68 is Ala, Gly, or Pro
  SITE (76)..(76): Xaa at position 76 is Val, Ala, Gly, Leu, or Ile
  SITE (80)..(80): Xaa at position 80 is His, Phe, Tyr, Lys, Arg, Gly, Ser Thr, Ala, Val, Leu, Ile, Asn, Met, or Gln
  SITE (81)..(81): Xaa at position 81 is Ile, Ala, Val, Leu, or Gly
  SITE (83)..(83): Xaa at position 83 is Leu, Ala, Val, Gly, or Ile
  SITE (85)..(85): Xaa at position 85 is Val, Ala, Gly, Leu, or Ile
  SITE (91)..(91): Xaa at position 91 is Leu, Ala, Val, Gly, or Ile
  SITE (98)..(98): Xaa at position 98 is Val, Ala, Gly, Leu, or Ile
  SITE (101)..(101): Xaa at position 101 is Ala, Gly, or Pro
  SITE (197)..(197): Xaa at position 197 is Leu, Ala, Val, Gly, or Ile
  SITE (199)..(199): Xaa at position 199 is Leu, Ala, Val, Gly, or Ile
  SITE (200)..(200): Xaa at position 200 is Ile, Ala, Val, Leu, or Gly
  SITE (204)..(204): Xaa at position 204 is Ile, Ala, Val, Leu, or Gly
  SITE (207)..(207): Xaa at position 207 is Leu, Ala, Val, Gly, or Ile
  SITE (208)..(208): Xaa at position 208 is Ala, Gly, or Pro
  SITE (210)..(210): Xaa at position 210 is Phe, Tyr, Met, His, Ile, Leu, Val Ala, or Gly
  SITE (214)..(214): Xaa at position 214 is Ala, Gly, or Pro
  SITE (215)..(215): Xaa at position 215 is Ile, Ala, Val, Leu, or Gly
  SITE (216)..(216): Xaa at position 216 is Ile, Ala, Val, Leu, or Gly
  SITE (223)..(223): Xaa at position 223 is Ile, Ala, Val, Leu, or Gly
  SITE (233)..(233): Xaa at position 233 is Leu, Ala, Val, Gly, or Ile
  SITE (241)..(241): Xaa at position 241 is Phe, Tyr, Met, His, Ile, Leu, Val Ala, or Gly
  SITE (245)..(245): Xaa at position 245 is Val, Ala, Gly, Leu, or Ile
  SITE (255)..(255): Xaa at position 255 is Leu, Ala, Val, Gly, or Ile
  SITE (258)..(258): Xaa at position 258 is Ala, Gly, or Pro
  SITE (270)..(270): Xaa at position 270 is Ala, Gly, or Pro
  SITE (273)..(273): Xaa at position 273 is Val, Ala, Gly, Leu, or Ile
  SITE (274)..(274): Xaa at position 274 is Ile, Ala, Val, Leu, or Gly
  SITE (275)..(275): Xaa at position 275 is His, Phe, Tyr, Lys, Arg, Gly, Ser Thr, Ala, Val, Leu, Ile, Asn, Met, or Gln
  SITE (276)..(276): Xaa at position 276 is Cys, Ala, Val, Gly, Ser, or Thr
  SITE (290)..(290): Xaa at position 290 is Leu, Ala, Val, Gly, or Ile
  SITE (294)..(294): Xaa at position 294 is Val, Ala, Gly, Leu, or Ile
  SITE (297)..(297): Xaa at position 297 is Cys, Ala, Val, Gly, Ser, or Thr
  SITE (298)..(298): Xaa at position 298 is Leu, Ala, Val, Gly, or Ile
  SITE (301)..(301): Xaa at position 301 is Ala, Gly, or Pro
  SITE (309)..(309): Xaa at position 309 is Ile, Ala, Val, Leu, or Gly
  SITE (310)..(310): Xaa at position 310 is Ala, Gly, or Pro
  SITE (311)..(311): Xaa at position 311 is Phe, Tyr, Met, His, Ile, Leu, Val Ala, or Gly
  SITE (314)..(314): Xaa at position 314 is Ile, Ala, Val, Leu, or Gly
  SITE (326)..(326): Xaa at position 326 is Ala, Gly, or Pro
  SITE (327)..(327): Xaa at position 327 is Ala, Gly, or Pro
  SITE (330)..(330): Xaa at position 330 is Ile, Ala, Val, Leu, or Gly
  SITE (331)..(331): Xaa at position 331 is Leu, Ala, Val, Gly, or Ile
  SITE (333)..(333): Xaa at position 333 is Ala, Gly, or Pro
  SITE (334)..(334): Xaa at position 334 is Ile, Ala, Val, Leu, or Gly
  SITE (338)..(338): Xaa at position 338 is Phe, Tyr, Met, His, Ile, Leu, Val Ala, or Gly
  SITE (346)..(346): Xaa at position 346 is Ile, Ala, Val, Leu, or Gly
  SITE (349)..(349): Xaa at position 349 is Val, Ala, Gly, Leu, or Ile
  SITE (351)..(351): Xaa at position 351 is Phe, Tyr, Met, His, Ile, Leu, Val Ala, or Gly
  SITE (362)..(362): Xaa at position 362 is Tyr, Phe, Met, His, Ile, Leu, Val Ala, or Gly
  SITE (366)..(366): Xaa at position 366 is Met, Ile, Leu, Val, Ala, or Gly
MSSRGGKKKSTKTSRSAKXGVIXPXGRXLRYXKKGXPKYRIGXGXPXXXXXXXEYXTAEXXELXGNXXRDNKKGRXTPRXXLXAXANDEEXNQLLKGXTIXSGGVLPNIHPELLAKKRGSKGKLEAIITPPPAKKAKSPSQKKPVSKKAGGKKGARKSKKKQGEVSKAASADSTTEGTPADGFTVLSTKSLFLGQKXNXXHSEXSNXXGXEVEXXXNPTNADXDLKDDLGNTXEKKGGKEXVEAXLELRKKNGPXEVXGAAVSAGHGLPXKFXXXXNSPVWGADKCEELXEKTXKNXXALXDDKKLKSXXXPSXGSGRNGFPKQTXXQLXXKXXSSYXVSTMSSSXKTXYXVLFDSESIGIXVQEXAKLDAN

SEQ ID NO: 62 - protein, 2602 aa, Homo sapiens
  SITE (22)..(22): Xaa at position 22 is Phe, Tyr, Met, His, Ile, Leu, Val Ala, or Gly
  SITE (26)..(26): Xaa at position 26 is Cys, Ala, Val, Gly, Ser, or Thr
  SITE (30)..(30): Xaa at position 30 is Leu, Ala, Val, Gly, or Ile
  SITE (37)..(37): Xaa at position 37 is Ile, Ala, Val, Leu, or Gly
  SITE (40)..(40): Xaa at position 40 is Leu, Ala, Val, Gly, or Ile
  SITE (44)..(44): Xaa at position 44 is Leu, Ala, Val, Gly, or Ile
  SITE (50)..(50): Xaa at position 50 is Leu, Ala, Val, Gly, or Ile
  SITE (51)..(51): Xaa at position 51 is Ile, Ala, Val, Leu, or Gly
  SITE (53)..(53): Xaa at position 53 is Leu, Ala, Val, Gly, or Ile
  SITE (54)..(54): Xaa at position 54 is Leu, Ala, Val, Gly, or Ile
  SITE (80)..(80): Xaa at position 80 is Val, Ala, Gly, Leu, or Ile
  SITE (82)..(82): Xaa at position 82 is Val, Ala, Gly, Leu, or Ile
  SITE (83)..(83): Xaa at position 83 is Ala, Gly, or Pro
  SITE (84)..(84): Xaa at position 84 is Leu, Ala, Val, Gly, or Ile
  SITE (86)..(86): Xaa at position 86 is Phe, Tyr, Met, His, Ile, Leu, Val Ala, or Gly
  SITE (87)..(87): Xaa at position 87 is Leu, Ala, Val, Gly, or Ile
  SITE (92)..(92): Xaa at position 92 is Ile, Ala, Val, Leu, or Gly
  SITE (102)..(102): Xaa at position 102 is Ile, Ala, Val, Leu, or Gly
  SITE (110)..(110): Xaa at position 110 is Ile, Ala, Val, Leu, or Gly
  SITE (111)..(111): Xaa at position 111 is Leu, Ala, Val, Gly, or Ile
  SITE (113)..(113): Xaa at position 113 is Leu, Ala, Val, Gly, or Ile
  SITE (114)..(114): Xaa at position 114 is Val, Ala, Gly, Leu, or Ile
  SITE (117)..(117): Xaa at position 117 is Leu, Ala, Val, Gly, or Ile
  SITE (118)..(118): Xaa at position 118 is Ile, Ala, Val, Leu, or Gly
  SITE (123)..(123): Xaa at position 123 is Ile, Ala, Val, Leu, or Gly
  SITE (145)..(145): Xaa at position 145 is Leu, Ala, Val, Gly, or Ile
  SITE (148)..(148): Xaa at position 148 is Trp, Tyr, Phe, Met, His, Ile, Leu Val, Ala, or Gly
  SITE (149)..(149): Xaa at position 149 is Ile, Ala, Val, Leu, or Gly
  SITE (153)..(153): Xaa at position 153 is Ile, Ala, Val, Leu, or Gly
  SITE (161)..(161): Xaa at position 161 is Phe, Tyr, Met, His, Ile, Leu, Val Ala, or Gly
  SITE (165)..(165): Xaa at position 165 is Trp, Tyr, Phe, Met, His, Ile, Leu Val, Ala, or Gly
  SITE (170)..(170): Xaa at position 170 is Ala, Gly, or Pro
  SITE (171)..(171): Xaa at position 171 is Leu, Ala, Val, Gly, or Ile
  SITE (173)..(173): Xaa at position 173 is Ala, Gly, or Pro
  SITE (174)..(174): Xaa at position 174 is Leu, Ala, Val, Gly, or Ile
  SITE (175)..(175): Xaa at position 175 is Val, Ala, Gly, Leu, or Ile
  SITE (179)..(179): Xaa at position 179 is Ala, Gly, or Pro
  SITE (183)..(183): Xaa at position 183 is Cys, Ala, Val, Gly, Ser, or Thr
  SITE (198)..(198): Xaa at position 198 is Ala, Gly, or Pro
  SITE (201)..(201): Xaa at position 201 is Ala, Gly, or Pro
  SITE (202)..(202): Xaa at position 202 is Met, Ile, Leu, Val, Ala, or Gly
  SITE (205)..(205): Xaa at position 205 is Ala, Gly, or Pro
  SITE (209)..(209): Xaa at position 209 is Leu, Ala, Val, Gly, or Ile
  SITE (211)..(211): Xaa at position 211 is Val, Ala, Gly, Leu, or Ile
  SITE (214)..(214): Xaa at position 214 is Val, Ala, Gly, Leu, or Ile
  SITE (215)..(215): Xaa at position 215 is Ile, Ala, Val, Leu, or Gly
  SITE (220)..(220): Xaa at position 220 is Ile, Ala, Val, Leu, or Gly
  SITE (230)..(230): Xaa at position 230 is Val, Ala, Gly, Leu, or Ile
  SITE (231)..(231): Xaa at position 231 is Met, Ile, Leu, Val, Ala, or Gly
  SITE (233)..(233): Xaa at position 233 is Tyr, Phe, Met, His, Ile, Leu, Val Ala, or Gly
  SITE (234)..(234): Xaa at position 234 is Leu, Ala, Val, Gly, or Ile
  SITE (237)..(237): Xaa at position 237 is Phe, Tyr, Met, His, Ile, Leu, Val Ala, or Gly
  SITE (257)..(257): Xaa at position 257 is Ala, Gly, or Pro
  SITE (275)..(275): Xaa at position 275 is Ala, Gly, or Pro
  SITE (279)..(279): Xaa at position 279 is Val, Ala, Gly, Leu, or Ile
  SITE (284)..(284): Xaa at position 284 is Ala, Gly, or Pro
  SITE (291)..(291): Xaa at position 291 is Val, Ala, Gly, Leu, or Ile
  SITE (317)..(317): Xaa at position 317 is Val, Ala, Gly, Leu, or Ile
  SITE (327)..(327): Xaa at position 327 is His, Phe, Tyr, Lys, Arg, Gly, Ser Thr, Ala, Val, Leu, Ile, Asn, Met, or Gln
  SITE (329)..(329): Xaa at position 329 is Val, Ala, Gly, Leu, or Ile
  SITE (331)..(331): Xaa at position 331 is Val, Ala, Gly, Leu, or Ile
  SITE (333)..(333): Xaa at position 333 is Phe, Tyr, Met, His, Ile, Leu, Val Ala, or Gly
  SITE (338)..(338): Xaa at position 338 is Ile, Ala, Val, Leu, or Gly
  SITE (345)..(345): Xaa at position 345 is Val, Ala, Gly, Leu, or Ile
  SITE (1043)..(1043): Xaa at position 1043 is Val, Ala, Gly, Leu, or Ile
  SITE (1061)..(1061): Xaa at position 1061 is Phe, Tyr, Met, His, Ile, Leu Val, Ala, or Gly
  SITE (1063)..(1063): Xaa at position 1063 is Ile, Ala, Val, Leu, or Gly
  SITE (1068)..(1068): Xaa at position 1068 is Ala, Gly, or Pro
  SITE (1097)..(1097): Xaa at position 1097 is Val, Ala, Gly, Leu, or Ile
  SITE (1099)..(1099): Xaa at position 1099 is Tyr, Phe, Met, His, Ile, Leu Val, Ala, or Gly
  SITE (1107)..(1107): Xaa at position 1107 is Tyr, Phe, Met, His, Ile, Leu Val, Ala, or Gly
  SITE (1109)..(1109): Xaa at position 1109 is Val, Ala, Gly, Leu, or Ile
  SITE (1111)..(1111): Xaa at position 1111 is Ile, Ala, Val, Leu, or Gly
  SITE (1118)..(1118): Xaa at position 1118 is Ile, Ala, Val, Leu, or Gly
  SITE (1125)..(1125): Xaa at position 1125 is Ala, Gly, or Pro
  SITE (1127)..(1127): Xaa at position 1127 is Ile, Ala, Val, Leu, or Gly
  SITE (1136)..(1136): Xaa at position 1136 is Val, Ala, Gly, Leu, or Ile
  SITE (1138)..(1138): Xaa at position 1138 is Ala, Gly, or Pro
  SITE (1156)..(1156): Xaa at position 1156 is Val, Ala, Gly, Leu, or Ile
  SITE (1161)..(1161): Xaa at position 1161 is Ala, Gly, or Pro
  SITE (1170)..(1170): Xaa at position 1170 is Ala, Gly, or Pro
  SITE (1192)..(1192): Xaa at position 1192 is Val, Ala, Gly, Leu, or Ile
  SITE (1194)..(1194): Xaa at position 1194 is Tyr, Phe, Met, His, Ile, Leu Val, Ala, or Gly
  SITE (1202)..(1202): Xaa at position 1202 is Tyr, Phe, Met, His, Ile, Leu Val, Ala, or Gly
  SITE (1204)..(1204): Xaa at position 1204 is Leu, Ala, Val, Gly, or Ile
  SITE (1206)..(1206): Xaa at position 1206 is Met, Ile, Leu, Val, Ala, or Gly
  SITE (1208)..(1208): Xaa at position 1208 is Tyr, Phe, Met, His, Ile, Leu Val, Ala, or Gly
  SITE (1220)..(1220): Xaa at position 1220 is Val, Ala, Gly, Leu, or Ile
  SITE (1231)..(1231): Xaa at position 1231 is Ile, Ala, Val, Leu, or Gly
  SITE (1243)..(1243): Xaa at position 1243 is Val, Ala, Gly, Leu, or Ile
  SITE (1251)..(1251): Xaa at position 1251 is Phe, Tyr, Met, His, Ile, Leu Val, Ala, or Gly
  SITE (1253)..(1253): Xaa at position 1253 is Val, Ala, Gly, Leu, or Ile
  SITE (1270)..(1270): Xaa at position 1270 is Ile, Ala, Val, Leu, or Gly
  SITE (1290)..(1290): Xaa at position 1290 is Tyr, Phe, Met, His, Ile, Leu Val, Ala, or Gly
  SITE (1292)..(1292): Xaa at position 1292 is Val, Ala, Gly, Leu, or Ile
  SITE (1294)..(1294): Xaa at position 1294 is Tyr, Phe, Met, His, Ile, Leu Val, Ala, or Gly
  SITE (1302)..(1302): Xaa at position 1302 is His, Phe, Tyr, Lys, Arg, Gly Ser, Thr, Ala, Val, Leu, Ile, Asn, Met, or Gln
  SITE (1304)..(1304): Xaa at position 1304 is Val, Ala, Gly, Leu, or Ile
  SITE (1306)..(1306): Xaa at position 1306 is Val, Ala, Gly, Leu, or Ile
  SITE (1320)..(1320): Xaa at position 1320 is Val, Ala, Gly, Leu, or Ile
  SITE (1331)..(1331): Xaa at position 1331 is Val, Ala, Gly, Leu, or Ile
  SITE (1341)..(1341): Xaa at position 1341 is Ala, Gly, or Pro
  SITE (1349)..(1349): Xaa at position 1349 is Phe, Tyr, Met, His, Ile, Leu Val, Ala, or Gly
  SITE (1351)..(1351): Xaa at position 1351 is Val, Ala, Gly, Leu, or Ile
  SITE (1356)..(1356): Xaa at position 1356 is Ala, Gly, or Pro
  SITE (1385)..(1385): Xaa at position 1385 is Ala, Gly, or Pro
  SITE (1387)..(1387): Xaa at position 1387 is Tyr, Phe, Met, His, Ile, Leu Val, Ala, or Gly
  SITE (1395)..(1395): Xaa at position 1395 is Tyr, Phe, Met, His, Ile, Leu Val, Ala, or Gly
  SITE (1397)..(1397): Xaa at position 1397 is Val, Ala, Gly, Leu, or Ile
  SITE (1399)..(1399): Xaa at position 1399 is Ile, Ala, Val, Leu, or Gly
  SITE (1406)..(1406): Xaa at position 1406 is Ile, Ala, Val, Leu, or Gly
  SITE (1413)..(1413): Xaa at position 1413 is Val, Ala, Gly, Leu, or Ile
  SITE (1424)..(1424): Xaa at position 1424 is Val, Ala, Gly, Leu, or Ile
  SITE (1435)..(1435): Xaa at position 1435 is Val, Ala, Gly, Leu, or Ile
  SITE (1445)..(1445): Xaa at position 1445 is Val, Ala, Gly, Leu, or Ile
  SITE (1450)..(1450): Xaa at position 1450 is Ala, Gly, or Pro
  SITE (1459)..(1459): Xaa at position 1459 is Val, Ala, Gly, Leu, or Ile
  SITE (1481)..(1481): Xaa at position 1481 is Val, Ala, Gly, Leu, or Ile
  SITE (1493)..(1493): Xaa at position 1493 is Val, Ala, Gly, Leu, or Ile
  SITE (1495)..(1495): Xaa at position 1495 is Val, Ala, Gly, Leu, or Ile
  SITE (1497)..(1497): Xaa at position 1497 is Tyr, Phe, Met, His, Ile, Leu Val, Ala, or Gly
  SITE (1502)..(1502): Xaa at position 1502 is Ile, Ala, Val, Leu, or Gly
  SITE (1509)..(1509): Xaa at position 1509 is Val, Ala, Gly, Leu, or Ile
  SITE (1511)..(1511): Xaa at position 1511 is Val, Ala, Gly, Leu, or Ile
  SITE (1520)..(1520): Xaa at position 1520 is Val, Ala, Gly, Leu, or Ile
  SITE (1532)..(1532): Xaa at position 1532 is Val, Ala, Gly, Leu, or Ile
  SITE (1534)..(1534): Xaa at position 1534 is Ala, Gly, or Pro
  SITE (1540)..(1540): Xaa at position 1540 is Phe, Tyr, Met, His, Ile, Leu Val, Ala, or Gly
  SITE (1542)..(1542): Xaa at position 1542 is Ile, Ala, Val, Leu, or Gly
  SITE (1544)..(1544): Xaa at position 1544 is Ala, Gly, or Pro
  SITE (1547)..(1547): Xaa at position 1547 is Ala, Gly, or Pro
  SITE (1556)..(1556): Xaa at position 1556 is Ile, Ala, Val, Leu, or Gly
  SITE (1578)..(1578): Xaa at position 1578 is Val, Ala, Gly, Leu, or Ile
  SITE (1580)..(1580): Xaa at position 1580 is Tyr, Phe, Met, His, Ile, Leu Val, Ala, or Gly
  SITE (1588)..(1588): Xaa at position 1588 is Tyr, Phe, Met, His, Ile, Leu Val, Ala, or Gly
  SITE (1590)..(1590): Xaa at position 1590 is Ile, Ala, Val, Leu, or Gly
  SITE (1592)..(1592): Xaa at position 1592 is Val, Ala, Gly, Leu, or Ile
  SITE (1594)..(1594): Xaa at position 1594 is Tyr, Phe, Met, His, Ile, Leu Val, Ala, or Gly
  SITE (1599)..(1599): Xaa at position 1599 is Ile, Ala, Val, Leu, or Gly
  SITE (1606)..(1606): Xaa at position 1606 is Ile, Ala, Val, Leu, or Gly
  SITE (1608)..(1608): Xaa at position 1608 is Ala, Gly, or Pro
  SITE (1614)..(1614): Xaa at position 1614 is Ala, Gly, or Pro
  SITE (1617)..(1617): Xaa at position 1617 is Cys, Ala, Val, Gly, Ser, or Thr
  SITE (1636)..(1636): Xaa at position 1636 is Phe, Tyr, Met, His, Ile, Leu Val, Ala, or Gly
  SITE (1638)..(1638): Xaa at position 1638 is Val, Ala, Gly, Leu, or Ile
  SITE (1643)..(1643): Xaa at position 1643 is Ala, Gly, or Pro
  SITE (1648)..(1648): Xaa at position 1648 is Val, Ala, Gly, Leu, or Ile
  SITE (1652)..(1652): Xaa at position 1652 is Val, Ala, Gly, Leu, or Ile
  SITE (1674)..(1674): Xaa at position 1674 is Ile, Ala, Val, Leu, or Gly
  SITE (1678)..(1678): Xaa at position 1678 is Ala, Gly, or Pro
  SITE (1684)..(1684): Xaa at position 1684 is Tyr, Phe, Met, His, Ile, Leu Val, Ala, or Gly
  SITE (1686)..(1686): Xaa at position 1686 is Ile, Ala, Val, Leu, or Gly
  SITE (1688)..(1688): Xaa at position 1688 is Val, Ala, Gly, Leu, or Ile
  SITE (1695)..(1695): Xaa at position 1695 is Ile, Ala, Val, Leu, or Gly
  SITE (1702)..(1702): Xaa at position 1702 is Val, Ala, Gly, Leu, or Ile
  SITE (1704)..(1704): Xaa at position 1704 is Ala, Gly, or Pro
  SITE (1755)..(1755): Xaa at position 1755 is Val, Ala, Gly, Leu, or Ile
  SITE (1764)..(1764): Xaa at position 1764 is Val, Ala, Gly, Leu, or Ile
  SITE (1784)..(1784): Xaa at position 1784 is Val, Ala, Gly, Leu, or Ile
  SITE (1786)..(1786): Xaa at position 1786 is Val, Ala, Gly, Leu, or Ile
  SITE (1796)..(1796): Xaa at position 1796 is His, Phe, Tyr, Lys, Arg, Gly Ser, Thr, Ala, Val, Leu, Ile, Asn, Met, or Gln
  SITE (1798)..(1798): Xaa at position 1798 is Met, Ile, Leu, Val, Ala, or Gly
  SITE (1800)..(1800): Xaa at position 1800 is Ile, Ala, Val, Leu, or Gly
  SITE (1807)..(1807): Xaa at position 1807 is Ile, Ala, Val, Leu, or Gly
  SITE (1824)..(1824): Xaa at position 1824 is Val, Ala, Gly, Leu, or Ile
  SITE (1842)..(1842): Xaa at position 1842 is Phe, Tyr, Met, His, Ile, Leu Val, Ala, or Gly
  SITE (1844)..(1844): Xaa at position 1844 is Ile, Ala, Val, Leu, or Gly
  SITE (1878)..(1878): Xaa at position 1878 is Val, Ala, Gly, Leu, or Ile
  SITE (1880)..(1880): Xaa at position 1880 is Tyr, Phe, Met, His, Ile, Leu Val, Ala, or Gly
  SITE (1888)..(1888): Xaa at position 1888 is Tyr, Phe, Met, His, Ile, Leu Val, Ala, or Gly
  SITE (1890)..(1890): Xaa at position 1890 is Ile, Ala, Val, Leu, or Gly
  SITE (1892)..(1892): Xaa at position 1892 is Val, Ala, Gly, Leu, or Ile
  SITE (1906)..(1906): Xaa at position 1906 is Ala, Gly, or Pro
  SITE (1908)..(1908): Xaa at position 1908 is Ile, Ala, Val, Leu, or Gly
  SITE (1964)..(1964): Xaa at position 1964 is Ile, Ala, Val, Leu, or Gly
  SITE (1966)..(1966): Xaa at position 1966 is Phe, Tyr, Met, His, Ile, Leu Val, Ala, or Gly
  SITE (1974)..(1974): Xaa at position 1974 is His, Phe, Tyr, Lys, Arg, Gly Ser, Thr, Ala, Val, Leu, Ile, Asn, Met, or Gln
  SITE (1976)..(1976): Xaa at position 1976 is Val, Ala, Gly, Leu, or Ile
  SITE (1978)..(1978): Xaa at position 1978 is Ile, Ala, Val, Leu, or Gly
  SITE (1994)..(1994): Xaa at position 1994 is Val, Ala, Gly, Leu, or Ile
  SITE (2002)..(2002): Xaa at position 2002 is Ala, Gly, or Pro
  SITE (2005)..(2005): Xaa at position 2005 is Ala, Gly, or Pro
  SITE (2023)..(2023): Xaa at position 2023 is Phe, Tyr, Met, His, Ile, Leu Val, Ala, or Gly
  SITE (2025)..(2025): Xaa at position 2025 is Val, Ala, Gly, Leu, or Ile
  SITE (2059)..(2059): Xaa at position 2059 is Val, Ala, Gly, Leu, or Ile
  SITE (2061)..(2061): Xaa at position 2061 is Tyr, Phe, Met, His, Ile, Leu Val, Ala, or Gly
  SITE (2069)..(2069): Xaa at position 2069 is Tyr, Phe, Met, His, Ile, Leu Val, Ala, or Gly
  SITE (2071)..(2071): Xaa at position 2071 is Val, Ala, Gly, Leu, or Ile
  SITE (2075)..(2075): Xaa at position 2075 is Phe, Tyr, Met, His, Ile, Leu Val, Ala, or Gly
  SITE (2087)..(2087): Xaa at position 2087 is Val, Ala, Gly, Leu, or Ile
  SITE (2089)..(2089): Xaa at position 2089 is Ile, Ala, Val, Leu, or Gly
  SITE (2133)..(2133): Xaa at position 2133 is Val, Ala, Gly, Leu, or Ile
  SITE (2153)..(2153): Xaa at position 2153 is His, Phe, Tyr, Lys, Arg, Gly Ser, Thr, Ala, Val, Leu, Ile, Asn, Met, or Gln
  SITE (2155)..(2155): Xaa at position 2155 is Val, Ala, Gly, Leu, or Ile
  SITE (2165)..(2165): Xaa at position 2165 is His, Phe, Tyr, Lys, Arg, Gly Ser, Thr, Ala, Val, Leu, Ile, Asn, Met, or Gln
  SITE (2167)..(2167): Xaa at position 2167 is Val, Ala, Gly, Leu, or Ile
  SITE (2169)..(2169): Xaa at position 2169 is Val, Ala, Gly, Leu, or Ile
  SITE (2185)..(2185): Xaa at position 2185 is Val, Ala, Gly, Leu, or Ile
  SITE (2196)..(2196): Xaa at position 2196 is Val, Ala, Gly, Leu, or Ile
  SITE (2214)..(2214): Xaa at position 2214 is Phe, Tyr, Met, His, Ile, Leu Val, Ala, or Gly
  SITE (2216)..(2216): Xaa at position 2216 is Ile, Ala, Val, Leu, or Gly
  SITE (2250)..(2250): Xaa at position 2250 is Val, Ala, Gly, Leu, or Ile
  SITE (2252)..(2252): Xaa at position 2252 is Tyr, Phe, Met, His, Ile, Leu Val, Ala, or Gly
  SITE (2254)..(2254): Xaa at position 2254 is Ala, Gly, or Pro
  SITE (2260)..(2260): Xaa at position 2260 is Tyr, Phe, Met, His, Ile, Leu Val, Ala, or Gly
  SITE (2262)..(2262): Xaa at position 2262 is Val, Ala, Gly, Leu, or Ile
  SITE (2264)..(2264): Xaa at position 2264 is Ile, Ala, Val, Leu, or Gly
  SITE (2271)..(2271): Xaa at position 2271 is Ile, Ala, Val, Leu, or Gly
  SITE (2278)..(2278): Xaa at position 2278 is Val, Ala, Gly, Leu, or Ile
  SITE (2280)..(2280): Xaa at position 2280 is Val, Ala, Gly, Leu, or Ile
  SITE (2281)..(2281): Xaa at position 2281 is Ile, Ala, Val, Leu, or Gly
  SITE (2287)..(2287): Xaa at position 2287 is Ala, Gly, or Pro
  SITE (2290)..(2290): Xaa at position 2290 is Leu, Ala, Val, Gly, or Ile
  SITE (2300)..(2300): Xaa at position 2300 is Leu, Ala, Val, Gly, or Ile
  SITE (2310)..(2310): Xaa at position 2310 is Ile, Ala, Val, Leu, or Gly
  SITE (2312)..(2312): Xaa at position 2312 is Leu, Ala, Val, Gly, or Ile
  SITE (2315)..(2315): Xaa at position 2315 is Ala, Gly, or Pro
  SITE (2319)..(2319): Xaa at position 2319 is Ile, Ala, Val, Leu, or Gly
  SITE (2323)..(2323): Xaa at position 2323 is Val, Ala, Gly, Leu, or Ile
  SITE (2345)..(2345): Xaa at position 2345 is Val, Ala, Gly, Leu, or Ile
  SITE (2355)..(2355): Xaa at position 2355 is His, Phe, Tyr, Lys, Arg, Gly Ser, Thr, Ala, Val, Leu, Ile, Asn, Met, or Gln
  SITE (2357)..(2357): Xaa at position 2357 is Ile, Ala, Val, Leu, or Gly
  SITE (2359)..(2359): Xaa at position 2359 is Val, Ala, Gly, Leu, or Ile
  SITE (2361)..(2361): Xaa at position 2361 is Phe, Tyr, Met, His, Ile, Leu Val, Ala, or Gly
  SITE (2373)..(2373): Xaa at position 2373 is Val, Ala, Gly, Leu, or Ile
  SITE (2387)..(2387): Xaa at position 2387 is Val, Ala, Gly, Leu, or Ile
  SITE (2394)..(2394): Xaa at position 2394 is Leu, Ala, Val, Gly, or Ile
  SITE (2405)..(2405): Xaa at position 2405 is Phe, Tyr, Met, His, Ile, Leu Val, Ala, or Gly
  SITE (2407)..(2407): Xaa at position 2407 is Ile, Ala, Val, Leu, or Gly
  SITE (2412)..(2412): Xaa at position 2412 is Ala, Gly, or Pro
  SITE (2440)..(2440): Xaa at position 2440 is Val, Ala, Gly, Leu, or Ile
  SITE (2442)..(2442): Xaa at position 2442 is Tyr, Phe, Met, His, Ile, Leu Val, Ala, or Gly
  SITE (2450)..(2450): Xaa at position 2450 is Tyr, Phe, Met, His, Ile, Leu Val, Ala, or Gly
  SITE (2452)..(2452): Xaa at position 2452 is Ile, Ala, Val, Leu, or Gly
  SITE (2454)..(2454): Xaa at position 2454 is Val, Ala, Gly, Leu, or Ile
  SITE (2456)..(2456): Xaa at position 2456 is Tyr, Phe, Met, His, Ile, Leu Val, Ala, or Gly
  SITE (2462)..(2462): Xaa at position 2462 is Ile, Ala, Val, Leu, or Gly
  SITE (2469)..(2469): Xaa at position 2469 is Ala, Gly, or Pro
  SITE (2512)..(2512): Xaa at position 2512 is Ala, Gly, or Pro
  SITE (2515)..(2515): Xaa at position 2515 is Val, Ala, Gly, Leu, or Ile
  SITE (2525)..(2525): Xaa at position 2525 is Ala, Gly, or Pro
  SITE (2535)..(2535): Xaa at position 2535 is Val, Ala, Gly, Leu, or Ile
  SITE (2537)..(2537): Xaa at position 2537 is Cys, Ala, Val, Gly, Ser, or Thr
  SITE (2571)..(2571): Xaa at position 2571 is Val, Ala, Gly, Leu, or Ile
  SITE (2575)..(2575): Xaa at position 2575 is Val, Ala, Gly, Leu, or Ile
  SITE (2585)..(2585): Xaa at position 2585 is Val, Ala, Gly, Leu, or Ile
  SITE (2587)..(2587): Xaa at position 2587 is Trp, Tyr, Phe, Met, His, Ile Leu, Val, Ala, or Gly
  SITE (2592)..(2592): Xaa at position 2592 is Ile, Ala, Val, Leu, or Gly
  SITE (2599)..(2599): Xaa at position 2599 is Val, Ala, Gly, Leu, or Ile
MPVTEKDLAEDAPWKKIQQNTXTRWXNEHXKCVNKRXGNXQTDXSDGLRXXAXXEVLSQKRMYRKYHQRPTFRQMQLENXSXXXEXXDRESXKLVSIDSKAXVDGNLKLXXGXXWTXXLHYSXSMPVWEDEGDDDAKKQTPKQRXLGXXQNKXPYLPITNXNQNXQDGKXXGXXXDSCXPGLXPDWESWDPQKPVDNXREXXQQXDDWXGXPQXXTPEEXIHPDVDEHSXXTXXSQXPKAKLKPGAPLKPKLNPKKXRAYGRGIEPTGNMVKQPXKFTXDTISXGQGDVMXFVEDPEGNKEEAQVTPDSDKNKTYSXEYLPKVTGLXKXTXLXAGQHXSKSPFEXSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKXKAHGPGLEGGLVGKPAEXTXDTKGXGTGGLGLTVEGPCEAKIECSDNGDGTCSXSXLPTKPGEXFXNXLFEEVHXPGSPFKXDXEMPFDPSKXVXSGPGLEHGKVGEAGLLSXDCSEXGPGALGLEXVSDSGTKAEVSIQNNKDGTYAXTXVPLTAGMXTXTXKXGGELVPHFPARXKVEPAVDTSRXKVFGPGIEGKDXFREATTDXTXDSRPLTQVGGDHIKAHXANPSGASTECFVTDNADGTXQXEXTPFEKGLXVXEXTYDDVPIPNSPFKXAVTEGCQPSRXQAQGPGLKEXFTNKPNVXTXVTRGXGIGGLGITVEGPSESKINCRDNKDGSCSXEXIPFAPGDXDXNXTYGGAHXPGSPFRXPVKDVVDPSKXKIAGPGLGSGXRARVLQSFTXDSSKXGLAPLEVRXLGPRGLVEPVNVVDNGDGTHTXTYTPSQEGPYMXSXKXADEEXPRSPFKXKXLPTYDASKXTASGPGLSSYGXPXSLPVDXAXDXRDXGEGLLAVQXTDQEGKPKRAIVHDNKDGTYAXTXIPDKTGRXMXGXTXGGDDXPLSPYRXRXTQTGDXSKXLATGPGIASTVKTGEEVGXVXDAKTXGKGKXTCTXLTPDGTEAEADVIENEDGTYDXFYTXAKPGTXVXYXRFGGVDXPNSPFTXMXTDGEVTAVEEAPVNACPPGFRPWVTEEAYVPVSDMNGLGFKPFDLVIPFAXRKGEITGEXHMPSGKTATPEIVDNKDGTXTXRYAPTEVGLXEXHXKYMGSHXPESPLQFYVNYPNSGSXSAYGPGLVYGVANKTATXTXVTEDAGEGGLDLAIEGPSKAEISCIDNKDGTCTXTXLPTLPGDXSXLXKYNDKHIPGSPFTXKXTDDSRRCSQVKLGSAADFLLDISETDLSSLTASIKAPSGRDEPCLLKRLPNNHIGXSXIPREVGEXLXSXKKNGNHVANSPVSIMXVQSEIGDXRRXKVYGRGLSEGRTFEMSDXIXDTRDAGYGGISLAVEGPSKVDIQTEDLEDGTCKXSXFPTVPGVXIXSTKXADEHVPGSPFTXKXSGEGRVKESITRTSRAPSVATVGSICDLNLKIPEINSSDMSAHXTSPSGRVTEAEIVPMGKNSXCXRFVPQEMGVXTXSXKYRGQHVTGSPFQFTXGPLGEGGAHKXRAGGPGLERGEAGVPAEXSXWTREAGAGGLSIAVEGPSKAEITFDDHKNGSCGXSXIXQEPGNXEXSXKFNDEHXPESPYLXPXXAPSDDXRRXTVMSLQESGXKVNQPASFAXRXNGXKGKXDAKXHSPSGAVEECHVSELEPDKYAXRFIPHENGVXTXDXKXNGSHVVGSPFKXRVGEPGQAGNPALXSAYGTGXEGGTTGIQSEXFXNTTRXGPGTLSVTIEGPSKVKMDCQETPEGYKXMXTPMAPGNXLXSXKXGGPNHXVGSPFKXKVTGQRLVSPGSANETSSILVESVTRSSTETCYSAIPKASSDXSKXTSKGAGLSKXFVGQKSSFLXDXSKAGSNMLLIGVHGPTTPCEEVSMKHVGNQQYNXTYVXKERGDYVLAXKXGEEHXPGSPFHXTVP

SEQ ID NO: 63 - protein, 327 aa, Homo sapiens
  SITE (42)..(42): Xaa at position 42 is Phe, Tyr, Met, His, Ile, Leu, Val Ala, or Gly
  SITE (48)..(48): Xaa at position 48 is Val, Ala, Gly, Leu, or Ile
  SITE (52)..(52): Xaa at position 52 is Val, Ala, Gly, Leu, or Ile
  SITE (65)..(65): Xaa at position 65 is His, Phe, Tyr, Lys, Arg, Gly, Ser Thr, Ala, Val, Leu, Ile, Asn, Met, or Gln
  SITE (68)..(68): Xaa at position 68 is Ile, Ala, Val, Leu, or Gly
  SITE (70)..(70): Xaa at position 70 is Ile, Ala, Val, Leu, or Gly
  SITE (72)..(72): Xaa at position 72 is Phe, Tyr, Met, His, Ile, Leu, Val Ala, or Gly
  SITE (73)..(73): Xaa at position 73 is Val, Ala, Gly, Leu, or Ile
  SITE (76)..(76): Xaa at position 76 is Ile, Ala, Val, Leu, or Gly
  SITE (101)..(101): Xaa at position 101 is Leu, Ala, Val, Gly, or Ile
  SITE (111)..(111): Xaa at position 111 is Phe, Tyr, Met, His, Ile, Leu, Val Ala, or Gly
  SITE (114)..(114): Xaa at position 114 is Val, Ala, Gly, Leu, or Ile
  SITE (126)..(126): Xaa at position 126 is Val, Ala, Gly, Leu, or Ile
  SITE (128)..(128): Xaa at position 128 is Leu, Ala, Val, Gly, or Ile
  SITE (130)..(130): Xaa at position 130 is Tyr, Phe, Met, His, Ile, Leu, Val Ala, or Gly
  SITE (131)..(131): Xaa at position 131 is Phe, Tyr, Met, His, Ile, Leu, Val Ala, or Gly
  SITE (132)..(132): Xaa at position 132 is Leu, Ala, Val, Gly, or Ile
  SITE (134)..(134): Xaa at position 134 is Val, Ala, Gly, Leu, or Ile
  SITE (151)..(151): Xaa at position 151 is Val, Ala, Gly, Leu, or Ile
  SITE (166)..(166): Xaa at position 166 is Met, Ile, Leu, Val, Ala, or Gly
  SITE (174)..(174): Xaa at position 174 is Leu, Ala, Val, Gly, or Ile
  SITE (176)..(176): Xaa at position 176 is Ile, Ala, Val, Leu, or Gly
  SITE (178)..(178): Xaa at position 178 is Phe, Tyr, Met, His, Ile, Leu, Val Ala, or Gly
  SITE (180)..(180): Xaa at position 180 is Tyr, Phe, Met, His, Ile, Leu, Val Ala, or Gly
  SITE (185)..(185): Xaa at position 185 is Tyr, Phe, Met, His, Ile, Leu, Val Ala, or Gly
  SITE (191)..(191): Xaa at position 191 is Ile, Ala, Val, Leu, or Gly
  SITE (195)..(195): Xaa at position 195 is Ile, Ala, Val, Leu, or Gly
  SITE (207)..(207): Xaa at position 207 is Met, Ile, Leu, Val, Ala, or Gly
  SITE (209)..(209): Xaa at position 209 is Leu, Ala, Val, Gly, or Ile
  SITE (211)..(211): Xaa at position 211 is Leu, Ala, Val, Gly, or Ile
  SITE (231)..(231): Xaa at position 231 is Ala, Gly, or Pro
  SITE (246)..(246): Xaa at position 246 is Ile, Ala, Val, Leu, or Gly
  SITE (248)..(248): Xaa at position 248 is Ile, Ala, Val, Leu, or Gly
  SITE (250)..(250): Xaa at position 250 is Leu, Ala, Val, Gly, or Ile
  SITE (252)..(252): Xaa at position 252 is Leu, Ala, Val, Gly, or Ile
  SITE (268)..(268): Xaa at position 268 is Phe, Tyr, Met, His, Ile, Leu, Val Ala, or Gly
  SITE (270)..(270): Xaa at position 270 is Val, Ala, Gly, Leu, or Ile
  SITE (272)..(272): Xaa at position 272 is Tyr, Phe, Met, His, Ile, Leu, Val Ala, or Gly
  SITE (274)..(274): Xaa at position 274 is Leu, Ala, Val, Gly, or Ile
  SITE (276)..(276): Xaa at position 276 is Leu, Ala, Val, Gly, or Ile
  SITE (278)..(278): Xaa at position 278 is Leu, Ala, Val, Gly, or Ile
  SITE (292)..(292): Xaa at position 292 is Ile, Ala, Val, Leu, or Gly
MSFLGGFFGPICEIDIVLNDGETRKMAEMKTEDGKVEKHYLXYDGESXSGKXNLAFKQPGKRLEXQGXRXEXXGQXELFNDKSNTHEFVNLVKELALPGEXTQSRSYDFEXMQXEKPYESYIGANXRXRXXXKXTIVRRLTDLVKEYDLIXHQLATYPDVNNSIKXEVGIEDCXHXEXEXNKSKXHLKDVXVGKXYFLLVRIKIQHXEXQXIKKEITGIGPSTTTETETIXKYEIMDGAPVKGESXPXRXFXAGYDPTPTMRDVNKKXSXRXFXNXVXVDEEDRRYFKQQEXILWRKAPEKLRKQRTNFHQRFESPESQASAEQPEM

SEQ ID NO: 64 - protein, 1613 aa, Homo sapiens
  SITE (23)..(23): Xaa at position 23 is Leu, Ala, Val, Gly, or Ile
  SITE (24)..(24): Xaa at position 24 is Leu, Ala, Val, Gly, or Ile
  SITE (25)..(25): Xaa at position 25 is Tyr, Phe, Met, His, Ile, Leu, Val Ala, or Gly
  SITE (26)..(26): Xaa at position 26 is Ala, Gly, or Pro
  SITE (31)..(31): Xaa at position 31 is Leu, Ala, Val, Gly, or Ile
  SITE (34)..(34): Xaa at position 34 is Val, Ala, Gly, Leu, or Ile
  SITE (47)..(47): Xaa at position 47 is Val, Ala, Gly, Leu, or Ile
  SITE (50)..(50): Xaa at position 50 is Leu, Ala, Val, Gly, or Ile
  SITE (53)..(53): Xaa at position 53 is Ala, Gly, or Pro
  SITE (55)..(55): Xaa at position 55 is Ala, Gly, or Pro
  SITE (56)..(56): Xaa at position 56 is Val, Ala, Gly, Leu, or Ile
  SITE (58)..(58): Xaa at position 58 is Phe, Tyr, Met, His, Ile, Leu, Val Ala, or Gly
  SITE (59)..(59): Xaa at position 59 is Val, Ala, Gly, Leu, or Ile
  SITE (65)..(65): Xaa at position 65 is Ile, Ala, Val, Leu, or Gly
  SITE (66)..(66): Xaa at position 66 is Tyr, Phe, Met, His, Ile, Leu, Val Ala, or Gly
  SITE (67)..(67): Xaa at position 67 is Trp, Tyr, Phe, Met, His, Ile, Leu Val, Ala, or Gly
  SITE (70)..(70): Xaa at position 70 is Val, Ala, Gly, Leu, or Ile
  SITE (74)..(74): Xaa at position 74 is Ala, Gly, or Pro
  SITE (75)..(75): Xaa at position 75 is Ile, Ala, Val, Leu, or Gly
  SITE (90)..(90): Xaa at position 90 is Val, Ala, Gly, Leu, or Ile
  SITE (91)..(91): Xaa at position 91 is Val, Ala, Gly, Leu, or Ile
  SITE (94)..(94): Xaa at position 94 is Leu, Ala, Val, Gly, or Ile
  SITE (100)..(100): Xaa at position 100 is Leu, Ala, Val, Gly, or Ile
  SITE (102)..(102): Xaa at position 102 is Cys, Ala, Val, Gly, Ser, or Thr
  SITE (109)..(109): Xaa at position 109 is Leu, Ala, Val, Gly, or Ile
  SITE (110)..(110): Xaa at position 110 is Tyr, Phe, Met, His, Ile, Leu, Val Ala, or Gly
  SITE (111)..(111): Xaa at position 111 is Trp, Tyr, Phe, Met, His, Ile, Leu Val, Ala, or Gly
  SITE (119)..(119): Xaa at position 119 is Ile, Ala, Val, Leu, or Gly
  SITE (121)..(121): Xaa at position 121 is Val, Ala, Gly, Leu, or Ile
  SITE (128)..(128): Xaa at position 128 is Leu, Ala, Val, Gly, or Ile
  SITE (152)..(152): Xaa at position 152 is Met, Ile, Leu, Val, Ala, or Gly
  SITE (153)..(153): Xaa at position 153 is Tyr, Phe, Met, His, Ile, Leu, Val Ala, or Gly
  SITE (154)..(154): Xaa at position 154 is Trp, Tyr, Phe, Met, His, Ile, Leu Val, Ala, or Gly
  SITE (163)..(163): Xaa at position 163 is Ile, Ala, Val, Leu, or Gly
  SITE (166)..(166): Xaa at position 166 is Ala, Gly, or Pro
  SITE (168)..(168): Xaa at position 168 is Met, Ile, Leu, Val, Ala, or Gly
  SITE (177)..(177): Xaa at position 177 is Ile, Ala, Val, Leu, or Gly
  SITE (189)..(189): Xaa at position 189 is Leu, Ala, Val, Gly, or Ile
  SITE (196)..(196): Xaa at position 196 is Leu, Ala, Val, Gly, or Ile
  SITE (197)..(197): Xaa at position 197 is Tyr, Phe, Met, His, Ile, Leu, Val Ala, or Gly
  SITE (198)..(198): Xaa at position 198 is Trp, Tyr, Phe, Met, His, Ile, Leu Val, Ala, or Gly
  SITE (199)..(199): Xaa at position 199 is Ala, Gly, or Pro
  SITE (206)..(206): Xaa at position 206 is Ile, Ala, Val, Leu, or Gly
  SITE (218)..(218): Xaa at position 218 is Ala, Gly, or Pro
  SITE (219)..(219): Xaa at position 219 is Val, Ala, Gly, Leu, or Ile
  SITE (224)..(224): Xaa at position 224 is Leu, Ala, Val, Gly, or Ile
  SITE (229)..(229): Xaa at position 229 is Ala, Gly, or Pro
  SITE (232)..(232): Xaa at position 232 is Leu, Ala, Val, Gly, or Ile
  SITE (237)..(237): Xaa at position 237 is Leu, Ala, Val, Gly, or Ile
  SITE (238)..(238): Xaa at position 238 is Tyr, Phe, Met, His, Ile, Leu, Val Ala, or Gly
  SITE (239)..(239): Xaa at position 239 is Trp, Tyr, Phe, Met, His, Ile, Leu Val, Ala, or Gly
  SITE (247)..(247): Xaa at position 247 is Ile, Ala, Val, Leu, or Gly
  SITE (248)..(248): Xaa at position 248 is Leu, Ala, Val, Gly, or Ile
  SITE (249)..(249): Xaa at position 249 is Ala, Gly, or Pro
  SITE (250)..(250): Xaa at position 250 is Cys, Ala, Val, Gly, Ser, or Thr
  SITE (271)..(271): Xaa at position 271 is Ile, Ala, Val, Leu, or Gly
  SITE (273)..(273): Xaa at position 273 is Ala, Gly, or Pro
  SITE (296)..(296): Xaa at position 296 is Leu, Ala, Val, Gly, or Ile
  SITE (297)..(297): Xaa at position 297 is Cys, Ala, Val, Gly, Ser, or Thr
  SITE (298)..(298): Xaa at position 298 is Leu, Ala, Val, Gly, or Ile
  SITE (299)..(299): Xaa at position 299 is Met, Ile, Leu, Val, Ala, or Gly
  SITE (308)..(308): Xaa at position 308 is Cys, Ala, Val, Gly, Ser, or Thr
  SITE (310)..(310): Xaa at position 310 is Cys, Ala, Val, Gly, Ser, or Thr
  SITE (317)..(317): Xaa at position 317 is Leu, Ala, Val, Gly, or Ile
  SITE (331)..(331): Xaa at position 331 is Leu, Ala, Val, Gly, or Ile
  SITE (332)..(332): Xaa at position 332 is Leu, Ala, Val, Gly, or Ile
  SITE (333)..(333): Xaa at position 333 is Leu, Ala, Val, Gly, or Ile
  SITE (334)..(334): Xaa at position 334 is Ala, Gly, or Pro
  SITE (339)..(339): Xaa at position 339 is Leu, Ala, Val, Gly, or Ile
  SITE (342)..(342): Xaa at position 342 is Ile, Ala, Val, Leu, or Gly
  SITE (344)..(344): Xaa at position 344 is Leu, Ala, Val, Gly, or Ile
  SITE (362)..(362): Xaa at position 362 is Ala, Gly, or Pro
  SITE (375)..(375): Xaa at position 375 is Tyr, Phe, Met, His, Ile, Leu, Val Ala, or Gly
  SITE (376)..(376): Xaa at position 376 is Trp, Tyr, Phe, Met, His, Ile, Leu Val, Ala, or Gly
  SITE (383)..(383): Xaa at position 383 is Ala, Gly, or Pro
  SITE (384)..(384): Xaa at position 384 is Ile, Ala, Val, Leu, or Gly
  SITE (414)..(414): Xaa at position 414 is Ala, Gly, or Pro
  SITE (417)..(417): Xaa at position 417 is Leu, Ala, Val, Gly, or Ile
  SITE (418)..(418): Xaa at position 418 is Tyr, Phe, Met, His, Ile, Leu, Val Ala, or Gly
  SITE (419)..(419): Xaa at position 419 is Trp, Tyr, Phe, Met, His, Ile, Leu Val, Ala, or Gly
  SITE (427)..(427): Xaa at position 427 is Ile, Ala, Val, Leu, or Gly
  SITE (429)..(429): Xaa at position 429 is Val, Ala, Gly, Leu, or Ile
  SITE (453)..(453): Xaa at position 453 is Leu, Ala, Val, Gly, or Ile
  SITE (460)..(460): Xaa at position 460 is Met, Ile, Leu, Val, Ala, or Gly
  SITE (461)..(461): Xaa at position 461 is Tyr, Phe, Met, His, Ile, Leu, Val Ala, or Gly
  SITE (462)..(462): Xaa at position 462 is Trp, Tyr, Phe, Met, His, Ile, Leu Val, Ala, or Gly
  SITE (471)..(471): Xaa at position 471 is Ile, Ala, Val, Leu, or Gly
  SITE (474)..(474): Xaa at position 474 is Ala, Gly, or Pro
  SITE (475)..(475): Xaa at position 475 is Ala, Gly, or Pro
  SITE (476)..(476): Xaa at position 476 is Leu, Ala, Val, Gly, or Ile
  SITE (485)..(485): Xaa at position 485 is Val, Ala, Gly, Leu, or Ile
  SITE (496)..(496): Xaa at position 496 is Ala, Gly, or Pro
  SITE (504)..(504): Xaa at position 504 is Ile, Ala, Val, Leu, or Gly
  SITE (506)..(506): Xaa at position 506 is Trp, Tyr, Phe, Met, His, Ile, Leu Val, Ala, or Gly
  SITE (517)..(517): Xaa at position 517 is Met, Ile, Leu, Val, Ala, or Gly
  SITE (532)..(532): Xaa at position 532 is Ile, Ala, Val, Leu, or Gly
  SITE (547)..(547): Xaa at position 547 is Trp, Tyr, Phe, Met, His, Ile, Leu Val, Ala, or Gly
  SITE (555)..(555): Xaa at position 555 is Ile, Ala, Val, Leu, or Gly
  SITE (575)..(575): Xaa at position 575 is Leu, Ala, Val, Gly, or Ile
  SITE (576)..(576): Xaa at position 576 is Met, Ile, Leu, Val, Ala, or Gly
  SITE (592)..(592): Xaa at position 592 is Cys, Ala, Val, Gly, Ser, or Thr
  SITE (602)..(602): Xaa at position 602 is Leu, Ala, Val, Gly, or Ile
  SITE (603)..(603): Xaa at position 603 is Cys, Ala, Val, Gly, Ser, or Thr
  SITE (604)..(604): Xaa at position 604 is Leu, Ala, Val, Gly, or Ile
  SITE (614)..(614): Xaa at position 614 is Cys, Ala, Val, Gly, Ser, or Thr
  SITE (634)..(634): Xaa at position 634 is Leu, Ala, Val, Gly, or Ile
  SITE (635)..(635): Xaa at position 635 is Leu, Ala, Val, Gly, or Ile
  SITE (636)..(636): Xaa at position 636 is Phe, Tyr, Met, His, Ile, Leu, Val Ala, or Gly
  SITE (642)..(642): Xaa at position 642 is Ile, Ala, Val, Leu, or Gly
  SITE (645)..(645): Xaa at position 645 is Ile, Ala, Val, Leu, or Gly
  SITE (664)..(664): Xaa at position 664 is Ala, Gly, or Pro
  SITE (666)..(666): Xaa at position 666 is Ala, Gly, or Pro
  SITE (676)..(676): Xaa at position 676 is Ile, Ala, Val, Leu, or Gly
  SITE (677)..(677): Xaa at position 677 is Tyr, Phe, Met, His, Ile, Leu, Val Ala, or Gly
  SITE (686)..(686): Xaa at position 686 is Ile, Ala, Val, Leu, or Gly
  SITE (689)..(689): Xaa at position 689 is Ala, Gly, or Pro
  SITE (700)..(700): Xaa at position 700 is Val, Ala, Gly, Leu, or Ile
  SITE (712)..(712): Xaa at position 712 is Val, Ala, Gly, Leu, or Ile
  SITE (719)..(719): Xaa at position 719 is Leu, Ala, Val, Gly, or Ile
  SITE (720)..(720): Xaa at position 720 is Tyr, Phe, Met, His, Ile, Leu, Val Ala, or Gly
  SITE (721)..(721): Xaa at position 721 is Trp, Tyr, Phe, Met, His, Ile, Leu Val, Ala, or Gly
  SITE (722)..(722): Xaa at position 722 is Ala, Gly, or Pro
  SITE (729)..(729): Xaa at position 729 is Ile, Ala, Val, Leu, or Gly
  SITE (731)..(731): Xaa at position 731 is Val, Ala, Gly, Leu, or Ile
  SITE (755)..(755): Xaa at position 755 is Leu, Ala, Val, Gly, or Ile
  SITE (762)..(762): Xaa at position 762 is Met, Ile, Leu, Val, Ala, or Gly
  SITE (764)..(764): Xaa at position 764 is Trp, Tyr, Phe, Met, His, Ile, Leu Val, Ala, or Gly
  SITE (773)..(773): Xaa at position 773 is Ile, Ala, Val, Leu, or Gly
  SITE (776)..(776): Xaa at position 776 is Ala, Gly, or Pro
  SITE (777)..(777): Xaa at position 777 is Ala, Gly, or Pro
  SITE (778)..(778): Xaa at position 778 is Met, Ile, Leu, Val, Ala, or Gly
  SITE (787)..(787): Xaa at position 787 is Val, Ala, Gly, Leu, or Ile
  SITE (793)..(793): Xaa at position 793 is Ala, Gly, or Pro
  SITE (798)..(798): Xaa at position 798 is Ile, Ala, Val, Leu, or Gly
  SITE (805)..(805): Xaa at position 805 is Leu, Ala, Val, Gly, or Ile
  SITE (807)..(807): Xaa at position 807 is Trp, Tyr, Phe, Met, His, Ile, Leu Val, Ala, or Gly
  SITE (815)..(815): Xaa at position 815 is Ile, Ala, Val, Leu, or Gly
  SITE (829)..(829): Xaa at position 829 is Ala, Gly, or Pro
  SITE (832)..(832): Xaa at position 832 is Leu, Ala, Val, Gly, or Ile
  SITE (845)..(845): Xaa at position 845 is Ile, Ala, Val, Leu, or Gly
  SITE (847)..(847): Xaa at position 847 is Trp, Tyr, Phe, Met, His, Ile, Leu Val, Ala, or Gly
  SITE (855)..(855): Xaa at position 855 is Ile, Ala, Val, Leu, or Gly
  SITE (858)..(858): Xaa at position 858 is Ala, Gly, or Pro
  SITE (869)..(869): Xaa at position 869 is Ile, Ala, Val, Leu, or Gly
  SITE (876)..(876): Xaa at position 876 is Val, Ala, Gly, Leu, or Ile
  SITE (881)..(881): Xaa at position 881 is Val, Ala, Gly, Leu, or Ile
  SITE (893)..(893): Xaa at position 893 is Cys, Ala, Val, Gly, Ser, or Thr
  SITE (903)..(903): Xaa at position 903 is Leu, Ala, Val, Gly, or Ile
  SITE (904)..(904): Xaa at position 904 is Cys, Ala, Val, Gly, Ser, or Thr
  SITE (906)..(906): Xaa at position 906 is Ala, Gly, or Pro
  SITE (936)..(936): Xaa at position 936 is Leu, Ala, Val, Gly, or Ile
  SITE (937)..(937): Xaa at position 937 is Leu, Ala, Val, Gly, or Ile
  SITE (938)..(938): Xaa at position 938 is Phe, Tyr, Met, His, Ile, Leu, Val Ala, or Gly
  SITE (944)..(944): Xaa at position 944 is Ile, Ala, Val, Leu, or Gly
  SITE (959)..(959): Xaa at position 959 is Leu, Ala, Val, Gly, or Ile
  SITE (967)..(967): Xaa at position 967 is Val, Ala, Gly, Leu, or Ile
  SITE (969)..(969): Xaa at position 969 is Ala, Gly, or Pro
  SITE (979)..(979): Xaa at position 979 is Leu, Ala, Val, Gly, or Ile
  SITE (980)..(980): Xaa at position 980 is Tyr, Phe, Met, His, Ile, Leu, Val Ala, or Gly
  SITE (981)..(981): Xaa at position 981 is Trp, Tyr, Phe, Met, His, Ile, Leu Val, Ala, or Gly
  SITE (982)..(982): Xaa at position 982 is Ile, Ala, Val, Leu, or Gly
  SITE (989)..(989): Xaa at position 989 is Ile, Ala, Val, Leu, or Gly
  SITE (992)..(992): Xaa at position 992 is Ala, Gly, or Pro
  SITE (1027)..(1027): Xaa at position 1027 is Tyr, Phe, Met, His, Ile, Leu Val, Ala, or Gly
  SITE (1028)..(1028): Xaa at position 1028 is Ile, Ala, Val, Leu, or Gly
  SITE (1029)..(1029): Xaa at position 1029 is Tyr, Phe, Met, His, Ile, Leu Val, Ala, or Gly
  SITE (1032)..(1032): Xaa at position 1032 is Cys, Ala, Val, Gly, Ser, or Thr
  SITE (1038)..(1038): Xaa at position 1038 is Ile, Ala, Val, Leu, or Gly
  SITE (1040)..(1040): Xaa at position 1040 is Val, Ala, Gly, Leu, or Ile
  SITE (1051)..(1051): Xaa at position 1051 is Val, Ala, Gly, Leu, or Ile
  SITE (1052)..(1052): Xaa at position 1052 is Leu, Ala, Val, Gly, or Ile
  SITE (1061)..(1061): Xaa at position 1061 is Ala, Gly, or Pro
  SITE (1062)..(1062): Xaa at position 1062 is Val, Ala, Gly, Leu, or Ile
  SITE (1071)..(1071): Xaa at position 1071 is Met, Ile, Leu, Val, Ala, or Gly
  SITE (1072)..(1072): Xaa at position 1072 is Tyr, Phe, Met, His, Ile, Leu Val, Ala, or Gly
  SITE (1073)..(1073): Xaa at position 1073 is Phe, Tyr, Met, His, Ile, Leu Val, Ala, or Gly
  SITE (1083)..(1083): Xaa at position 1083 is Ile, Ala, Val, Leu, or Gly
  SITE (1086)..(1086): Xaa at position 1086 is Ala, Gly, or Pro
  SITE (1087)..(1087): Xaa at position 1087 is Ala, Gly, or Pro
  SITE (1088)..(1088): Xaa at position 1088 is Leu, Ala, Val, Gly, or Ile
  SITE (1116)..(1116): Xaa at position 1116 is Leu, Ala, Val, Gly, or Ile
  SITE (1117)..(1117): Xaa at position 1117 is Phe, Tyr, Met, His, Ile, Leu Val, Ala, or Gly
  SITE (1118)..(1118): Xaa at position 1118 is Trp, Tyr, Phe, Met, His, Ile Leu, Val, Ala, or Gly
  SITE (1119)..(1119): Xaa at position 1119 is Ala, Gly, or Pro
  SITE (1126)..(1126): Xaa at position 1126 is Ile, Ala, Val, Leu, or Gly
  SITE (1157)..(1157): Xaa at position 1157 is Leu, Ala, Val, Gly, or Ile
  SITE (1159)..(1159): Xaa at position 1159 is Trp, Tyr, Phe, Met, His, Ile Leu, Val, Ala, or Gly
  SITE (1160)..(1160): Xaa at position 1160 is Ile, Ala, Val, Leu, or Gly
  SITE (1167)..(1167): Xaa at position 1167 is Ile, Ala, Val, Leu, or Gly
  SITE (1188)..(1188): Xaa at position 1188 is Leu, Ala, Val, Gly, or Ile
  SITE (1207)..(1207): Xaa at position 1207 is Cys, Ala, Val, Gly, Ser, or Thr
  SITE (1217)..(1217): Xaa at position 1217 is Ile, Ala, Val, Leu, or Gly
  SITE (1218)..(1218): Xaa at position 1218 is Cys, Ala, Val, Gly, Ser, or Thr
  SITE (1219)..(1219): Xaa at position 1219 is Leu, Ala, Val, Gly, or Ile
  SITE (1313)..(1313): Xaa at position 1313 is Cys, Ala, Val, Gly, Ser, or Thr
MGAVLRSLLACSFCVLLRAAPLXXXXNRRDXRLXDATNGKENATIVXGGXEDXAXXDXXFSHGLXXXSDXSEEXXKRTEFNKTESVQNVXXSGXLSPDGXAXDWLGEKXXXTDSETNRXEXSNLDGSXRKVLFWQELDQPRAIALDPSSGFXXXTDWGEVPKXERXGXDGSSRFIIXNSEIYWPNGLTXDYEEQKXXXXDAKLNFXHKSNLDGTNRQXXVKGSXPHPFXLTXFEDIXXXTDWSTHSXXXXNKYTGEGLREIHSDIFSPMDXHXFSQQRQPNATNPCGIDNGGCSHXXXXSPVKPFYQXAXPTGVKLXENGKTCKDGATELXXXXRRTDXRRXSXDTPDFTDIVLQLEDIRHXIAIDYDPVEGYIXXTDDEVRXXRRSFIDGSGSQFVVTAQIAHPDGIAVDWVXRNXXXTDTGTDRXEXTRLNGTMRKILISEDLEEPRAIVXDPMVGYXXXTDWGEIPKXERXXXDGSDRVVLXNTSLGWPNGLXLDYDEGKXYXGDAKTDKIEVXNTDGTGRRVLVEDKXPHIFGFTLLGDYVYXTDWQRRSXERVHKRSAEREVIIDQLPDXXGLKATNVHRVIGSNPXAEENGGCSHXXXYRPQGLRCAXPIGFELISDMKTCIVPEAFXXXSRRADXRRXSLETNNNNVAIPLTGVKEXSXLDFDVTDNRXXWTDISLKTXSRXFMNGSALEHVXEFGLDYPEGMAXDWLGKNXXXXDTGTNRXEXSKLDGQHRQVLVWKDLDSPRALAXDPAEGFXYXTEWGGKPKXDRXXXDGSERTTLXPNVGRXNGLTXDYAKRRXYXTDLDTNLXESSNMLGLNREVIXDDXPHPFGLTQYQDYXYXTDWSRRSXERXNKTSGQNRTIXQGHLDYXMDILXFHSSRQSGWNEXASSNGHCSHXXLXVPVGGFVCGCPAHYSLNADNRTCSAPTTFXXXSQKSAXNRMVIDEQQSPDIIXPIHSLRNXRXIDYDPLDKQXXXXDSRQNMXRKXQEDGSQGFTVVVSSVPSQNLEIQPYDLSIDIYSRXXXWTXEATNVXNXTRLDGRSVGVXXKGEQDRPRXXVVNPEKGYXXXTNLQERSPKXERXXXDGTEREVLFFSGLSKPIALALDSRLGKXXXXDSDLRRXESSDLSGANRIVLEDSNILQPVGLTVFENWXYXXDKQQQMXEKIDMTGREGRTKVQARIAQXSDIHAVKELNLQEYRQHPXAQDNGGCSHXXXVKGDGTTRCSCPMHLVLLQDELSCGEPPTCSPQQFTCFTGEIDCIPVAWRCDGFTECEDHSDELNCPVCSESQFQCASGQCIDGALRCNGDANXQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 65 - protein, 1012 aa, Homo sapiens
  SITE (834)..(834): Xaa at position 834 is Met, Ile, Leu, Val, Ala, or Gly
  SITE (851)..(851): Xaa at position 851 is His, Phe, Tyr, Lys, Arg, Gly, Ser Thr, Ala, Val, Leu, Ile, Asn, Met, or Gln
  SITE (852)..(852): Xaa at position 852 is Val, Ala, Gly, Leu, or Ile
  SITE (854)..(854): Xaa at position 854 is Ala, Gly, or Pro
  SITE (858)..(858): Xaa at position 858 is Ala, Gly, or Pro
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNXPRQLEMGGLSPAGDMSXXDXAAAXVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 66 - protein, 350 aa, Homo sapiens
  SITE (57)..(57): Xaa at position 57 is Val, Ala, Gly, Leu, or Ile
  SITE (62)..(62): Xaa at position 62 is Phe, Tyr, Met, His, Ile, Leu, Val Ala, or Gly
  SITE (64)..(64): Xaa at position 64 is Ile, Ala, Val, Leu, or Gly
  SITE (67)..(67): Xaa at position 67 is Cys, Ala, Val, Gly, Ser, or Thr
  SITE (70)..(70): Xaa at position 70 is Cys, Ala, Val, Gly, Ser, or Thr
  SITE (72)..(72): Xaa at position 72 is Ile, Ala, Val, Leu, or Gly
  SITE (74)..(74): Xaa at position 74 is Ile, Ala, Val, Leu, or Gly
  SITE (75)..(75): Xaa at position 75 is Phe, Tyr, Met, His, Ile, Leu, Val Ala, or Gly
  SITE (81)..(81): Xaa at position 81 is Val, Ala, Gly, Leu, or Ile
  SITE (83)..(83): Xaa at position 83 is Ile, Ala, Val, Leu, or Gly
  SITE (86)..(86): Xaa at position 86 is Cys, Ala, Val, Gly, Ser, or Thr
  SITE (89)..(89): Xaa at position 89 is Cys, Ala, Val, Gly, Ser, or Thr
  SITE (91)..(91): Xaa at position 91 is Ile, Ala, Val, Leu, or Gly
  SITE (92)..(92): Xaa at position 92 is Phe, Tyr, Met, His, Ile, Leu, Val Ala, or Gly
  SITE (93)..(93): Xaa at position 93 is Leu, Ala, Val, Gly, or Ile
  SITE (96)..(96): Xaa at position 96 is Val, Ala, Gly, Leu, or Ile
  SITE (100)..(100): Xaa at position 100 is Val, Ala, Gly, Leu, or Ile
  SITE (102)..(102): Xaa at position 102 is Phe, Tyr, Met, His, Ile, Leu, Val Ala, or Gly
  SITE (105)..(105): Xaa at position 105 is Cys, Ala, Val, Gly, Ser, or Thr
  SITE (108)..(108): Xaa at position 108 is Cys, Ala, Val, Gly, Ser, or Thr
  SITE (110)..(110): Xaa at position 110 is Cys, Ala, Val, Gly, Ser, or Thr
  SITE (112)..(112): Xaa at position 112 is Leu, Ala, Val, Gly, or Ile
  SITE (113)..(113): Xaa at position 113 is Ala, Gly, or Pro
  SITE (114)..(114): Xaa at position 114 is Cys, Ala, Val, Gly, Ser, or Thr
  SITE (117)..(117): Xaa at position 117 is Phe, Tyr, Met, His, Ile, Leu, Val Ala, or Gly
  SITE (119)..(119): Xaa at position 119 is Val, Ala, Gly, Leu, or Ile
  SITE (122)..(122): Xaa at position 122 is Cys, Ala, Val, Gly, Ser, or Thr
  SITE (125)..(125): Xaa at position 125 is Leu, Ala, Val, Gly, or Ile
  SITE (127)..(127): Xaa at position 127 is Val, Ala, Gly, Leu, or Ile
  SITE (129)..(129): Xaa at position 129 is Leu, Ala, Val, Gly, or Ile
  SITE (131)..(131): Xaa at position 131 is Cys, Ala, Val, Gly, Ser, or Thr
  SITE (137)..(137): Xaa at position 137 is Ile, Ala, Val, Leu, or Gly
  SITE (143)..(143): Xaa at position 143 is Ile, Ala, Val, Leu, or Gly
  SITE (145)..(145): Xaa at position 145 is Phe, Tyr, Met, His, Ile, Leu, Val Ala, or Gly
  SITE (148)..(148): Xaa at position 148 is Phe, Tyr, Met, His, Ile, Leu, Val Ala, or Gly
  SITE (150)..(150): Xaa at position 150 is Trp, Tyr, Phe, Met, His, Ile, Leu Val, Ala, or Gly
  SITE (152)..(152): Xaa at position 152 is Tyr, Phe, Met, His, Ile, Leu, Val Ala, or Gly
  SITE (155)..(155): Xaa at position 155 is Leu, Ala, Val, Gly, or Ile
  SITE (157)..(157): Xaa at position 157 is Phe, Tyr, Met, His, Ile, Leu, Val Ala, or Gly
  SITE (159)..(159): Xaa at position 159 is Phe, Tyr, Met, His, Ile, Leu, Val Ala, or Gly
  SITE (162)..(162): Xaa at position 162 is Ala, Gly, or Pro
  SITE (167)..(167): Xaa at position 167 is Phe, Tyr, Met, His, Ile, Leu, Val Ala, or Gly
  SITE (171)..(171): Xaa at position 171 is Trp, Tyr, Phe, Met, His, Ile, Leu Val, Ala, or Gly
  SITE (189)..(189): Xaa at position 189 is Leu, Ala, Val, Gly, or Ile
  SITE (195)..(195): Xaa at position 195 is Val, Ala, Gly, Leu, or Ile
  SITE (199)..(199): Xaa at position 199 is Val, Ala, Gly, Leu, or Ile
  SITE (207)..(207): Xaa at position 207 is Leu, Ala, Val, Gly, or Ile
  SITE (221)..(221): Xaa at position 221 is Val, Ala, Gly, Leu, or Ile
  SITE (236)..(236): Xaa at position 236 is Cys, Ala, Val, Gly, Ser, or Thr
  SITE (237)..(237): Xaa at position 237 is Leu, Ala, Val, Gly, or Ile
  SITE (238)..(238): Xaa at position 238 is Val, Ala, Gly, Leu, or Ile
  SITE (239)..(239): Xaa at position 239 is Val, Ala, Gly, Leu, or Ile
  SITE (248)..(248): Xaa at position 248 is Ala, Gly, or Pro
  SITE (250)..(250): Xaa at position 250 is Ala, Gly, or Pro
  SITE (253)..(253): Xaa at position 253 is Leu, Ala, Val, Gly, or Ile
  SITE (257)..(257): Xaa at position 257 is Met, Ile, Leu, Val, Ala, or Gly
  SITE (270)..(270): Xaa at position 270 is Val, Ala, Gly, Leu, or Ile
  SITE (277)..(277): Xaa at position 277 is Ala, Gly, or Pro
  SITE (280)..(280): Xaa at position 280 is Val, Ala, Gly, Leu, or Ile
  SITE (285)..(285): Xaa at position 285 is Ala, Gly, or Pro
  SITE (297)..(297): Xaa at position 297 is Val, Ala, Gly, Leu, or Ile
  SITE (299)..(299): Xaa at position 299 is Ala, Gly, or Pro
  SITE (300)..(300): Xaa at position 300 is Leu, Ala, Val, Gly, or Ile
  SITE (302)..(302): Xaa at position 302 is Phe, Tyr, Met, His, Ile, Leu, Val Ala, or Gly
  SITE (307)..(307): Xaa at position 307 is Ala, Gly, or Pro
  SITE (308)..(308): Xaa at position 308 is Val, Ala, Gly, Leu, or Ile
  SITE (311)..(311): Xaa at position 311 is Cys, Ala, Val, Gly, Ser, or Thr
  SITE (333)..(333): Xaa at position 333 is Ala, Gly, or Pro
  SITE (340)..(340): Xaa at position 340 is Phe, Tyr, Met, His, Ile, Leu, Val Ala, or Gly
  SITE (344)..(344): Xaa at position 344 is Ala, Gly, or Pro
MGCFFSKRRKADKESRPENEEERPKQYSWDQREKVDPKDYMFSGLKDETVGRLPGTXAGQQXLXQDXENXNXYXXDHSATXTXDDXTNXIXXXGPXKGSXFXRNXRDXKXTXXXQQXRXRDXRKXEXFXCXATQPIXESSSNXKXGCXQXYXPEXAXQXKDXGLSIXNNTXSNIHDFTPVSGELNWSLXPEDAVXQDYXPIPTTEEXKAVRVSTEANRSIXPISRGQRQKSSDESXXXXLFAGDYTIXNXRKXIDEXVGKGFFLVQTKEXSMKAEDXQRXFREKXPDFLPLLNKGPXIXXEXNGDGXXEVXQLIVNEIFNGTKMFVSESKETXSGDVDSXYNFXDIQMGI

SEQ ID NO: 67 - protein, 270 aa, Homo sapiens
  SITE (25)..(25): Xaa at position 25 is Leu, Ala, Val, Gly, or Ile
  SITE (39)..(39): Xaa at position 39 is Ala, Gly, or Pro
  SITE (44)..(44): Xaa at position 44 is Trp, Tyr, Phe, Met, His, Ile, Leu Val, Ala, or Gly
  SITE (51)..(51): Xaa at position 51 is Phe, Tyr, Met, His, Ile, Leu, Val Ala, or Gly
  SITE (60)..(60): Xaa at position 60 is Cys, Ala, Val, Gly, Ser, or Thr
  SITE (64)..(64): Xaa at position 64 is Cys, Ala, Val, Gly, Ser, or Thr
  SITE (77)..(77): Xaa at position 77 is Trp, Tyr, Phe, Met, His, Ile, Leu Val, Ala, or Gly
  SITE (84)..(84): Xaa at position 84 is Val, Ala, Gly, Leu, or Ile
  SITE (92)..(92): Xaa at position 92 is Ile, Ala, Val, Leu, or Gly
  SITE (135)..(135): Xaa at position 135 is Leu, Ala, Val, Gly, or Ile
  SITE (149)..(149): Xaa at position 149 is Leu, Ala, Val, Gly, or Ile
  SITE (164)..(164): Xaa at position 164 is Cys, Ala, Val, Gly, Ser, or Thr
  SITE (167)..(167): Xaa at position 167 is Val, Ala, Gly, Leu, or Ile
  SITE (176)..(176): Xaa at position 176 is Cys, Ala, Val, Gly, Ser, or Thr
  SITE (191)..(191): Xaa at position 191 is Met, Ile, Leu, Val, Ala, or Gly
  SITE (198)..(198): Xaa at position 198 is Cys, Ala, Val, Gly, Ser, or Thr
MDWKTLQALLSGVNKYSTAFGRIWXSVVFVFRVLVYVVXAERVXGDEQKDXDCNTKQPGXTNVXYDNYFPISNIRLXALQLIFXTCPSLLVXLHVAYREERERRHRQKHGDQCAKLYDNAGKKHGGLWWTYLFSXIFKLIIEFLFLYLXHTLWHGFNMPRLVQXANXAPCPNIVDXYIARPTEKKIFTYFXVGASAVXIVLTICELCYLICHRVLRGLHKDKPRGGCSPSSSASRASTCRCHHKLVEAGEVDPDPGNNKLQASAPNLTPI

SEQ ID NO: 68 - protein, 414 aa, Homo sapiens
  SITE (10)..(10): Xaa at position 10 is Val, Ala, Gly, Leu, or Ile
  SITE (11)..(11): Xaa at position 11 is Val, Ala, Gly, Leu, or Ile
  SITE (13)..(13): Xaa at position 13 is Met, Ile, Leu, Val, Ala, or Gly
  SITE (18)..(18): Xaa at position 18 is Met, Ile, Leu, Val, Ala, or Gly
  SITE (21)..(21): Xaa at position 21 is Ile, Ala, Val, Leu, or Gly
  SITE (22)..(22): Xaa at position 22 is Ile, Ala, Val, Leu, or Gly
  SITE (23)..(23): Xaa at position 23 is Trp, Tyr, Phe, Met, His, Ile, Leu Val, Ala, or Gly
  SITE (25)..(25): Xaa at position 25 is Leu, Ala, Val, Gly, or Ile
  SITE (26)..(26): Xaa at position 26 is Ile, Ala, Val, Leu, or Gly
  SITE (30)..(30): Xaa at position 30 is Leu, Ala, Val, Gly, or Ile
  SITE (31)..(31): Xaa at position 31 is Ile, Ala, Val, Leu, or Gly
  SITE (35)..(35): Xaa at position 35 is Val, Ala, Gly, Leu, or Ile
  SITE (39)..(39): Xaa at position 39 is Leu, Ala, Val, Gly, or Ile
  SITE (44)..(44): Xaa at position 44 is Leu, Ala, Val, Gly, or Ile
  SITE (46)..(46): Xaa at position 46 is Ile, Ala, Val, Leu, or Gly
  SITE (60)..(60): Xaa at position 60 is Ala, Gly, or Pro
  SITE (61)..(61): Xaa at position 61 is Ala, Gly, or Pro
  SITE (63)..(63): Xaa at position 63 is Ala, Gly, or Pro
  SITE (64)..(64): Xaa at position 64 is Ile, Ala, Val, Leu, or Gly
  SITE (69)..(69): Xaa at position 69 is Val, Ala, Gly, Leu, or Ile
  SITE (71)..(71): Xaa at position 71 is Val, Ala, Gly, Leu, or Ile
  SITE (73)..(73): Xaa at position 73 is Cys, Ala, Val, Gly, Ser, or Thr
  SITE (74)..(74): Xaa at position 74 is Ala, Gly, or Pro
  SITE (76)..(76): Xaa at position 76 is Ile, Ala, Val, Leu, or Gly
  SITE (99)..(99): Xaa at position 99 is Ile, Ala, Val, Leu, or Gly
  SITE (102)..(102): Xaa at position 102 is Ile, Ala, Val, Leu, or Gly
  SITE (107)..(107): Xaa at position 107 is Val, Ala, Gly, Leu, or Ile
  SITE (108)..(108): Xaa at position 108 is Phe, Tyr, Met, His, Ile, Leu, Val Ala, or Gly
  SITE (112)..(112): Xaa at position 112 is Ile, Ala, Val, Leu, or Gly
  SITE (113)..(113): Xaa at position 113 is Ile, Ala, Val, Leu, or Gly
  SITE (114)..(114): Xaa at position 114 is Cys, Ala, Val, Gly, Ser, or Thr
  SITE (117)..(117): Xaa at position 117 is Ile, Ala, Val, Leu, or Gly
  SITE (124)..(124): Xaa at position 124 is Trp, Tyr, Phe, Met, His, Ile, Leu Val, Ala, or Gly
  SITE (128)..(128): Xaa at position 128 is Ile, Ala, Val, Leu, or Gly
  SITE (129)..(129): Xaa at position 129 is Ile, Ala, Val, Leu, or Gly
  SITE (130)..(130): Xaa at position 130 is Ile, Ala, Val, Leu, or Gly
  SITE (133)..(133): Xaa at position 133 is His, Phe, Tyr, Lys, Arg, Gly, Ser Thr, Ala, Val, Leu, Ile, Asn, Met, or Gln
  SITE (134)..(134): Xaa at position 134 is Ala, Gly, or Pro
  SITE (179)..(179): Xaa at position 179 is Ala, Gly, or Pro
  SITE (189)..(189): Xaa at position 189 is Ile, Ala, Val, Leu, or Gly
  SITE (192)..(192): Xaa at position 192 is Phe, Tyr, Met, His, Ile, Leu, Val Ala, or Gly
  SITE (193)..(193): Xaa at position 193 is Ala, Gly, or Pro
  SITE (197)..(197): Xaa at position 197 is Phe, Tyr, Met, His, Ile, Leu, Val Ala, or Gly
  SITE (199)..(199): Xaa at position 199 is Met, Ile, Leu, Val, Ala, or Gly
  SITE (200)..(200): Xaa at position 200 is Ala, Gly, or Pro
  SITE (207)..(207): Xaa at position 207 is Leu, Ala, Val, Gly, or Ile
  SITE (209)..(209): Xaa at position 209 is Leu, Ala, Val, Gly, or Ile
  SITE (223)..(223): Xaa at position 223 is Phe, Tyr, Met, His, Ile, Leu, Val Ala, or Gly
  SITE (226)..(226): Xaa at position 226 is Ile, Ala, Val, Leu, or Gly
  SITE (227)..(227): Xaa at position 227 is Phe, Tyr, Met, His, Ile, Leu, Val Ala, or Gly
  SITE (239)..(239): Xaa at position 239 is Phe, Tyr, Met, His, Ile, Leu, Val Ala, or Gly
  SITE (244)..(244): Xaa at position 244 is Ile, Ala, Val, Leu, or Gly
  SITE (254)..(254): Xaa at position 254 is Met, Ile, Leu, Val, Ala, or Gly
  SITE (258)..(258): Xaa at position 258 is Ala, Gly, or Pro
  SITE (265)..(265): Xaa at position 265 is Phe, Tyr, Met, His, Ile, Leu, Val Ala, or Gly
  SITE (266)..(266): Xaa at position 266 is Ile, Ala, Val, Leu, or Gly
  SITE (267)..(267): Xaa at position 267 is Trp, Tyr, Phe, Met, His, Ile, Leu Val, Ala, or Gly
  SITE (268)..(268): Xaa at position 268 is Ala, Gly, or Pro
  SITE (269)..(269): Xaa at position 269 is Cys, Ala, Val, Gly, Ser, or Thr
  SITE (281)..(281): Xaa at position 281 is Val, Ala, Gly, Leu, or Ile
  SITE (282)..(282): Xaa at position 282 is Ala, Gly, or Pro
  SITE (285)..(285): Xaa at position 285 is Tyr, Phe, Met, His, Ile, Leu, Val Ala, or Gly
  SITE (290)..(290): Xaa at position 290 is Met, Ile, Leu, Val, Ala, or Gly
  SITE (291)..(291): Xaa at position 291 is Met, Ile, Leu, Val, Ala, or Gly
  SITE (295)..(295): Xaa at position 295 is Leu, Ala, Val, Gly, or Ile
  SITE (296)..(296): Xaa at position 296 is Val, Ala, Gly, Leu, or Ile
  SITE (297)..(297): Xaa at position 297 is Cys, Ala, Val, Gly, Ser, or Thr
  SITE (303)..(303): Xaa at position 303 is Val, Ala, Gly, Leu, or Ile
  SITE (305)..(305): Xaa at position 305 is Ala, Gly, or Pro
  SITE (307)..(307): Xaa at position 307 is Ala, Gly, or Pro
  SITE (308)..(308): Xaa at position 308 is Ala, Gly, or Pro
  SITE (330)..(330): Xaa at position 330 is Ile, Ala, Val, Leu, or Gly
  SITE (331)..(331): Xaa at position 331 is Ala, Gly, or Pro
  SITE (333)..(333): Xaa at position 333 is Ile, Ala, Val, Leu, or Gly
  SITE (334)..(334): Xaa at position 334 is Phe, Tyr, Met, His, Ile, Leu, Val Ala, or Gly
  SITE (335)..(335): Xaa at position 335 is Ala, Gly, or Pro
  SITE (336)..(336): Xaa at position 336 is Trp, Tyr, Phe, Met, His, Ile, Leu Val, Ala, or Gly
  SITE (340)..(340): Xaa at position 340 is Leu, Ala, Val, Gly, or Ile
  SITE (344)..(344): Xaa at position 344 is Ala, Gly, or Pro
  SITE (352)..(352): Xaa at position 352 is Leu, Ala, Val, Gly, or Ile
  SITE (353)..(353): Xaa at position 353 is Ala, Gly, or Pro
  SITE (355)..(355): Xaa at position 355 is Phe, Tyr, Met, His, Ile, Leu, Val Ala, or Gly
  SITE (356)..(356): Xaa at position 356 is Ala, Gly, or Pro
  SITE (358)..(358): Xaa at position 358 is Ala, Gly, or Pro
  SITE (359)..(359): Xaa at position 359 is Leu, Ala, Val, Gly, or Ile
  SITE (362)..(362): Xaa at position 362 is Val, Ala, Gly, Leu, or Ile
  SITE (367)..(367): Xaa at position 367 is Ile, Ala, Val, Leu, or Gly
  SITE (371)..(371): Xaa at position 371 is Phe, Tyr, Met, His, Ile, Leu, Val Ala, or Gly
  SITE (372)..(372): Xaa at position 372 is Met, Ile, Leu, Val, Ala, or Gly
  SITE (376)..(376): Xaa at position 376 is Leu, Ala, Val, Gly, or Ile
  SITE (377)..(377): Xaa at position 377 is Ala, Gly, or Pro
  SITE (378)..(378): Xaa at position 378 is Ala, Gly, or Pro
  SITE (397)..(397): Xaa at position 397 is Phe, Tyr, Met, His, Ile, Leu, Val Ala, or Gly
  SITE (398)..(398): Xaa at position 398 is Met, Ile, Leu, Val, Ala, or Gly
  SITE (401)..(401): Xaa at position 401 is Leu, Ala, Val, Gly, or Ile
  SITE (405)..(405): Xaa at position 405 is Leu, Ala, Val, Gly, or Ile
MSKKISGGSXXEXQGDEXTRXXXEXXKEKXXFPYXELDXHSYDXGXENRDATNDQVTKDXXEXXKKHNXGXKXXTXTPDEKRVEEFKLKQMWKSPNGTXRNXLGGTXXREAXXXKNXPRLVSGXVKPXXXGRXXYGDQYRATDFVVPGPGKVEITYTPSDGTQKVTYLVHNFEEGGGVXMGMYNQDKSXEDXXHSSXQXXLSKGWPXYXSTKNTILKKYDGRXKDXXQEIYDKQYKSQXEAQKXWYEHRLIDDXVAQXMKSEGGXXXXXKNYDGDVQSDSXXQGXGSLGXXTSVXXXPDGKTXEXEXXHGTVTRHYRMYQKGQETSTNPXXSXXXXTRGXAHRXKLDNNKEXXFXXNXXEEXSIETXEAGXXTKDXXXCIKGLPNVQRSDYLNTFEXXDKXGENXKIKLAQAKL

SEQ ID NO: 69 - protein, 250 aa, Homo sapiens
  SITE (219)..(219): Xaa at position 219 is Leu, Ala, Val, Gly, or Ile
  SITE (225)..(225): Xaa at position 225 is Leu, Ala, Val, Gly, or Ile
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHXHQGDIXSVIIPRARAKLNLSPHGTFLGFVKL

SEQ ID NO: 70 - protein, 2080 aa, Homo sapiens
  SITE (2)..(2): Xaa at position 2 is Leu, Ala, Val, Gly, or Ile
  SITE (86)..(86): Xaa at position 86 is Val, Ala, Gly, Leu, or Ile
MXRVFILYAENVHTPDTDISDAYCSAVFAGVKKRTKVIKNSVNPVWNEGFEWDLKGIPLDQGSELHVVVKDHETMGRNRFLGEAKXPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 71 - protein, 2070 aa, Homo sapiens
  SITE (129)..(129): Xaa at position 129 is Met, Ile, Leu, Val, Ala, or Gly
  SITE (130)..(130): Xaa at position 130 is Ala, Gly, or Pro
  SITE (138)..(138): Xaa at position 138 is Phe, Tyr, Met, His, Ile, Leu, Val Ala, or Gly
  SITE (140)..(140): Xaa at position 140 is Leu, Ala, Val, Gly, or Ile
  SITE (165)..(165): Xaa at position 165 is Ile, Ala, Val, Leu, or Gly
  SITE (167)..(167): Xaa at position 167 is Val, Ala, Gly, Leu, or Ile
  SITE (176)..(176): Xaa at position 176 is Ala, Gly, or Pro
  SITE (188)..(188): Xaa at position 188 is Ile, Ala, Val, Leu, or Gly
  SITE (189)..(189): Xaa at position 189 is Leu, Ala, Val, Gly, or Ile
  SITE (190)..(190): Xaa at position 190 is Ala, Gly, or Pro
  SITE (191)..(191): Xaa at position 191 is Ile, Ala, Val, Leu, or Gly
  SITE (196)..(196): Xaa at position 196 is Leu, Ala, Val, Gly, or Ile
  SITE (205)..(205): Xaa at position 205 is Ala, Gly, or Pro
  SITE (216)..(216): Xaa at position 216 is Val, Ala, Gly, Leu, or Ile
  SITE (218)..(218): Xaa at position 218 is Leu, Ala, Val, Gly, or Ile
  SITE (219)..(219): Xaa at position 219 is Val, Ala, Gly, Leu, or Ile
  SITE (220)..(220): Xaa at position 220 is Ile, Ala, Val, Leu, or Gly
  SITE (221)..(221): Xaa at position 221 is Ala, Gly, or Pro
  SITE (258)..(258): Xaa at position 258 is Ile, Ala, Val, Leu, or Gly
  SITE (260)..(260): Xaa at position 260 is Leu, Ala, Val, Gly, or Ile
  SITE (279)..(279): Xaa at position 279 is Val, Ala, Gly, Leu, or Ile
  SITE (290)..(290): Xaa at position 290 is Ala, Gly, or Pro
  SITE (302)..(302): Xaa at position 302 is Ile, Ala, Val, Leu, or Gly
  SITE (303)..(303): Xaa at position 303 is Leu, Ala, Val, Gly, or Ile
  SITE (305)..(305): Xaa at position 305 is Ile, Ala, Val, Leu, or Gly
  SITE (310)..(310): Xaa at position 310 is Leu, Ala, Val, Gly, or Ile
  SITE (318)..(318): Xaa at position 318 is Val, Ala, Gly, Leu, or Ile
  SITE (329)..(329): Xaa at position 329 is Val, Ala, Gly, Leu, or Ile
  SITE (331)..(331): Xaa at position 331 is Leu, Ala, Val, Gly, or Ile
  SITE (333)..(333): Xaa at position 333 is Ile, Ala, Val, Leu, or Gly
  SITE (334)..(334): Xaa at position 334 is Ala, Gly, or Pro
  SITE (378)..(378): Xaa at position 378 is Val, Ala, Gly, Leu, or Ile
  SITE (380)..(380): Xaa at position 380 is Leu, Ala, Val, Gly, or Ile
  SITE (405)..(405): Xaa at position 405 is Ile, Ala, Val, Leu, or Gly
  SITE (407)..(407): Xaa at position 407 is Val, Ala, Gly, Leu, or Ile
  SITE (415)..(415): Xaa at position 415 is Ala, Gly, or Pro
  SITE (416)..(416): Xaa at position 416 is Val, Ala, Gly, Leu, or Ile
  SITE (422)..(422): Xaa at position 422 is Ile, Ala, Val, Leu, or Gly
  SITE (428)..(428): Xaa at position 428 is Ile, Ala, Val, Leu, or Gly
  SITE (431)..(431): Xaa at position 431 is Val, Ala, Gly, Leu, or Ile
  SITE (436)..(436): Xaa at position 436 is Leu, Ala, Val, Gly, or Ile
  SITE (444)..(444): Xaa at position 444 is Ala, Gly, or Pro
  SITE (455)..(455): Xaa at position 455 is Val, Ala, Gly, Leu, or Ile
  SITE (457)..(457): Xaa at position 457 is Leu, Ala, Val, Gly, or Ile
  SITE (459)..(459): Xaa at position 459 is Leu, Ala, Val, Gly, or Ile
  SITE (703)..(703): Xaa at position 703 is Leu, Ala, Val, Gly, or Ile
  SITE (728)..(728): Xaa at position 728 is Ile, Ala, Val, Leu, or Gly
  SITE (730)..(730): Xaa at position 730 is Ile, Ala, Val, Leu, or Gly
  SITE (738)..(738): Xaa at position 738 is Ile, Ala, Val, Leu, or Gly
  SITE (739)..(739): Xaa at position 739 is Ala, Gly, or Pro
  SITE (745)..(745): Xaa at position 745 is Leu, Ala, Val, Gly, or Ile
  SITE (751)..(751): Xaa at position 751 is Leu, Ala, Val, Gly, or Ile
  SITE (754)..(754): Xaa at position 754 is Val, Ala, Gly, Leu, or Ile
  SITE (759)..(759): Xaa at position 759 is Leu, Ala, Val, Gly, or Ile
  SITE (767)..(767): Xaa at position 767 is Ala, Gly, or Pro
  SITE (774)..(774): Xaa at position 774 is Ala, Gly, or Pro
  SITE (779)..(779): Xaa at position 779 is Val, Ala, Gly, Leu, or Ile
  SITE (781)..(781): Xaa at position 781 is Ile, Ala, Val, Leu, or Gly
  SITE (783)..(783): Xaa at position 783 is Val, Ala, Gly, Leu, or Ile
  SITE (1152)..(1152): Xaa at position 1152 is Val, Ala, Gly, Leu, or Ile
  SITE (1154)..(1154): Xaa at position 1154 is Leu, Ala, Val, Gly, or Ile
  SITE (1162)..(1162): Xaa at position 1162 is Leu, Ala, Val, Gly, or Ile
  SITE (1185)..(1185): Xaa at position 1185 is Ile, Ala, Val, Leu, or Gly
  SITE (1187)..(1187): Xaa at position 1187 is Ile, Ala, Val, Leu, or Gly
  SITE (1196)..(1196): Xaa at position 1196 is Ala, Gly, or Pro
  SITE (1202)..(1202): Xaa at position 1202 is Leu, Ala, Val, Gly, or Ile
  SITE (1208)..(1208): Xaa at position 1208 is Ile, Ala, Val, Leu, or Gly
  SITE (1209)..(1209): Xaa at position 1209 is Val, Ala, Gly, Leu, or Ile
  SITE (1211)..(1211): Xaa at position 1211 is Val, Ala, Gly, Leu, or Ile
  SITE (1216)..(1216): Xaa at position 1216 is Leu, Ala, Val, Gly, or Ile
  SITE (1219)..(1219): Xaa at position 1219 is Ala, Gly, or Pro
  SITE (1224)..(1224): Xaa at position 1224 is Ala, Gly, or Pro
  SITE (1235)..(1235): Xaa at position 1235 is Val, Ala, Gly, Leu, or Ile
  SITE (1237)..(1237): Xaa at position 1237 is Phe, Tyr, Met, His, Ile, Leu Val, Ala, or Gly
  SITE (1239)..(1239): Xaa at position 1239 is Val, Ala, Gly, Leu, or Ile
  SITE (1337)..(1337): Xaa at position 1337 is Ile, Ala, Val, Leu, or Gly
  SITE (1353)..(1353): Xaa at position 1353 is Leu, Ala, Val, Gly, or Ile
  SITE (1365)..(1365): Xaa at position 1365 is Ala, Gly, or Pro
  SITE (1375)..(1375): Xaa at position 1375 is Val, Ala, Gly, Leu, or Ile
  SITE (1376)..(1376): Xaa at position 1376 is Phe, Tyr, Met, His, Ile, Leu Val, Ala, or Gly
  SITE (1377)..(1377): Xaa at position 1377 is Ile, Ala, Val, Leu, or Gly
  SITE (1386)..(1386): Xaa at position 1386 is Ala, Gly, or Pro
  SITE (1398)..(1398): Xaa at position 1398 is Leu, Ala, Val, Gly, or Ile
  SITE (1399)..(1399): Xaa at position 1399 is Leu, Ala, Val, Gly, or Ile
  SITE (1401)..(1401): Xaa at position 1401 is Ile, Ala, Val, Leu, or Gly
  SITE (1406)..(1406): Xaa at position 1406 is Leu, Ala, Val, Gly, or Ile
  SITE (1414)..(1414): Xaa at position 1414 is Ala, Gly, or Pro
  SITE (1421)..(1421): Xaa at position 1421 is Ala, Gly, or Pro
  SITE (1425)..(1425): Xaa at position 1425 is Val, Ala, Gly, Leu, or Ile
  SITE (1427)..(1427): Xaa at position 1427 is Ile, Ala, Val, Leu, or Gly
  SITE (1428)..(1428): Xaa at position 1428 is Ile, Ala, Val, Leu, or Gly
  SITE (1429)..(1429): Xaa at position 1429 is Phe, Tyr, Met, His, Ile, Leu Val, Ala, or Gly
  SITE (1430)..(1430): Xaa at position 1430 is Ile, Ala, Val, Leu, or Gly
  SITE (1435)..(1435): Xaa at position 1435 is Ala, Gly, or Pro
  SITE (1630)..(1630): Xaa at position 1630 is Ile, Ala, Val, Leu, or Gly
  SITE (1632)..(1632): Xaa at position 1632 is Ile, Ala, Val, Leu, or Gly
  SITE (1654)..(1654): Xaa at position 1654 is Ile, Ala, Val, Leu, or Gly
  SITE (1656)..(1656): Xaa at position 1656 is Ile, Ala, Val, Leu, or Gly
  SITE (1664)..(1664): Xaa at position 1664 is Ala, Gly, or Pro
  SITE (1665)..(1665): Xaa at position 1665 is Ala, Gly, or Pro
  SITE (1677)..(1677): Xaa at position 1677 is Ile, Ala, Val, Leu, or Gly
  SITE (1680)..(1680): Xaa at position 1680 is Val, Ala, Gly, Leu, or Ile
  SITE (1685)..(1685): Xaa at position 1685 is Leu, Ala, Val, Gly, or Ile
  SITE (1693)..(1693): Xaa at position 1693 is Ala, Gly, or Pro
  SITE (1704)..(1704): Xaa at position 1704 is Val, Ala, Gly, Leu, or Ile
  SITE (1706)..(1706): Xaa at position 1706 is Leu, Ala, Val, Gly, or Ile
  SITE (1708)..(1708): Xaa at position 1708 is Leu, Ala, Val, Gly, or Ile
  SITE (1726)..(1726): Xaa at position 1726 is Ile, Ala, Val, Leu, or Gly
  SITE (1728)..(1728): Xaa at position 1728 is Leu, Ala, Val, Gly, or Ile
  SITE (1749)..(1749): Xaa at position 1749 is Val, Ala, Gly, Leu, or Ile
  SITE (1760)..(1760): Xaa at position 1760 is Ala, Gly, or Pro
  SITE (1772)..(1772): Xaa at position 1772 is Ile, Ala, Val, Leu, or Gly
  SITE (1788)..(1788): Xaa at position 1788 is Val, Ala, Gly, Leu, or Ile
  SITE (1799)..(1799): Xaa at position 1799 is Val, Ala, Gly, Leu, or Ile
  SITE (1803)..(1803): Xaa at position 1803 is Val, Ala, Gly, Leu, or Ile
  SITE (1890)..(1890): Xaa at position 1890 is Ile, Ala, Val, Leu, or Gly
  SITE (1892)..(1892): Xaa at position 1892 is Ile, Ala, Val, Leu, or Gly
  SITE (1901)..(1901): Xaa at position 1901 is Ala, Gly, or Pro
  SITE (1916)..(1916): Xaa at position 1916 is Ile, Ala, Val, Leu, or Gly
  SITE (1929)..(1929): Xaa at position 1929 is Ala, Gly, or Pro
  SITE (1940)..(1940): Xaa at position 1940 is Ile, Ala, Val, Leu, or Gly
  SITE (1942)..(1942): Xaa at position 1942 is Met, Ile, Leu, Val, Ala, or Gly
  SITE (1944)..(1944): Xaa at position 1944 is Val, Ala, Gly, Leu, or Ile
  SITE (1988)..(1988): Xaa at position 1988 is Ile, Ala, Val, Leu, or Gly
  SITE (1990)..(1990): Xaa at position 1990 is Leu, Ala, Val, Gly, or Ile
  SITE (1997)..(1997): Xaa at position 1997 is Leu, Ala, Val, Gly, or Ile
  SITE (2014)..(2014): Xaa at position 2014 is Ile, Ala, Val, Leu, or Gly
  SITE (2016)..(2016): Xaa at position 2016 is Val, Ala, Gly, Leu, or Ile
  SITE (2025)..(2025): Xaa at position 2025 is Ala, Gly, or Pro
  SITE (2037)..(2037): Xaa at position 2037 is Ile, Ala, Val, Leu, or Gly
  SITE (2040)..(2040): Xaa at position 2040 is Val, Ala, Gly, Leu, or Ile
  SITE (2045)..(2045): Xaa at position 2045 is Leu, Ala, Val, Gly, or Ile
  SITE (2053)..(2053): Xaa at position 2053 is Ala, Gly, or Pro
  SITE (2057)..(2057): Xaa at position 2057 is Leu, Ala, Val, Gly, or Ile
  SITE (2064)..(2064): Xaa at position 2064 is Val, Ala, Gly, Leu, or Ile
  SITE (2066)..(2066): Xaa at position 2066 is Leu, Ala, Val, Gly, or Ile
  SITE (2068)..(2068): Xaa at position 2068 is Val, Ala, Gly, Leu, or Ile
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNXXQGRHVEVXEXLKPPSGGLGFSVVGLRSENRGELGXFXQEIQEGSVXHRDGRLKETDQXXXXNGQAXDQTITHQQXISILQKAKDTXQXXXXRGSLPQLVSPIVSRSPSAASTISAHSNPVHWQHMETXEXVNDGSGLGFGIIGGKATGXIVKTILPGGVXDQHGRLCSGDHXXKXGDTDXAGMSSEQXAQVLRQCGNRXKXMXXRGAIEERTAPTALGITLSSSPTSTPELRVDASTQKGEESETFDXEXTKNVQGLGITIAGYIGDKKLEPSGXFXKSITKSSXXEHDGRXQIGDQXIAXDGTNXQGFTNQQXVEVLRHTGQTXLXTXMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIEXEKGSKGLGFSILDYQDPIDPASTVXIXRSLVPGGXXEKDGRXLPGDRXMFXNDVNXENSSLEEXVEALKGXPSGTXRXGXAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRXEXWREPSKSXGISIVGGRGMGSRLSNGEVMRGXFXKHVLEDSPXGKNGTXKPGDRXXEXDGMDXRDXSHEQXVEAIRKAGNPXVXMXQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNXRERYGTLTGELHMIEXEKGHSGLGLSLXGNKDRSRMSXXXVGIDPNGAXGKDGRLQIADEXXEXNGQIXYGRSHQNXSSIIKCXPSKXKXXXXRNKDXVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTXEXSKGRTGLGLSIVGGSDTLLGAXIXHEVYEEGXXCKDGRLWAGDQXLEXNGIDXRKATHDEXINVLRQTPQRXRXTXYRDEAPYKEEEVCDTLTXEXQKKPGKGLGLSIVGKRNDTGXFVSDIVKGGIXDADGRLMQGDQXLMVNGEDVRNATQEAXAALLKCSLGTXTLEXGRIKAGPFHSERRPSQSSQVSEGSLSSFTFPLSGSSTSESLESSSKKNALASEIQGLRTVEMKKGPTDSLGISIAGGVGSPLGDVPXFXAMMHPTGVXAQTQKLRVGDRIVTXCGTSTEGMTHTQXVNLLKNASGSXEXQXVAGGDVSVVTGHQQEPASSSLSFTGLTSSSIFQDDLGPPQCKSXTXERGPDGXGFSIVGGYGSPHGDLPXYXKTVFAKGAXSEDGRLKRGDQXIAXNGQSXEGVTHEEXVAIXKRTKGTXTXMXLS

SEQ ID NO: 72 - protein, 1014 aa, Homo sapiens
  SITE (961)..(961): Xaa at position 961 is Ala, Gly, or Pro
  SITE (975)..(975): Xaa at position 975 is Phe, Tyr, Met, His, Ile, Leu, Val Ala, or Gly
  SITE (981)..(981): Xaa at position 981 is Ile, Ala, Val, Leu, or Gly
  SITE (996)..(996): Xaa at position 996 is Val, Ala, Gly, Leu, or Ile
  SITE (1005)..(1005): Xaa at position 1005 is Leu, Ala, Val, Gly, or Ile
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAVKYKGELQRGTAISDPPELKRAKENQKNISNVYYRGQLGRATTLSVTPEMERVKKNQENISSVKYTQDHKQMKGRPSLILDTPAMRHVKEAQNHISMVKYHEDFEKTKGRGFTPVVDDPVTERVRKNTQVVSDAAYKGVHPHIVEMDRRPGIIVDLKVWRTDPGSIFDLDPLEDNIQSRSLHMLSEKASHYRRHWSRSHSSSTFGTGLGDDRSEISEIYPSFSCCSEVTRPSDEGAPVLPGAYQQSHSQGYGYMHQTSVSSMRSMQHSPNLRTYRXMYDYSAQDEDEVSXRDGDYXVNVQPIDDGWMYGTXQRTGRTGMXPANYIEFVN

SEQ ID NO: 73 - protein, 585 aa, Homo sapiens
  SITE (90)..(90): Xaa at position 90 is Val, Ala, Gly, Leu, or Ile
  SITE (158)..(158): Xaa at position 158 is Val, Ala, Gly, Leu, or Ile
  SITE (248)..(248): Xaa at position 248 is Phe, Tyr, Met, His, Ile, Leu, Val Ala, or Gly
MTITYTSQVANARLGSFSRLLLCWRGSIYKLLYGEFLIFLLCYYIIRFIYRLALTEEQQLMFEKLTLYCDSYIQLIPISFVLGFYVTLVXTRWWNQYENLPWPDRLMSLVSGFVEGKDEQGRLLRRTLIRYANLGNVLILRSVSTAVYKRFPSAQHLXQAGFMTPAEHKQLEKLSLPHNMFWVPWVWFANLSMKAWLGGRIRDPILLQSLLNEMNTLRTQCGHLYAYDWISIPLVYTQVVTVAVYSFXLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 74 - protein, 968 aa, Homo sapiens
  SITE (53)..(53): Xaa at position 53 is Ala, Gly, or Pro
  SITE (62)..(62): Xaa at position 62 is Ala, Gly, or Pro
  SITE (64)..(64): Xaa at position 64 is Ala, Gly, or Pro
  SITE (82)..(82): Xaa at position 82 is Ile, Ala, Val, Leu, or Gly
  SITE (84)..(84): Xaa at position 84 is Ile, Ala, Val, Leu, or Gly
  SITE (86)..(86): Xaa at position 86 is Ala, Gly, or Pro
  SITE (88)..(88): Xaa at position 88 is Cys, Ala, Val, Gly, Ser, or Thr
  SITE (93)..(93): Xaa at position 93 is Ile, Ala, Val, Leu, or Gly
  SITE (94)..(94): Xaa at position 94 is Val, Ala, Gly, Leu, or Ile
  SITE (106)..(106): Xaa at position 106 is Leu, Ala, Val, Gly, or Ile
  SITE (108)..(108): Xaa at position 108 is Ile, Ala, Val, Leu, or Gly
  SITE (109)..(109): Xaa at position 109 is Met, Ile, Leu, Val, Ala, or Gly
  SITE (118)..(118): Xaa at position 118 is Val, Ala, Gly, Leu, or Ile
  SITE (121)..(121): Xaa at position 121 is Ile, Ala, Val, Leu, or Gly
  SITE (122)..(122): Xaa at position 122 is Met, Ile, Leu, Val, Ala, or Gly
  SITE (125)..(125): Xaa at position 125 is Leu, Ala, Val, Gly, or Ile
  SITE (129)..(129): Xaa at position 129 is Leu, Ala, Val, Gly, or Ile
  SITE (134)..(134): Xaa at position 134 is Ile, Ala, Val, Leu, or Gly
  SITE (136)..(136): Xaa at position 136 is Val, Ala, Gly, Leu, or Ile
  SITE (137)..(137): Xaa at position 137 is Val, Ala, Gly, Leu, or Ile
  SITE (138)..(138): Xaa at position 138 is Cys, Ala, Val, Gly, Ser, or Thr
  SITE (141)..(141): Xaa at position 141 is Met, Ile, Leu, Val, Ala, or Gly
  SITE (142)..(142): Xaa at position 142 is Leu, Ala, Val, Gly, or Ile
  SITE (144)..(144): Xaa at position 144 is Ala, Gly, or Pro
  SITE (145)..(145): Xaa at position 145 is Leu, Ala, Val, Gly, or Ile
  SITE (148)..(148): Xaa at position 148 is Leu, Ala, Val, Gly, or Ile
  SITE (155)..(155): Xaa at position 155 is His, Phe, Tyr, Lys, Arg, Gly, Ser Thr, Ala, Val, Leu, Ile, Asn, Met, or Gln
  SITE (158)..(158): Xaa at position 158 is Leu, Ala, Val, Gly, or Ile
  SITE (160)..(160): Xaa at position 160 is Ala, Gly, or Pro
  SITE (163)..(163): Xaa at position 163 is Val, Ala, Gly, Leu, or Ile
  SITE (164)..(164): Xaa at position 164 is Leu, Ala, Val, Gly, or Ile
  SITE (165)..(165): Xaa at position 165 is Met, Ile, Leu, Val, Ala, or Gly
  SITE (167)..(167): Xaa at position 167 is Leu, Ala, Val, Gly, or Ile
  SITE (171)..(171): Xaa at position 171 is Ile, Ala, Val, Leu, or Gly
  SITE (173)..(173): Xaa at position 173 is Leu, Ala, Val, Gly, or Ile
  SITE (176)..(176): Xaa at position 176 is Phe, Tyr, Met, His, Ile, Leu, Val Ala, or Gly
  SITE (178)..(178): Xaa at position 178 is Val, Ala, Gly, Leu, or Ile
  SITE (180)..(180): Xaa at position 180 is Ala, Gly, or Pro
  SITE (200)..(200): Xaa at position 200 is Ala, Gly, or Pro
  SITE (218)..(218): Xaa at position 218 is Ala, Gly, or Pro
  SITE (220)..(220): Xaa at position 220 is Ile, Ala, Val, Leu, or Gly
  SITE (223)..(223): Xaa at position 223 is Leu, Ala, Val, Gly, or Ile
  SITE (227)..(227): Xaa at position 227 is Leu, Ala, Val, Gly, or Ile
  SITE (228)..(228): Xaa at position 228 is Ile, Ala, Val, Leu, or Gly
  SITE (230)..(230): Xaa at position 230 is Met, Ile, Leu, Val, Ala, or Gly
  SITE (245)..(245): Xaa at position 245 is Val, Ala, Gly, Leu, or Ile
  SITE (246)..(246): Xaa at position 246 is Leu, Ala, Val, Gly, or Ile
  SITE (249)..(249): Xaa at position 249 is Ile, Ala, Val, Leu, or Gly
  SITE (267)..(267): Xaa at position 267 is Phe, Tyr, Met, His, Ile, Leu, Val Ala, or Gly
  SITE (270)..(270): Xaa at position 270 is Phe, Tyr, Met, His, Ile, Leu, Val Ala, or Gly
  SITE (274)..(274): Xaa at position 274 is Ala, Gly, or Pro
  SITE (275)..(275): Xaa at position 275 is Leu, Ala, Val, Gly, or Ile
  SITE (285)..(285): Xaa at position 285 is Ala, Gly, or Pro
  SITE (288)..(288): Xaa at position 288 is Leu, Ala, Val, Gly, or Ile
  SITE (293)..(293): Xaa at position 293 is Phe, Tyr, Met, His, Ile, Leu, Val Ala, or Gly
  SITE (294)..(294): Xaa at position 294 is Val, Ala, Gly, Leu, or Ile
  SITE (303)..(303): Xaa at position 303 is Leu, Ala, Val, Gly, or Ile
  SITE (306)..(306): Xaa at position 306 is Leu, Ala, Val, Gly, or Ile
  SITE (307)..(307): Xaa at position 307 is Val, Ala, Gly, Leu, or Ile
MAFANFRRILRLSTFEKRKSREYEHVRRDLDPNEVWEIVGELGDGAFGKVYKXKNKETGALXAXKVIETKSEEELEDYIVEXEXLXTXDHPYXXKLLGAYYHDGKXWXXIEFCPGGAXDAXXLEXDRGXTEPQXQXXXRQXXEXXNFXHSKRIIXRDXKXGNXXXTXEGDXRXADXGXSXKNLKTLQKRDSFIGTPYWMXPEVVMCETMKDTPYDYKXDXWSXGITXXEXAQIEPPHHELNPMRXXLKXAKSDPPTLLTPSKWSVEXRDXLKIXXDKNPETRPSXAQXLEHPXXSSITSNKAXREXXAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 75 - protein, 251 aa, Homo sapiens
  SITE (97)..(97): Xaa at position 97 is Ala, Gly, or Pro
  SITE (99)..(99): Xaa at position 99 is Leu, Ala, Val, Gly, or Ile
  SITE (117)..(117): Xaa at position 117 is Leu, Ala, Val, Gly, or Ile
  SITE (132)..(132): Xaa at position 132 is Met, Ile, Leu, Val, Ala, or Gly
  SITE (139)..(139): Xaa at position 139 is Leu, Ala, Val, Gly, or Ile
  SITE (141)..(141): Xaa at position 141 is Ile, Ala, Val, Leu, or Gly
  SITE (147)..(147): Xaa at position 147 is Tyr, Phe, Met, His, Ile, Leu, Val Ala, or Gly
  SITE (149)..(149): Xaa at position 149 is Ile, Ala, Val, Leu, or Gly
  SITE (153)..(153): Xaa at position 153 is Val, Ala, Gly, Leu, or Ile
  SITE (155)..(155): Xaa at position 155 is Phe, Tyr, Met, His, Ile, Leu, Val Ala, or Gly
  SITE (168)..(168): Xaa at position 168 is Ala, Gly, or Pro
  SITE (177)..(177): Xaa at position 177 is Ile, Ala, Val, Leu, or Gly
  SITE (179)..(179): Xaa at position 179 is Val, Ala, Gly, Leu, or Ile
  SITE (180)..(180): Xaa at position 180 is Val, Ala, Gly, Leu, or Ile
  SITE (181)..(181): Xaa at position 181 is Ile, Ala, Val, Leu, or Gly
  SITE (212)..(212): Xaa at position 212 is Ile, Ala, Val, Leu, or Gly
  SITE (220)..(220): Xaa at position 220 is Leu, Ala, Val, Gly, or Ile
  SITE (226)..(226): Xaa at position 226 is Leu, Ala, Val, Gly, or Ile
  SITE (228)..(228): Xaa at position 228 is Val, Ala, Gly, Leu, or Ile
  SITE (230)..(230): Xaa at position 230 is Val, Ala, Gly, Leu, or Ile
  SITE (236)..(236): Xaa at position 236 is Val, Ala, Gly, Leu, or Ile
  SITE (245)..(245): Xaa at position 245 is Phe, Tyr, Met, His, Ile, Leu, Val Ala, or Gly
  SITE (246)..(246): Xaa at position 246 is Phe, Tyr, Met, His, Ile, Leu, Val Ala, or Gly
  SITE (248)..(248): Xaa at position 248 is Ala, Gly, or Pro
MAEDLGLSFGETASVEMLPEHGSCRPKARSSSARWALTCCLVLLPFLAGLTTYLLVSQLRAQGEACVQFQALKGQEFAPSHQQVYAPLRADGDKPRXHXTVVRQTPTQHFKNQFPAXHWEHELGLAFTKNRXNYTNKFXLXPESGDXFXYSQXTXRGMTSECSEIRQXGRPNKPDSXTXXXTKVTDSYPEPTQLLMGTKSVCEVGSNWFQPXYLGAMFSXQEGDKXMXNXSDISLXDYTKEDKTXXGXFLL

SEQ ID NO: 76 - protein, 599 aa, Homo sapiens
  SITE (165)..(165): Xaa at position 165 is Leu, Ala, Val, Gly, or Ile
  SITE (173)..(173): Xaa at position 173 is Ile, Ala, Val, Leu, or Gly
  SITE (175)..(175): Xaa at position 175 is Cys, Ala, Val, Gly, Ser, or Thr
  SITE (191)..(191): Xaa at position 191 is Trp, Tyr, Phe, Met, His, Ile, Leu Val, Ala, or Gly
  SITE (221)..(221): Xaa at position 221 is Cys, Ala, Val, Gly, Ser, or Thr
  SITE (236)..(236): Xaa at position 236 is Ala, Gly, or Pro
  SITE (238)..(238): Xaa at position 238 is Val, Ala, Gly, Leu, or Ile
  SITE (273)..(273): Xaa at position 273 is Cys, Ala, Val, Gly, Ser, or Thr
  SITE (275)..(275): Xaa at position 275 is Ala, Gly, or Pro
  SITE (277)..(277): Xaa at position 277 is Phe, Tyr, Met, His, Ile, Leu, Val Ala, or Gly
  SITE (289)..(289): Xaa at position 289 is Trp, Tyr, Phe, Met, His, Ile, Leu Val, Ala, or Gly
  SITE (326)..(326): Xaa at position 326 is Val, Ala, Gly, Leu, or Ile
  SITE (335)..(335): Xaa at position 335 is Phe, Tyr, Met, His, Ile, Leu, Val Ala, or Gly
  SITE (337)..(337): Xaa at position 337 is Cys, Ala, Val, Gly, Ser, or Thr
  SITE (339)..(339): Xaa at position 339 is Val, Ala, Gly, Leu, or Ile
  SITE (350)..(350): Xaa at position 350 is Val, Ala, Gly, Leu, or Ile
  SITE (352)..(352): Xaa at position 352 is Leu, Ala, Val, Gly, or Ile
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDXLLGSTGSXSXPSLSCQSDAQSPAVTXYKNGKLLSVERSNRIVVDEVYDYHQGTYVXDYTQSDTVSSWTVRXVXQVRTIVGDTKLKPDILDPVEDTLEVELGKPLTISXKXRXGFERVFNPVIKXYIKDSDLEWEVSVPEAKSIKSTLKDEIIERNIILEKXTQRDLRRKXVXFXQNSIGNTTQSXQXKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 77 - protein, 1321 aa, Homo sapiens
  SITE (452)..(452): Xaa at position 452 is Ala, Gly, or Pro
  SITE (453)..(453): Xaa at position 453 is Leu, Ala, Val, Gly, or Ile
  SITE (454)..(454): Xaa at position 454 is Val, Ala, Gly, Leu, or Ile
  SITE (464)..(464): Xaa at position 464 is Ala, Gly, or Pro
  SITE (467)..(467): Xaa at position 467 is Leu, Ala, Val, Gly, or Ile
  SITE (468)..(468): Xaa at position 468 is Ile, Ala, Val, Leu, or Gly
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTXXXGPSGAGKSTXLQXXQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 78 - protein, 300 aa, Homo sapiens
  SITE (49)..(49): Xaa at position 49 is Cys, Ala, Val, Gly, Ser, or Thr
  SITE (52)..(52): Xaa at position 52 is Cys, Ala, Val, Gly, Ser, or Thr
  SITE (91)..(91): Xaa at position 91 is Cys, Ala, Val, Gly, Ser, or Thr
  SITE (132)..(132): Xaa at position 132 is Cys, Ala, Val, Gly, Ser, or Thr
MRALEGPGLSLLCLVLALPALLPVPAVRGVAETPTYPWRDAETGERLVXAQXPPGTFVQRPCRRDSPTTCGPCPPRHYTQFWNYLERCRYXNVLCGEREEEARACHATHNRACRCRTGFFAHAGFCLEHASXPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 79 - protein, 188 aa, Homo sapiens
  SITE (49)..(49): Xaa at position 49 is Phe, Tyr, Met, His, Ile, Leu, Val Ala, or Gly
  SITE (50)..(50): Xaa at position 50 is Ile, Ala, Val, Leu, or Gly
  SITE (51)..(51): Xaa at position 51 is Ala, Gly, or Pro
  SITE (53)..(53): Xaa at position 53 is Ala, Gly, or Pro
  SITE (54)..(54): Xaa at position 54 is Ala, Gly, or Pro
  SITE (69)..(69): Xaa at position 69 is Ile, Ala, Val, Leu, or Gly
  SITE (70)..(70): Xaa at position 70 is Val, Ala, Gly, Leu, or Ile
  SITE (145)..(145): Xaa at position 145 is Leu, Ala, Val, Gly, or Ile
  SITE (146)..(146): Xaa at position 146 is Leu, Ala, Val, Gly, or Ile
MFHQIWAALLYFYGIILNSIYQCPEHSQLTTLGVDGKEFPEVHLGQWYXXXGXXPTKEELATFDPVDNXXFNMAAGSAPMQLHLRATIRMKDGLCVPRKWIYHLTEGSTDLRTEGRPDMKTELFSSSCPGGIMLNETGQGYQRFXXYNRSPHPPEKCVEEFKSLTSCLDSKAFLLTPRNQEACELSNN

SEQ ID NO: 80 - protein, 261 aa, Homo sapiens
  SITE (25)..(25): Xaa at position 25 is Ile, Ala, Val, Leu, or Gly
  SITE (39)..(39): Xaa at position 39 is Ala, Gly, or Pro
  SITE (44)..(44): Xaa at position 44 is Trp, Tyr, Phe, Met, His, Ile, Leu Val, Ala, or Gly
  SITE (51)..(51): Xaa at position 51 is Phe, Tyr, Met, His, Ile, Leu, Val Ala, or Gly
  SITE (60)..(60): Xaa at position 60 is Cys, Ala, Val, Gly, Ser, or Thr
  SITE (64)..(64): Xaa at position 64 is Cys, Ala, Val, Gly, Ser, or Thr
  SITE (73)..(73): Xaa at position 73 is His, Phe, Tyr, Lys, Arg, Gly, Ser Thr, Ala, Val, Leu, Ile, Asn, Met, or Gln
  SITE (77)..(77): Xaa at position 77 is Trp, Tyr, Phe, Met, His, Ile, Leu Val, Ala, or Gly
  SITE (84)..(84): Xaa at position 84 is Val, Ala, Gly, Leu, or Ile
  SITE (92)..(92): Xaa at position 92 is Ala, Gly, or Pro
  SITE (140)..(140): Xaa at position 140 is Ile, Ala, Val, Leu, or Gly
  SITE (154)..(154): Xaa at position 154 is Phe, Tyr, Met, His, Ile, Leu, Val Ala, or Gly
  SITE (169)..(169): Xaa at position 169 is Cys, Ala, Val, Gly, Ser, or Thr
  SITE (171)..(171): Xaa at position 171 is Ile, Ala, Val, Leu, or Gly
  SITE (180)..(180): Xaa at position 180 is Cys, Ala, Val, Gly, Ser, or Thr
  SITE (195)..(195): Xaa at position 195 is Met, Ile, Leu, Val, Ala, or Gly
  SITE (202)..(202): Xaa at position 202 is Cys, Ala, Val, Gly, Ser, or Thr
MDWGTLHTFIGGVNKHSTSIGKVWXTVIFIFRVMILVVXAQEVXGDEQEDXVCNTLQPGXKNVXYDHFFPVSXIRLXALQLIFXSTPALLVXMHVAYYRHETTRKFRRGEKRNDFKDIEDIKKQKVRIEGSLWWTYTSSXFFRIIFEAAFMYVXYFLYNGYHLPWVLKXGXDPCPNLVDXFISRPTEKTVFTIFXISASVIXMLLNVAELCYLLLKVCFRRSKRAQTQKNHPNHALKESKQNEMNELISDSGQNAITGFPS

SEQ ID NO: 81 - protein, 263 aa, Homo sapiens
  SITE (37)..(37): Xaa at position 37 is Val, Ala, Gly, Leu, or Ile
  SITE (39)..(39): Xaa at position 39 is Trp, Tyr, Phe, Met, His, Ile, Leu Val, Ala, or Gly
  SITE (70)..(70): Xaa at position 70 is Ala, Gly, or Pro
  SITE (134)..(134): Xaa at position 134 is Val, Ala, Gly, Leu, or Ile
  SITE (135)..(135): Xaa at position 135 is Cys, Ala, Val, Gly, Ser, or Thr
  SITE (146)..(146): Xaa at position 146 is Cys, Ala, Val, Gly, Ser, or Thr
  SITE (148)..(148): Xaa at position 148 is Leu, Ala, Val, Gly, or Ile
  SITE (159)..(159): Xaa at position 159 is Leu, Ala, Val, Gly, or Ile
  SITE (195)..(195): Xaa at position 195 is Cys, Ala, Val, Gly, Ser, or Thr
  SITE (211)..(211): Xaa at position 211 is Cys, Ala, Val, Gly, Ser, or Thr
MRPGAPGPLWPLPWGALAWAVGFVSSMGSGNPAPGGXCXLQQGQEATCSLVLQTDVTRAECCASGNIDTXWSNLTHPGNKINLLGFLGLVHCLPCKDSCDGVECGPGKACRMLGGRPRCECAPDCSGLPARLQXXGSDGATYRDEXEXRAARCRGHPDXSVMYRGRCRKSCEHVVCPRPQSCVVDQTGSAHCVVXRAAPCPVPSSPGQELXGNNNVTYISSCHMRQATCFLGRSIGVRHAGSCAGTPEEPPGGESAEEEENFV

SEQ ID NO: 82 - protein, 270 aa, Homo sapiens
  SITE (124)..(124): Xaa at position 124 is Ala, Gly, or Pro
  SITE (126)..(126): Xaa at position 126 is Leu, Ala, Val, Gly, or Ile
  SITE (134)..(134): Xaa at position 134 is Ile, Ala, Val, Leu, or Gly
  SITE (159)..(159): Xaa at position 159 is Val, Ala, Gly, Leu, or Ile
  SITE (160)..(160): Xaa at position 160 is Leu, Ala, Val, Gly, or Ile
  SITE (161)..(161): Xaa at position 161 is Leu, Ala, Val, Gly, or Ile
  SITE (183)..(183): Xaa at position 183 is Met, Ile, Leu, Val, Ala, or Gly
  SITE (184)..(184): Xaa at position 184 is Val, Ala, Gly, Leu, or Ile
  SITE (186)..(186): Xaa at position 186 is Leu, Ala, Val, Gly, or Ile
  SITE (194)..(194): Xaa at position 194 is Leu, Ala, Val, Gly, or Ile
  SITE (196)..(196): Xaa at position 196 is Ala, Gly, or Pro
  SITE (203)..(203): Xaa at position 203 is Val, Ala, Gly, Leu, or Ile
  SITE (216)..(216): Xaa at position 216 is Ala, Gly, or Pro
  SITE (217)..(217): Xaa at position 217 is Phe, Tyr, Met, His, Ile, Leu, Val Ala, or Gly
  SITE (218)..(218): Xaa at position 218 is Phe, Tyr, Met, His, Ile, Leu, Val Ala, or Gly
  SITE (219)..(219): Xaa at position 219 is Val, Ala, Gly, Leu, or Ile
  SITE (227)..(227): Xaa at position 227 is Cys, Ala, Val, Gly, Ser, or Thr
  SITE (230)..(230): Xaa at position 230 is Phe, Tyr, Met, His, Ile, Leu, Val Ala, or Gly
  SITE (232)..(232): Xaa at position 232 is Cys, Ala, Val, Gly, Ser, or Thr
  SITE (240)..(240): Xaa at position 240 is Ile, Ala, Val, Leu, or Gly
  SITE (247)..(247): Xaa at position 247 is Leu, Ala, Val, Gly, or Ile
  SITE (248)..(248): Xaa at position 248 is Ala, Gly, or Pro
  SITE (265)..(265): Xaa at position 265 is Phe, Tyr, Met, His, Ile, Leu, Val Ala, or Gly
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLXSXSTYNDQSXTFALEDESYEIYVEDLKKDEKKDKXXXSYYESQHPSNESGDGVDGKMLXXTXSPTKDFWXHXNNKEHSXELHKCEKPLPDQXXXXLHNMHSNXVSXEXKTDPGVFXGVKDNHXXLIKVDSSENLCTENILXKLSET

SEQ ID NO: 83 - protein, 443 aa, Homo sapiens
  SITE (71)..(71): Xaa at position 71 is Cys, Ala, Val, Gly, Ser, or Thr
  SITE (109)..(109): Xaa at position 109 is Cys, Ala, Val, Gly, Ser, or Thr
  SITE (162)..(162): Xaa at position 162 is Cys, Ala, Val, Gly, Ser, or Thr
  SITE (241)..(241): Xaa at position 241 is Cys, Ala, Val, Gly, Ser, or Thr
  SITE (281)..(281): Xaa at position 281 is Cys, Ala, Val, Gly, Ser, or Thr
MLPCASCLPGSLLLWALLLLLLGSASPQDSEEPDSYTECTDGYEWDPDSQHCRDVNECLTIPEACKGEMKXINHYGGYLCLPRSAAVINDLHGEGPPPPVPPAQHPNPXPPGYEPDDQDSCVDVDECAQALHDCRPSQDCHNLPGSYQCTCPDGYRKIGPEXVDIDECRYRYCQHRCVNLPGSFRCQCEPGFQLGPNNRSCVDVNECDMGAPCEQRCFNSYGTFLCRCHQGYELHRDGFSXSDIDECSYSSYLCQYRCINEPGRFSCHCPQGYQLLATRLXQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 84 - protein, 134 aa, Homo sapiens
  SITE (17)..(17): Xaa at position 17 is Ile, Ala, Val, Leu, or Gly
  SITE (28)..(28): Xaa at position 28 is Leu, Ala, Val, Gly, or Ile
  SITE (29)..(29): Xaa at position 29 is Ile, Ala, Val, Leu, or Gly
  SITE (30)..(30): Xaa at position 30 is Leu, Ala, Val, Gly, or Ile
  SITE (34)..(34): Xaa at position 34 is Val, Ala, Gly, Leu, or Ile
  SITE (41)..(41): Xaa at position 41 is Leu, Ala, Val, Gly, or Ile
  SITE (51)..(51): Xaa at position 51 is Leu, Ala, Val, Gly, or Ile
  SITE (55)..(55): Xaa at position 55 is Ala, Gly, or Pro
  SITE (84)..(84): Xaa at position 84 is Leu, Ala, Val, Gly, or Ile
MAEQSDEAVKYYTLEEXQKHNHSKSTWXXXHHKXYDLTKFXEEHPGGEEVXREQXGGDATENFEDVGHSTDAREMSKTFIIGEXHPDDRPKLNKPPETLITTIDSSSSWWTNWVIPAISAVAVALMYRLYMAED

SEQ ID NO: 85 - protein, 332 aa, Homo sapiens
  SITE (23)..(23): Xaa at position 23 is Ile, Ala, Val, Leu, or Gly
  SITE (25)..(25): Xaa at position 25 is Val, Ala, Gly, Leu, or Ile
  SITE (26)..(26): Xaa at position 26 is Val, Ala, Gly, Leu, or Ile
  SITE (28)..(28): Xaa at position 28 is Val, Ala, Gly, Leu, or Ile
  SITE (34)..(34): Xaa at position 34 is Ala, Gly, or Pro
  SITE (35)..(35): Xaa at position 35 is Cys, Ala, Val, Gly, Ser, or Thr
  SITE (36)..(36): Xaa at position 36 is Ala, Gly, or Pro
  SITE (39)..(39): Xaa at position 39 is Ile, Ala, Val, Leu, or Gly
  SITE (40)..(40): Xaa at position 40 is Leu, Ala, Val, Gly, or Ile
  SITE (41)..(41): Xaa at position 41 is Met, Ile, Leu, Val, Ala, or Gly
  SITE (45)..(45): Xaa at position 45 is Ala, Gly, or Pro
  SITE (48)..(48): Xaa at position 48 is Leu, Ala, Val, Gly, or Ile
  SITE (49)..(49): Xaa at position 49 is Ala, Gly, or Pro
  SITE (50)..(50): Xaa at position 50 is Leu, Ala, Val, Gly, or Ile
  SITE (51)..(51): Xaa at position 51 is Val, Ala, Gly, Leu, or Ile
  SITE (58)..(58): Xaa at position 58 is Leu, Ala, Val, Gly, or Ile
  SITE (91)..(91): Xaa at position 91 is Leu, Ala, Val, Gly, or Ile
  SITE (92)..(92): Xaa at position 92 is Val, Ala, Gly, Leu, or Ile
  SITE (93)..(93): Xaa at position 93 is Ile, Ala, Val, Leu, or Gly
  SITE (94)..(94): Xaa at position 94 is Ile, Ala, Val, Leu, or Gly
  SITE (109)..(109): Xaa at position 109 is Leu, Ala, Val, Gly, or Ile
  SITE (110)..(110): Xaa at position 110 is Val, Ala, Gly, Leu, or Ile
  SITE (114)..(114): Xaa at position 114 is Val, Ala, Gly, Leu, or Ile
  SITE (117)..(117): Xaa at position 117 is Phe, Tyr, Met, His, Ile, Leu, Val Ala, or Gly
  SITE (119)..(119): Xaa at position 119 is Phe, Tyr, Met, His, Ile, Leu, Val Ala, or Gly
  SITE (120)..(120): Xaa at position 120 is Ile, Ala, Val, Leu, or Gly
  SITE (121)..(121): Xaa at position 121 is Ile, Ala, Val, Leu, or Gly
  SITE (124)..(124): Xaa at position 124 is Val, Ala, Gly, Leu, or Ile
  SITE (131)..(131): Xaa at position 131 is Cys, Ala, Val, Gly, Ser, or Thr
  SITE (133)..(133): Xaa at position 133 is Leu, Ala, Val, Gly, or Ile
  SITE (134)..(134): Xaa at position 134 is Leu, Ala, Val, Gly, or Ile
  SITE (135)..(135): Xaa at position 135 is Ile, Ala, Val, Leu, or Gly
  SITE (136)..(136): Xaa at position 136 is Val, Ala, Gly, Leu, or Ile
  SITE (140)..(140): Xaa at position 140 is Val, Ala, Gly, Leu, or Ile
  SITE (142)..(142): Xaa at position 142 is Ile, Ala, Val, Leu, or Gly
  SITE (143)..(143): Xaa at position 143 is Leu, Ala, Val, Gly, or Ile
  SITE (146)..(146): Xaa at position 146 is Val, Ala, Gly, Leu, or Ile
  SITE (147)..(147): Xaa at position 147 is Ala, Gly, or Pro
  SITE (158)..(158): Xaa at position 158 is Val, Ala, Gly, Leu, or Ile
  SITE (159)..(159): Xaa at position 159 is Ile, Ala, Val, Leu, or Gly
  SITE (163)..(163): Xaa at position 163 is Cys, Ala, Val, Gly, Ser, or Thr
  SITE (170)..(170): Xaa at position 170 is Phe, Tyr, Met, His, Ile, Leu, Val Ala, or Gly
  SITE (174)..(174): Xaa at position 174 is Met, Ile, Leu, Val, Ala, or Gly
  SITE (185)..(185): Xaa at position 185 is Cys, Ala, Val, Gly, Ser, or Thr
  SITE (189)..(189): Xaa at position 189 is Val, Ala, Gly, Leu, or Ile
  SITE (190)..(190): Xaa at position 190 is Leu, Ala, Val, Gly, or Ile
  SITE (198)..(198): Xaa at position 198 is Val, Ala, Gly, Leu, or Ile
  SITE (200)..(200): Xaa at position 200 is Val, Ala, Gly, Leu, or Ile
  SITE (204)..(204): Xaa at position 204 is Met, Ile, Leu, Val, Ala, or Gly
  SITE (206)..(206): Xaa at position 206 is Val, Ala, Gly, Leu, or Ile
  SITE (218)..(218): Xaa at position 218 is Leu, Ala, Val, Gly, or Ile
  SITE (230)..(230): Xaa at position 230 is Val, Ala, Gly, Leu, or Ile
  SITE (234)..(234): Xaa at position 234 is Val, Ala, Gly, Leu, or Ile
  SITE (256)..(256): Xaa at position 256 is Val, Ala, Gly, Leu, or Ile
  SITE (257)..(257): Xaa at position 257 is Ala, Gly, or Pro
  SITE (259)..(259): Xaa at position 259 is Leu, Ala, Val, Gly, or Ile
  SITE (260)..(260): Xaa at position 260 is Ala, Gly, or Pro
  SITE (263)..(263): Xaa at position 263 is Ile, Ala, Val, Leu, or Gly
  SITE (273)..(273): Xaa at position 273 is Val, Ala, Gly, Leu, or Ile
  SITE (277)..(277): Xaa at position 277 is Ile, Ala, Val, Leu, or Gly
  SITE (283)..(283): Xaa at position 283 is Ile, Ala, Val, Leu, or Gly
  SITE (287)..(287): Xaa at position 287 is Val, Ala, Gly, Leu, or Ile
  SITE (288)..(288): Xaa at position 288 is Phe, Tyr, Met, His, Ile, Leu, Val Ala, or Gly
  SITE (289)..(289): Xaa at position 289 is Leu, Ala, Val, Gly, or Ile
  SITE (291)..(291): Xaa at position 291 is Val, Ala, Gly, Leu, or Ile
  SITE (293)..(293): Xaa at position 293 is Cys, Ala, Val, Gly, Ser, or Thr
  SITE (295)..(295): Xaa at position 295 is Leu, Ala, Val, Gly, or Ile
  SITE (316)..(316): Xaa at position 316 is Leu, Ala, Val, Gly, or Ile
  SITE (320)..(320): Xaa at position 320 is Ala, Gly, or Pro
  SITE (323)..(323): Xaa at position 323 is Leu, Ala, Val, Gly, or Ile
MATLKDQLIYNLLKEEQTPQNKXTXXGXGAVGMXXXISXXXKDLXDEXXXXDVIEDKXKGEMMDLQHGSLFLRTPKIVSGKDYNVTANSKXXXXTAGARQQEGESRLNXXQRNXNIXKXXXPNXVKYSPNXKXXXXSNPXDXXTYXXWKISGFPKNRXXGSGXNLDSARXRYLXGERLGVHPLSXHGWXXGEHGDSSXPXWSGXNXAGVSLKTLHPDXGTDKDKEQWKEXHKQXVESAYEVIKLKGYTSWAIGLSXXDXXESXMKNLRRVHPXSTMXKGLYGXKDDXXXSXPXIXGQNGISDLVKVTLTSEEEARXKKSXDTXWGIQKELQF

SEQ ID NO: 86 - protein, 301 aa, Homo sapiens
  SITE (45)..(45): Xaa at position 45 is Leu, Ala, Val, Gly, or Ile
  SITE (47)..(47): Xaa at position 47 is Leu, Ala, Val, Gly, or Ile
  SITE (60)..(60): Xaa at position 60 is Phe, Tyr, Met, His, Ile, Leu, Val Ala, or Gly
  SITE (62)..(62): Xaa at position 62 is Phe, Tyr, Met, His, Ile, Leu, Val Ala, or Gly
  SITE (71)..(71): Xaa at position 71 is Leu, Ala, Val, Gly, or Ile
  SITE (73)..(73): Xaa at position 73 is Leu, Ala, Val, Gly, or Ile
  SITE (79)..(79): Xaa at position 79 is Ile, Ala, Val, Leu, or Gly
  SITE (81)..(81): Xaa at position 81 is Leu, Ala, Val, Gly, or Ile
  SITE (106)..(106): Xaa at position 106 is Val, Ala, Gly, Leu, or Ile
  SITE (108)..(108): Xaa at position 108 is Leu, Ala, Val, Gly, or Ile
  SITE (109)..(109): Xaa at position 109 is Val, Ala, Gly, Leu, or Ile
  SITE (110)..(110): Xaa at position 110 is Ile, Ala, Val, Leu, or Gly
  SITE (127)..(127): Xaa at position 127 is Met, Ile, Leu, Val, Ala, or Gly
  SITE (131)..(131): Xaa at position 131 is Leu, Ala, Val, Gly, or Ile
  SITE (142)..(142): Xaa at position 142 is Phe, Tyr, Met, His, Ile, Leu, Val Ala, or Gly
  SITE (149)..(149): Xaa at position 149 is Leu, Ala, Val, Gly, or Ile
  SITE (157)..(157): Xaa at position 157 is Phe, Tyr, Met, His, Ile, Leu, Val Ala, or Gly
  SITE (175)..(175): Xaa at position 175 is Val, Ala, Gly, Leu, or Ile
  SITE (177)..(177): Xaa at position 177 is Met, Ile, Leu, Val, Ala, or Gly
  SITE (178)..(178): Xaa at position 178 is Ile, Ala, Val, Leu, or Gly
  SITE (179)..(179): Xaa at position 179 is Ala, Gly, or Pro
  SITE (184)..(184): Xaa at position 184 is Ile, Ala, Val, Leu, or Gly
  SITE (187)..(187): Xaa at position 187 is Met, Ile, Leu, Val, Ala, or Gly
  SITE (188)..(188): Xaa at position 188 is Leu, Ala, Val, Gly, or Ile
  SITE (190)..(190): Xaa at position 190 is Val, Ala, Gly, Leu, or Ile
  SITE (191)..(191): Xaa at position 191 is Ile, Ala, Val, Leu, or Gly
  SITE (194)..(194): Xaa at position 194 is Ile, Ala, Val, Leu, or Gly
  SITE (204)..(204): Xaa at position 204 is Cys, Ala, Val, Gly, Ser, or Thr
  SITE (206)..(206): Xaa at position 206 is Leu, Ala, Val, Gly, or Ile
  SITE (207)..(207): Xaa at position 207 is Leu, Ala, Val, Gly, or Ile
  SITE (208)..(208): Xaa at position 208 is Phe, Tyr, Met, His, Ile, Leu, Val Ala, or Gly
  SITE (216)..(216): Xaa at position 216 is Ile, Ala, Val, Leu, or Gly
  SITE (217)..(217): Xaa at position 217 is Leu, Ala, Val, Gly, or Ile
  SITE (218)..(218): Xaa at position 218 is Leu, Ala, Val, Gly, or Ile
  SITE (222)..(222): Xaa at position 222 is Leu, Ala, Val, Gly, or Ile
  SITE (233)..(233): Xaa at position 233 is Phe, Tyr, Met, His, Ile, Leu, Val Ala, or Gly
  SITE (237)..(237): Xaa at position 237 is Tyr, Phe, Met, His, Ile, Leu, Val Ala, or Gly
  SITE (239)..(239): Xaa at position 239 is Leu, Ala, Val, Gly, or Ile
  SITE (258)..(258): Xaa at position 258 is Ile, Ala, Val, Leu, or Gly
  SITE (270)..(270): Xaa at position 270 is Leu, Ala, Val, Gly, or Ile
  SITE (271)..(271): Xaa at position 271 is Val, Ala, Gly, Leu, or Ile
  SITE (272)..(272): Xaa at position 272 is Leu, Ala, Val, Gly, or Ile
  SITE (273)..(273): Xaa at position 273 is Met, Ile, Leu, Val, Ala, or Gly
  SITE (284)..(284): Xaa at position 284 is Cys, Ala, Val, Gly, Ser, or Thr
  SITE (288)..(288): Xaa at position 288 is Leu, Ala, Val, Gly, or Ile
MGAQLSTLGHMVLFPVWFLYSLLMKLFQRSTPAITLESPDIKYPXRXIDREIISHDTRRXRXALPSPQHIXGXPVGQHXYXSARIDGNLVVRPYTPISSDDDKGFXDXXXKVYFKDTHPKFPAGGKXSQYXESMQIGDTIEXRGPSGLXVYQGKGKXAIRPDKKSNPIIRTVKSXGXXXGGTGXTPXXQXXRAXMKDPDDHTVXHXXXANQTEKDXXXRPEXEELRNKHSARXKLWXTXDRAPEAWDYGQGFVNEEMXRDHLPPPEEEPXXXXCGPPPMIQYAXLPNXDHVGHPTERCFVF

SEQ ID NO: 87 - protein, 227 aa, Homo sapiens
  SITE (83)..(83): Xaa at position 83 is Ile, Ala, Val, Leu, or Gly
  SITE (97)..(97): Xaa at position 97 is Ile, Ala, Val, Leu, or Gly
  SITE (106)..(106): Xaa at position 106 is Trp, Tyr, Phe, Met, His, Ile, Leu Val, Ala, or Gly
  SITE (108)..(108): Xaa at position 108 is Tyr, Phe, Met, His, Ile, Leu, Val Ala, or Gly
  SITE (142)..(142): Xaa at position 142 is Val, Ala, Gly, Leu, or Ile
  SITE (144)..(144): Xaa at position 144 is Leu, Ala, Val, Gly, or Ile
  SITE (150)..(150): Xaa at position 150 is Ile, Ala, Val, Leu, or Gly
  SITE (152)..(152): Xaa at position 152 is Met, Ile, Leu, Val, Ala, or Gly
  SITE (154)..(154): Xaa at position 154 is Ile, Ala, Val, Leu, or Gly
  SITE (161)..(161): Xaa at position 161 is His, Phe, Tyr, Lys, Arg, Gly, Ser Thr, Ala, Val, Leu, Ile, Asn, Met, or Gln
  SITE (163)..(163): Xaa at position 163 is Trp, Tyr, Phe, Met, His, Ile, Leu Val, Ala, or Gly
  SITE (164)..(164): Xaa at position 164 is Ala, Gly, or Pro
  SITE (165)..(165): Xaa at position 165 is Val, Ala, Gly, Leu, or Ile
  SITE (168)..(168): Xaa at position 168 is Leu, Ala, Val, Gly, or Ile
  SITE (174)..(174): Xaa at position 174 is Ala, Gly, or Pro
  SITE (184)..(184): Xaa at position 184 is Phe, Tyr, Met, His, Ile, Leu, Val Ala, or Gly
  SITE (207)..(207): Xaa at position 207 is Met, Ile, Leu, Val, Ala, or Gly
  SITE (209)..(209): Xaa at position 209 is Ile, Ala, Val, Leu, or Gly
  SITE (210)..(210): Xaa at position 210 is Val, Ala, Gly, Leu, or Ile
  SITE (211)..(211): Xaa at position 211 is Leu, Ala, Val, Gly, or Ile
MAHAAQVGLQDATSPIMEELITFHDHALMIIFLICFLVLYALFLTLTTKLTNTNISDAQEMETVWTILPAIILVLIALPSLRXLYMTDEVNDPSLTXKSIGHQWYXTXEYTDYGGLIFNSYMLPPLFLEPGDLRLLDVDNRXVXPIEAPXRXMXTSQDVLXSXXXPTXGLKTDXIPGRLNQTTXTATRPGVYYGQCSEICGANHSFXPXXXELIPLKIFEMGPVFTL

SEQ ID NO: 88 - protein, 452 aa, Homo sapiens
  SITE (34)..(34): Xaa at position 34 is Ala, Gly, or Pro
  SITE (35)..(35): Xaa at position 35 is Ile, Ala, Val, Leu, or Gly
  SITE (37)..(37): Xaa at position 37 is Leu, Ala, Val, Gly, or Ile
  SITE (39)..(39): Xaa at position 39 is Phe, Tyr, Met, His, Ile, Leu, Val Ala, or Gly
  SITE (51)..(51): Xaa at position 51 is Val, Ala, Gly, Leu, or Ile
  SITE (55)..(55): Xaa at position 55 is Phe, Tyr, Met, His, Ile, Leu, Val Ala, or Gly
  SITE (79)..(79): Xaa at position 79 is Phe, Tyr, Met, His, Ile, Leu, Val Ala, or Gly
  SITE (80)..(80): Xaa at position 80 is Phe, Tyr, Met, His, Ile, Leu, Val Ala, or Gly
  SITE (83)..(83): Xaa at position 83 is Leu, Ala, Val, Gly, or Ile
  SITE (91)..(91): Xaa at position 91 is Leu, Ala, Val, Gly, or Ile
  SITE (94)..(94): Xaa at position 94 is Ile, Ala, Val, Leu, or Gly
  SITE (98)..(98): Xaa at position 98 is Leu, Ala, Val, Gly, or Ile
  SITE (104)..(104): Xaa at position 104 is Ala, Gly, or Pro
  SITE (109)..(109): Xaa at position 109 is Leu, Ala, Val, Gly, or Ile
  SITE (120)..(120): Xaa at position 120 is Trp, Tyr, Phe, Met, His, Ile, Leu Val, Ala, or Gly
  SITE (125)..(125): Xaa at position 125 is Ile, Ala, Val, Leu, or Gly
  SITE (128)..(128): Xaa at position 128 is Leu, Ala, Val, Gly, or Ile
  SITE (131)..(131): Xaa at position 131 is Phe, Tyr, Met, His, Ile, Leu, Val Ala, or Gly
  SITE (132)..(132): Xaa at position 132 is Ala, Gly, or Pro
  SITE (165)..(165): Xaa at position 165 is Ala, Gly, or Pro
  SITE (187)..(187): Xaa at position 187 is Trp, Tyr, Phe, Met, His, Ile, Leu Val, Ala, or Gly
  SITE (190)..(190): Xaa at position 190 is Val, Ala, Gly, Leu, or Ile
  SITE (191)..(191): Xaa at position 191 is Phe, Tyr, Met, His, Ile, Leu, Val Ala, or Gly
  SITE (194)..(194): Xaa at position 194 is Leu, Ala, Val, Gly, or Ile
  SITE (202)..(202): Xaa at position 202 is Ala, Gly, or Pro
  SITE (203)..(203): Xaa at position 203 is Cys, Ala, Val, Gly, Ser, or Thr
  SITE (206)..(206): Xaa at position 206 is Tyr, Phe, Met, His, Ile, Leu, Val Ala, or Gly
  SITE (213)..(213): Xaa at position 213 is Leu, Ala, Val, Gly, or Ile
  SITE (219)..(219): Xaa at position 219 is Phe, Tyr, Met, His, Ile, Leu, Val Ala, or Gly
  SITE (224)..(224): Xaa at position 224 is Ile, Ala, Val, Leu, or Gly
  SITE (227)..(227): Xaa at position 227 is Leu, Ala, Val, Gly, or Ile
  SITE (230)..(230): Xaa at position 230 is Val, Ala, Gly, Leu, or Ile
  SITE (233)..(233): Xaa at position 233 is Phe, Tyr, Met, His, Ile, Leu, Val Ala, or Gly
  SITE (234)..(234): Xaa at position 234 is Leu, Ala, Val, Gly, or Ile
  SITE (240)..(240): Xaa at position 240 is Phe, Tyr, Met, His, Ile, Leu, Val Ala, or Gly
  SITE (255)..(255): Xaa at position 255 is Leu, Ala, Val, Gly, or Ile
  SITE (258)..(258): Xaa at position 258 is Leu, Ala, Val, Gly, or Ile
  SITE (259)..(259): Xaa at position 259 is Ala, Gly, or Pro
  SITE (260)..(260): Xaa at position 260 is Phe, Tyr, Met, His, Ile, Leu, Val Ala, or Gly
  SITE (262)..(262): Xaa at position 262 is Val, Ala, Gly, Leu, or Ile
  SITE (263)..(263): Xaa at position 263 is Phe, Tyr, Met, His, Ile, Leu, Val Ala, or Gly
  SITE (265)..(265): Xaa at position 265 is Cys, Ala, Val, Gly, Ser, or Thr
  SITE (268)..(268): Xaa at position 268 is Tyr, Phe, Met, His, Ile, Leu, Val Ala, or Gly
  SITE (269)..(269): Xaa at position 269 is Ile, Ala, Val, Leu, or Gly
  SITE (283)..(283): Xaa at position 283 is Ile, Ala, Val, Leu, or Gly
  SITE (284)..(284): Xaa at position 284 is Cys, Ala, Val, Gly, Ser, or Thr
  SITE (287)..(287): Xaa at position 287 is Leu, Ala, Val, Gly, or Ile
  SITE (288)..(288): Xaa at position 288 is Leu, Ala, Val, Gly, or Ile
  SITE (290)..(290): Xaa at position 290 is His, Phe, Tyr, Lys, Arg, Gly, Ser Thr, Ala, Val, Leu, Ile, Asn, Met, or Gln
  SITE (291)..(291): Xaa at position 291 is Val, Ala, Gly, Leu, or Ile
  SITE (293)..(293): Xaa at position 293 is Leu, Ala, Val, Gly, or Ile
  SITE (294)..(294): Xaa at position 294 is Phe, Tyr, Met, His, Ile, Leu, Val Ala, or Gly
  SITE (299)..(299): Xaa at position 299 is Phe, Tyr, Met, His, Ile, Leu, Val Ala, or Gly
  SITE (300)..(300): Xaa at position 300 is Ala, Gly, or Pro
  SITE (302)..(302): Xaa at position 302 is Phe, Tyr, Met, His, Ile, Leu, Val Ala, or Gly
  SITE (306)..(306): Xaa at position 306 is Ile, Ala, Val, Leu, or Gly
  SITE (309)..(309): Xaa at position 309 is Ala, Gly, or Pro
  SITE (311)..(311): Xaa at position 311 is Leu, Ala, Val, Gly, or Ile
  SITE (313)..(313): Xaa at position 313 is Ala, Gly, or Pro
  SITE (318)..(318): Xaa at position 318 is Ile, Ala, Val, Leu, or Gly
  SITE (321)..(321): Xaa at position 321 is Leu, Ala, Val, Gly, or Ile
  SITE (322)..(322): Xaa at position 322 is Ala, Gly, or Pro
  SITE (324)..(324): Xaa at position 324 is Ile, Ala, Val, Leu, or Gly
  SITE (327)..(327): Xaa at position 327 is Phe, Tyr, Met, His, Ile, Leu, Val Ala, or Gly
  SITE (329)..(329): Xaa at position 329 is Val, Ala, Gly, Leu, or Ile
  SITE (333)..(333): Xaa at position 333 is Leu, Ala, Val, Gly, or Ile
  SITE (340)..(340): Xaa at position 340 is Ile, Ala, Val, Leu, or Gly
  SITE (342)..(342): Xaa at position 342 is Ala, Gly, or Pro
  SITE (343)..(343): Xaa at position 343 is Tyr, Phe, Met, His, Ile, Leu, Val Ala, or Gly
  SITE (345)..(345): Xaa at position 345 is Ala, Gly, or Pro
  SITE (347)..(347): Xaa at position 347 is Leu, Ala, Val, Gly, or Ile
  SITE (348)..(348): Xaa at position 348 is Leu, Ala, Val, Gly, or Ile
  SITE (354)..(354): Xaa at position 354 is Leu, Ala, Val, Gly, or Ile
  SITE (357)..(357): Xaa at position 357 is Cys, Ala, Val, Gly, Ser, or Thr
  SITE (373)..(373): Xaa at position 373 is Ala, Gly, or Pro
  SITE (385)..(385): Xaa at position 385 is Leu, Ala, Val, Gly, or Ile
  SITE (386)..(386): Xaa at position 386 is Tyr, Phe, Met, His, Ile, Leu, Val Ala, or Gly
  SITE (387)..(387): Xaa at position 387 is Tyr, Phe, Met, His, Ile, Leu, Val Ala, or Gly
  SITE (389)..(389): Xaa at position 389 is Ala, Gly, or Pro
  SITE (395)..(395): Xaa at position 395 is Ala, Gly, or Pro
  SITE (399)..(399): Xaa at position 399 is Val, Ala, Gly, Leu, or Ile
  SITE (402)..(402): Xaa at position 402 is Phe, Tyr, Met, His, Ile, Leu, Val Ala, or Gly
  SITE (403)..(403): Xaa at position 403 is Ala, Gly, or Pro
  SITE (406)..(406): Xaa at position 406 is Ile, Ala, Val, Leu, or Gly
  SITE (410)..(410): Xaa at position 410 is Phe, Tyr, Met, His, Ile, Leu, Val Ala, or Gly
  SITE (421)..(421): Xaa at position 421 is Ile, Ala, Val, Leu, or Gly
  SITE (424)..(424): Xaa at position 424 is Leu, Ala, Val, Gly, or Ile
  SITE (432)..(432): Xaa at position 432 is Ile, Ala, Val, Leu, or Gly
  SITE (434)..(434): Xaa at position 434 is Ala, Gly, or Pro
MSTAVLENPGLGRKLSDFGQETSYIEDNCNQNGXXSXIXSLKEEVGALAKXLRLXEENDVNLTHIESRPSRLKKDEYEXXTHXDKRSLPAXTNXIKIXRHDIGXTVHEXSRDKKKDTVPXFPRTXQEXDRXXNQILSYGAELDADHPGFKDPVYRARRKQFADIXYNYRHGQPIPRVEYMEEEKKTXGTXXKTXKSLYKTHXXYEXNHIFPLXEKYCGXHEDNXPQXEDXSQXXQTCTGXRLRPVAGLLSSRDFXGGXXXRXXHXTQXXRHGSKPMYTPEPDXXHEXXGXXPXXSDRSXXQXSQEXGLXSXGXPDEYXEKXXTXYWXTXEFGXCKQGDSXKXXGXGXXSSFGEXQYXLSEKPKLLPLELEKTXIQNYTVTEFQPXXXVXESFNDXKEKXRNXXATXPRPXSVRYDPYTQRXEVXDNTQQLKXLXDSINSEIGILCSALQKIK

SEQ ID NO: 89 - protein, 154 aa, Homo sapiens
  SITE (5)..(5): Xaa at position 5 is Ala, Gly, or Pro
  SITE (7)..(7): Xaa at position 7 is Cys, Ala, Val, Gly, Ser, or Thr
  SITE (9)..(9): Xaa at position 9 is Leu, Ala, Val, Gly, or Ile
  SITE (15)..(15): Xaa at position 15 is Val, Ala, Gly, Leu, or Ile
  SITE (18)..(18): Xaa at position 18 is Ile, Ala, Val, Leu, or Gly
  SITE (19)..(19): Xaa at position 19 is Ile, Ala, Val, Leu, or Gly
  SITE (21)..(21): Xaa at position 21 is Phe, Tyr, Met, His, Ile, Leu, Val Ala, or Gly
  SITE (30)..(30): Xaa at position 30 is Val, Ala, Gly, Leu, or Ile
  SITE (32)..(32): Xaa at position 32 is Val, Ala, Gly, Leu, or Ile
  SITE (36)..(36): Xaa at position 36 is Ile, Ala, Val, Leu, or Gly
  SITE (39)..(39): Xaa at position 39 is Leu, Ala, Val, Gly, or Ile
  SITE (44)..(44): Xaa at position 44 is His, Phe, Tyr, Lys, Arg, Gly, Ser Thr, Ala, Val, Leu, Ile, Asn, Met, or Gln
  SITE (46)..(46): Xaa at position 46 is Phe, Tyr, Met, His, Ile, Leu, Val Ala, or Gly
  SITE (47)..(47): Xaa at position 47 is His, Phe, Tyr, Lys, Arg, Gly, Ser Thr, Ala, Val, Leu, Ile, Asn, Met, or Gln
  SITE (48)..(48): Xaa at position 48 is Val, Ala, Gly, Leu, or Ile
  SITE (49)..(49): Xaa at position 49 is His, Phe, Tyr, Lys, Arg, Gly, Ser Thr, Ala, Val, Leu, Ile, Asn, Met, or Gln
  SITE (61)..(61): Xaa at position 61 is Ala, Gly, or Pro
  SITE (64)..(64): Xaa at position 64 is His, Phe, Tyr, Lys, Arg, Gly, Ser Thr, Ala, Val, Leu, Ile, Asn, Met, or Gln
  SITE (72)..(72): Xaa at position 72 is His, Phe, Tyr, Lys, Arg, Gly, Ser Thr, Ala, Val, Leu, Ile, Asn, Met, or Gln
  SITE (81)..(81): Xaa at position 81 is His, Phe, Tyr, Lys, Arg, Gly, Ser Thr, Ala, Val, Leu, Ile, Asn, Met, or Gln
  SITE (82)..(82): Xaa at position 82 is Val, Ala, Gly, Leu, or Ile
  SITE (85)..(85): Xaa at position 85 is Leu, Ala, Val, Gly, or Ile
  SITE (88)..(88): Xaa at position 88 is Val, Ala, Gly, Leu, or Ile
  SITE (90)..(90): Xaa at position 90 is Ala, Gly, or Pro
  SITE (96)..(96): Xaa at position 96 is Ala, Gly, or Pro
  SITE (98)..(98): Xaa at position 98 is Val, Ala, Gly, Leu, or Ile
  SITE (104)..(104): Xaa at position 104 is Val, Ala, Gly, Leu, or Ile
  SITE (105)..(105): Xaa at position 105 is Ile, Ala, Val, Leu, or Gly
  SITE (107)..(107): Xaa at position 107 is Leu, Ala, Val, Gly, or Ile
  SITE (113)..(113): Xaa at position 113 is Ile, Ala, Val, Leu, or Gly
  SITE (114)..(114): Xaa at position 114 is Ile, Ala, Val, Leu, or Gly
  SITE (118)..(118): Xaa at position 118 is Leu, Ala, Val, Gly, or Ile
  SITE (119)..(119): Xaa at position 119 is Val, Ala, Gly, Leu, or Ile
  SITE (120)..(120): Xaa at position 120 is Val, Ala, Gly, Leu, or Ile
  SITE (121)..(121): Xaa at position 121 is His, Phe, Tyr, Lys, Arg, Gly, Ser Thr, Ala, Val, Leu, Ile, Asn, Met, or Gln
  SITE (141)..(141): Xaa at position 141 is Ala, Gly, or Pro
  SITE (146)..(146): Xaa at position 146 is Ala, Gly, or Pro
  SITE (147)..(147): Xaa at position 147 is Cys, Ala, Val, Gly, Ser, or Thr
  SITE (150)..(150): Xaa at position 150 is Ile, Ala, Val, Leu, or Gly
MATKXVXVXKGDGPXQGXXNXEQKESNGPXKXWGSXKGXTEGLXGXXXXEFGDNTAGCTSXGPXFNPLSRKXGGPKDEERXXGDXGNXTXDKDGVXDXSIEDSXXSXSGDHCXXGRTXXXXEKADDLGKGGNEESTKTGNXGSRLXXGVXGIAQ

SEQ ID NO: 90 - protein, 2351 aa, Homo sapiens
  SITE (26)..(26): Xaa at position 26 is Leu, Ala, Val, Gly, or Ile
  SITE (28)..(28): Xaa at position 28 is Ala, Gly, or Pro
  SITE (90)..(90): Xaa at position 90 is Leu, Ala, Val, Gly, or Ile
  SITE (91)..(91): Xaa at position 91 is Leu, Ala, Val, Gly, or Ile
  SITE (95)..(95): Xaa at position 95 is Ile, Ala, Val, Leu, or Gly
  SITE (105)..(105): Xaa at position 105 is Ile, Ala, Val, Leu, or Gly
  SITE (107)..(107): Xaa at position 107 is Leu, Ala, Val, Gly, or Ile
  SITE (115)..(115): Xaa at position 115 is Val, Ala, Gly, Leu, or Ile
  SITE (117)..(117): Xaa at position 117 is Leu, Ala, Val, Gly, or Ile
  SITE (119)..(119): Xaa at position 119 is Ala, Gly, or Pro
  SITE (131)..(131): Xaa at position 131 is Ala, Gly, or Pro
  SITE (147)..(147): Xaa at position 147 is Val, Ala, Gly, Leu, or Ile
  SITE (155)..(155): Xaa at position 155 is Tyr, Phe, Met, His, Ile, Leu, Val Ala, or Gly
  SITE (157)..(157): Xaa at position 157 is Trp, Tyr, Phe, Met, His, Ile, Leu Val, Ala, or Gly
  SITE (177)..(177): Xaa at position 177 is Tyr, Phe, Met, His, Ile, Leu, Val Ala, or Gly
  SITE (191)..(191): Xaa at position 191 is Leu, Ala, Val, Gly, or Ile
  SITE (192)..(192): Xaa at position 192 is Ile, Ala, Val, Leu, or Gly
  SITE (194)..(194): Xaa at position 194 is Ala, Gly, or Pro
  SITE (196)..(196): Xaa at position 196 is Leu, Ala, Val, Gly, or Ile
  SITE (197)..(197): Xaa at position 197 is Val, Ala, Gly, Leu, or Ile
  SITE (198)..(198): Xaa at position 198 is Cys, Ala, Val, Gly, Ser, or Thr
  SITE (217)..(217): Xaa at position 217 is Leu, Ala, Val, Gly, or Ile
  SITE (218)..(218): Xaa at position 218 is Phe, Tyr, Met, His, Ile, Leu, Val Ala, or Gly
  SITE (219)..(219): Xaa at position 219 is Ala, Gly, or Pro
  SITE (221)..(221): Xaa at position 221 is Phe, Tyr, Met, His, Ile, Leu, Val Ala, or Gly
  SITE (251)..(251): Xaa at position 251 is His, Phe, Tyr, Lys, Arg, Gly, Ser Thr, Ala, Val, Leu, Ile, Asn, Met, or Gln
  SITE (253)..(253): Xaa at position 253 is Val, Ala, Gly, Leu, or Ile
  SITE (256)..(256): Xaa at position 256 is Tyr, Phe, Met, His, Ile, Leu, Val Ala, or Gly
  SITE (272)..(272): Xaa at position 272 is Val, Ala, Gly, Leu, or Ile
  SITE (274)..(274): Xaa at position 274 is Trp, Tyr, Phe, Met, His, Ile, Leu Val, Ala, or Gly
  SITE (276)..(276): Xaa at position 276 is Val, Ala, Gly, Leu, or Ile
  SITE (277)..(277): Xaa at position 277 is Ile, Ala, Val, Leu, or Gly
  SITE (288)..(288): Xaa at position 288 is Ile, Ala, Val, Leu, or Gly
  SITE (295)..(295): Xaa at position 295 is Phe, Tyr, Met, His, Ile, Leu, Val Ala, or Gly
  SITE (307)..(307): Xaa at position 307 is Ile, Ala, Val, Leu, or Gly
  SITE (315)..(315): Xaa at position 315 is Ala, Gly, or Pro
  SITE (319)..(319): Xaa at position 319 is Leu, Ala, Val, Gly, or Ile
  SITE (329)..(329): Xaa at position 329 is Cys, Ala, Val, Gly, Ser, or Thr
  SITE (339)..(339): Xaa at position 339 is Met, Ile, Leu, Val, Ala, or Gly
  SITE (341)..(341): Xaa at position 341 is Ala, Gly, or Pro
  SITE (343)..(343): Xaa at position 343 is Val, Ala, Gly, Leu, or Ile
  SITE (345)..(345): Xaa at position 345 is Val, Ala, Gly, Leu, or Ile
  SITE (405)..(405): Xaa at position 405 is Ile, Ala, Val, Leu, or Gly
  SITE (406)..(406): Xaa at position 406 is Ala, Gly, or Pro
  SITE (407)..(407): Xaa at position 407 is Ala, Gly, or Pro
  SITE (414)..(414): Xaa at position 414 is Tyr, Phe, Met, His, Ile, Leu, Val Ala, or Gly
  SITE (415)..(415): Xaa at position 415 is Ala, Gly, or Pro
  SITE (431)..(431): Xaa at position 431 is Leu, Ala, Val, Gly, or Ile
  SITE (442)..(442): Xaa at position 442 is Tyr, Phe, Met, His, Ile, Leu, Val Ala, or Gly
  SITE (445)..(445): Xaa at position 445 is Val, Ala, Gly, Leu, or Ile
  SITE (447)..(447): Xaa at position 447 is Phe, Tyr, Met, His, Ile, Leu, Val Ala, or Gly
  SITE (467)..(467): Xaa at position 467 is Ile, Ala, Val, Leu, or Gly
  SITE (472)..(472): Xaa at position 472 is Leu, Ala, Val, Gly, or Ile
  SITE (480)..(480): Xaa at position 480 is Leu, Ala, Val, Gly, or Ile
  SITE (482)..(482): Xaa at position 482 is Ile, Ala, Val, Leu, or Gly
  SITE (484)..(484): Xaa at position 484 is Phe, Tyr, Met, His, Ile, Leu, Val Ala, or Gly
  SITE (492)..(492): Xaa at position 492 is Tyr, Phe, Met, His, Ile, Leu, Val Ala, or Gly
  SITE (494)..(494): Xaa at position 494 is Ile, Ala, Val, Leu, or Gly
  SITE (517)..(517): Xaa at position 517 is Leu, Ala, Val, Gly, or Ile
  SITE (530)..(530): Xaa at position 530 is Tyr, Phe, Met, His, Ile, Leu, Val Ala, or Gly
  SITE (532)..(532): Xaa at position 532 is Trp, Tyr, Phe, Met, His, Ile, Leu Val, Ala, or Gly
  SITE (552)..(552): Xaa at position 552 is Tyr, Phe, Met, His, Ile, Leu, Val Ala, or Gly
  SITE (566)..(566): Xaa at position 566 is Leu, Ala, Val, Gly, or Ile
  SITE (567)..(567): Xaa at position 567 is Ile, Ala, Val, Leu, or Gly
  SITE (570)..(570): Xaa at position 570 is Leu, Ala, Val, Gly, or Ile
  SITE (571)..(571): Xaa at position 571 is Leu, Ala, Val, Gly, or Ile
  SITE (572)..(572): Xaa at position 572 is Ile, Ala, Val, Leu, or Gly
  SITE (573)..(573): Xaa at position 573 is Cys, Ala, Val, Gly, Ser, or Thr
  SITE (594)..(594): Xaa at position 594 is Leu, Ala, Val, Gly, or Ile
  SITE (595)..(595): Xaa at position 595 is Phe, Tyr, Met, His, Ile, Leu, Val Ala, or Gly
  SITE (598)..(598): Xaa at position 598 is Phe, Tyr, Met, His, Ile, Leu, Val Ala, or Gly
  SITE (605)..(605): Xaa at position 605 is Tyr, Phe, Met, His, Ile, Leu, Val Ala, or Gly
  SITE (633)..(633): Xaa at position 633 is Met, Ile, Leu, Val, Ala, or Gly
  SITE (636)..(636): Xaa at position 636 is Ile, Ala, Val, Leu, or Gly
  SITE (640)..(640): Xaa at position 640 is Val, Ala, Gly, Leu, or Ile
  SITE (648)..(648): Xaa at position 648 is Val, Ala, Gly, Leu, or Ile
  SITE (656)..(656): Xaa at position 656 is Trp, Tyr, Phe, Met, His, Ile, Leu Val, Ala, or Gly
  SITE (658)..(658): Xaa at position 658 is Ile, Ala, Val, Leu, or Gly
  SITE (670)..(670): Xaa at position 670 is Val, Ala, Gly, Leu, or Ile
  SITE (677)..(677): Xaa at position 677 is Phe, Tyr, Met, His, Ile, Leu, Val Ala, or Gly
  SITE (689)..(689): Xaa at position 689 is Leu, Ala, Val, Gly, or Ile
  SITE (697)..(697): Xaa at position 697 is Val, Ala, Gly, Leu, or Ile
  SITE (699)..(699): Xaa at position 699 is Met, Ile, Leu, Val, Ala, or Gly
  SITE (701)..(701): Xaa at position 701 is Met, Ile, Leu, Val, Ala, or Gly
  SITE (709)..(709): Xaa at position 709 is Leu, Ala, Val, Gly, or Ile
  SITE (711)..(711): Xaa at position 711 is Cys, Ala, Val, Gly, Ser, or Thr
  SITE (721)..(721): Xaa at position 721 is Met, Ile, Leu, Val, Ala, or Gly
  SITE (723)..(723): Xaa at position 723 is Ala, Gly, or Pro
  SITE (725)..(725): Xaa at position 725 is Leu, Ala, Val, Gly, or Ile
  SITE (1719)..(1719): Xaa at position 1719 is Ile, Ala, Val, Leu, or Gly
  SITE (1720)..(1720): Xaa at position 1720 is Ala, Gly, or Pro
  SITE (1721)..(1721): Xaa at position 1721 is Ala, Gly, or Pro
  SITE (1752)..(1752): Xaa at position 1752 is Val, Ala, Gly, Leu, or Ile
  SITE (1753)..(1753): Xaa at position 1753 is Val, Ala, Gly, Leu, or Ile
  SITE (1754)..(1754): Xaa at position 1754 is Phe, Tyr, Met, His, Ile, Leu Val, Ala, or Gly
  SITE (1774)..(1774): Xaa at position 1774 is His, Phe, Tyr, Lys, Arg, Gly Ser, Thr, Ala, Val, Leu, Ile, Asn, Met, or Gln
  SITE (1775)..(1775): Xaa at position 1775 is Leu, Ala, Val, Gly, or Ile
  SITE (1777)..(1777): Xaa at position 1777 is Leu, Ala, Val, Gly, or Ile
  SITE (1778)..(1778): Xaa at position 1778 is Leu, Ala, Val, Gly, or Ile
  SITE (1782)..(1782): Xaa at position 1782 is Ile, Ala, Val, Leu, or Gly
  SITE (1784)..(1784): Xaa at position 1784 is Ala, Gly, or Pro
  SITE (1790)..(1790): Xaa at position 1790 is Ile, Ala, Val, Leu, or Gly
  SITE (1792)..(1792): Xaa at position 1792 is Val, Ala, Gly, Leu, or Ile
  SITE (1794)..(1794): Xaa at position 1794 is Phe, Tyr, Met, His, Ile, Leu Val, Ala, or Gly
  SITE (1802)..(1802): Xaa at position 1802 is Tyr, Phe, Met, His, Ile, Leu Val, Ala, or Gly
  SITE (1804)..(1804): Xaa at position 1804 is Phe, Tyr, Met, His, Ile, Leu Val, Ala, or Gly
  SITE (1826)..(1826): Xaa at position 1826 is Val, Ala, Gly, Leu, or Ile
  SITE (1836)..(1836): Xaa at position 1836 is Trp, Tyr, Phe, Met, His, Ile Leu, Val, Ala, or Gly
  SITE (1838)..(1838): Xaa at position 1838 is Val, Ala, Gly, Leu, or Ile
  SITE (1842)..(1842): Xaa at position 1842 is Met, Ile, Leu, Val, Ala, or Gly
  SITE (1851)..(1851): Xaa at position 1851 is Cys, Ala, Val, Gly, Ser, or Thr
  SITE (1853)..(1853): Xaa at position 1853 is Ala, Gly, or Pro
  SITE (1856)..(1856): Xaa at position 1856 is Tyr, Phe, Met, His, Ile, Leu Val, Ala, or Gly
  SITE (1867)..(1867): Xaa at position 1867 is His, Phe, Tyr, Lys, Arg, Gly Ser, Thr, Ala, Val, Leu, Ile, Asn, Met, or Gln
  SITE (1870)..(1870): Xaa at position 1870 is Leu, Ala, Val, Gly, or Ile
  SITE (1871)..(1871): Xaa at position 1871 is Ile, Ala, Val, Leu, or Gly
  SITE (1874)..(1874): Xaa at position 1874 is Leu, Ala, Val, Gly, or Ile
  SITE (1875)..(1875): Xaa at position 1875 is Leu, Ala, Val, Gly, or Ile
  SITE (1876)..(1876): Xaa at position 1876 is Val, Ala, Gly, Leu, or Ile
  SITE (1877)..(1877): Xaa at position 1877 is Cys, Ala, Val, Gly, Ser, or Thr
  SITE (1892)..(1892): Xaa at position 1892 is Val, Ala, Gly, Leu, or Ile
  SITE (1895)..(1895): Xaa at position 1895 is Phe, Tyr, Met, His, Ile, Leu Val, Ala, or Gly
  SITE (1896)..(1896): Xaa at position 1896 is Ala, Gly, or Pro
  SITE (1897)..(1897): Xaa at position 1897 is Leu, Ala, Val, Gly, or Ile
  SITE (1899)..(1899): Xaa at position 1899 is Phe, Tyr, Met, His, Ile, Leu Val, Ala, or Gly
  SITE (1902)..(1902): Xaa at position 1902 is Phe, Tyr, Met, His, Ile, Leu Val, Ala, or Gly
  SITE (1937)..(1937): Xaa at position 1937 is Phe, Tyr, Met, His, Ile, Leu Val, Ala, or Gly
  SITE (1938)..(1938): Xaa at position 1938 is His, Phe, Tyr, Lys, Arg, Gly Ser, Thr, Ala, Val, Leu, Ile, Asn, Met, or Gln
  SITE (1939)..(1939): Xaa at position 1939 is Ala, Gly, or Pro
  SITE (1940)..(1940): Xaa at position 1940 is Ile, Ala, Val, Leu, or Gly
  SITE (1948)..(1948): Xaa at position 1948 is Leu, Ala, Val, Gly, or Ile
  SITE (1951)..(1951): Xaa at position 1951 is Leu, Ala, Val, Gly, or Ile
  SITE (1953)..(1953): Xaa at position 1953 is Met, Ile, Leu, Val, Ala, or Gly
  SITE (1954)..(1954): Xaa at position 1954 is Ala, Gly, or Pro
  SITE (1959)..(1959): Xaa at position 1959 is Ile, Ala, Val, Leu, or Gly
  SITE (1961)..(1961): Xaa at position 1961 is Trp, Tyr, Phe, Met, His, Ile Leu, Val, Ala, or Gly
  SITE (1962)..(1962): Xaa at position 1962 is Tyr, Phe, Met, His, Ile, Leu Val, Ala, or Gly
  SITE (1963)..(1963): Xaa at position 1963 is Leu, Ala, Val, Gly, or Ile
  SITE (1964)..(1964): Xaa at position 1964 is Leu, Ala, Val, Gly, or Ile
  SITE (1973)..(1973): Xaa at position 1973 is His, Phe, Tyr, Lys, Arg, Gly Ser, Thr, Ala, Val, Leu, Ile, Asn, Met, or Gln
  SITE (1975)..(1975): Xaa at position 1975 is Ile, Ala, Val, Leu, or Gly
  SITE (1977)..(1977): Xaa at position 1977 is Phe, Tyr, Met, His, Ile, Leu Val, Ala, or Gly
  SITE (1982)..(1982): Xaa at position 1982 is Phe, Tyr, Met, His, Ile, Leu Val, Ala, or Gly
  SITE (1997)..(1997): Xaa at position 1997 is Leu, Ala, Val, Gly, or Ile
  SITE (2005)..(2005): Xaa at position 2005 is Val, Ala, Gly, Leu, or Ile
  SITE (2017)..(2017): Xaa at position 2017 is Val, Ala, Gly, Leu, or Ile
  SITE (2019)..(2019): Xaa at position 2019 is Cys, Ala, Val, Gly, Ser, or Thr
  SITE (2029)..(2029): Xaa at position 2029 is Met, Ile, Leu, Val, Ala, or Gly
  SITE (2033)..(2033): Xaa at position 2033 is Phe, Tyr, Met, His, Ile, Leu Val, Ala, or Gly
  SITE (2035)..(2035): Xaa at position 2035 is Val, Ala, Gly, Leu, or Ile
  SITE (2046)..(2046): Xaa at position 2046 is Met, Ile, Leu, Val, Ala, or Gly
  SITE (2066)..(2066): Xaa at position 2066 is Ala, Gly, or Pro
  SITE (2070)..(2070): Xaa at position 2070 is Ala, Gly, or Pro
  SITE (2080)..(2080): Xaa at position 2080 is Ala, Gly, or Pro
  SITE (2081)..(2081): Xaa at position 2081 is Trp, Tyr, Phe, Met, His, Ile Leu, Val, Ala, or Gly
  SITE (2099)..(2099): Xaa at position 2099 is Ile, Ala, Val, Leu, or Gly
  SITE (2100)..(2100): Xaa at position 2100 is Ile, Ala, Val, Leu, or Gly
  SITE (2101)..(2101): Xaa at position 2101 is His, Phe, Tyr, Lys, Arg, Gly Ser, Thr, Ala, Val, Leu, Ile, Asn, Met, or Gln
  SITE (2108)..(2108): Xaa at position 2108 is Ala, Gly, or Pro
  SITE (2117)..(2117): Xaa at position 2117 is Ile, Ala, Val, Leu, or Gly
  SITE (2120)..(2120): Xaa at position 2120 is Phe, Tyr, Met, His, Ile, Leu Val, Ala, or Gly
  SITE (2122)..(2122): Xaa at position 2122 is Ile, Ala, Val, Leu, or Gly
  SITE (2124)..(2124): Xaa at position 2124 is Tyr, Phe, Met, His, Ile, Leu Val, Ala, or Gly
  SITE (2134)..(2134): Xaa at position 2134 is Tyr, Phe, Met, His, Ile, Leu Val, Ala, or Gly
  SITE (2145)..(2145): Xaa at position 2145 is Phe, Tyr, Met, His, Ile, Leu Val, Ala, or Gly
  SITE (2163)..(2163): Xaa at position 2163 is Ile, Ala, Val, Leu, or Gly
  SITE (2164)..(2164): Xaa at position 2164 is Ile, Ala, Val, Leu, or Gly
  SITE (2165)..(2165): Xaa at position 2165 is Ala, Gly, or Pro
  SITE (2181)..(2181): Xaa at position 2181 is Leu, Ala, Val, Gly, or Ile
  SITE (2185)..(2185): Xaa at position 2185 is Leu, Ala, Val, Gly, or Ile
  SITE (2186)..(2186): Xaa at position 2186 is Met, Ile, Leu, Val, Ala, or Gly
  SITE (2188)..(2188): Xaa at position 2188 is Cys, Ala, Val, Gly, Ser, or Thr
  SITE (2193)..(2193): Xaa at position 2193 is Cys, Ala, Val, Gly, Ser, or Thr
  SITE (2199)..(2199): Xaa at position 2199 is Met, Ile, Leu, Val, Ala, or Gly
  SITE (2209)..(2209): Xaa at position 2209 is Ile, Ala, Val, Leu, or Gly
  SITE (2220)..(2220): Xaa at position 2220 is Ala, Gly, or Pro
  SITE (2222)..(2222): Xaa at position 2222 is Trp, Tyr, Phe, Met, His, Ile Leu, Val, Ala, or Gly
  SITE (2227)..(2227): Xaa at position 2227 is Ala, Gly, or Pro
  SITE (2237)..(2237): Xaa at position 2237 is Ala, Gly, or Pro
  SITE (2238)..(2238): Xaa at position 2238 is Trp, Tyr, Phe, Met, His, Ile Leu, Val, Ala, or Gly
  SITE (2249)..(2249): Xaa at position 2249 is Leu, Ala, Val, Gly, or Ile
  SITE (2251)..(2251): Xaa at position 2251 is Val, Ala, Gly, Leu, or Ile
  SITE (2253)..(2253): Xaa at position 2253 is Phe, Tyr, Met, His, Ile, Leu Val, Ala, or Gly
  SITE (2259)..(2259): Xaa at position 2259 is Val, Ala, Gly, Leu, or Ile
  SITE (2262)..(2262): Xaa at position 2262 is Val, Ala, Gly, Leu, or Ile
  SITE (2267)..(2267): Xaa at position 2267 is Val, Ala, Gly, Leu, or Ile
  SITE (2274)..(2274): Xaa at position 2274 is Met, Ile, Leu, Val, Ala, or Gly
  SITE (2276)..(2276): Xaa at position 2276 is Val, Ala, Gly, Leu, or Ile
  SITE (2279)..(2279): Xaa at position 2279 is Phe, Tyr, Met, His, Ile, Leu Val, Ala, or Gly
  SITE (2281)..(2281): Xaa at position 2281 is Ile, Ala, Val, Leu, or Gly
  SITE (2302)..(2302): Xaa at position 2302 is Phe, Tyr, Met, His, Ile, Leu Val, Ala, or Gly
  SITE (2316)..(2316): Xaa at position 2316 is Leu, Ala, Val, Gly, or Ile
  SITE (2325)..(2325): Xaa at position 2325 is Leu, Ala, Val, Gly, or Ile
  SITE (2327)..(2327): Xaa at position 2327 is Ile, Ala, Val, Leu, or Gly
  SITE (2336)..(2336): Xaa at position 2336 is Ile, Ala, Val, Leu, or Gly
  SITE (2337)..(2337): Xaa at position 2337 is Ala, Gly, or Pro
  SITE (2338)..(2338): Xaa at position 2338 is Leu, Ala, Val, Gly, or Ile
  SITE (2340)..(2340): Xaa at position 2340 is Met, Ile, Leu, Val, Ala, or Gly
  SITE (2342)..(2342): Xaa at position 2342 is Val, Ala, Gly, Leu, or Ile
  SITE (2347)..(2347): Xaa at position 2347 is Ala, Gly, or Pro
MQIELSTCFFLCLLRFCFSATRRYYXGXVELSWDYMQSDLGELPVDARFPPRVPKSFPFNTSVVYKKTLFVEFTDHLFNIAKPRPPWMGXXGPTXQAEVYDTVVXTXKNMASHPXSXHXVGVSYWKASEGXEYDDQTSQREKEDDKXFPGGSHTXVXQVLKENGPMASDPLCLTYSXLSHVDLVKDLNSGXXGXLXXXREGSLAKEKTQTLHKFILXXXVXDEGKSWHSETKNSLMQDRDAASARAWPKMXTXNGXVNRSLPGLIGCHRKSXYXHXXGMGTTPEVHSXFLEGHTXLVRNHRQASLEXSPITFLTXQTLXMDLGQFLLFXHISSHQHDGXEXYXKXDSCPEEPQLRMKNNEEAEDYDDDLTDSEMDVVRFDDDNSPSFIQIRSVAKKHPKTWVHYXXXEEEDWDXXPLVLAPDDRSYKSQYXNNGPQRIGRKXKKXRXMAYTDETFKTREAIQHESGXLGPLXYGEVGDTXLXIXKNQASRPXNXYPHGITDVRPLYSRRLPKGVKHXKDFPILPGEIFKXKXTVTVEDGPTKSDPRCLTRYXSSFVNMERDLASGXXGPXXXXYKESVDQRGNQIMSDKRNVIXXSVXDENRSWXLTENIQRFLPNPAGVQLEDPEFQASNIXHSXNGYXFDSLQLSXCLHEVAYXYXLSIGAQTDFLSXFFSGYTXKHKMVYEDTLTXFPFSGETXFXSXENPGLWIXGXHNSDFRNRGXTXLXKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFXXXVERLWDYGMSSSPHVLRNRAQSGSVPQFKKXXXQEFTDGSFTQPLYRGELNEXXGXXGPYXRXEVEDNXMXTXRNQASRPXSXYSSLISYEEDQRQGAEPRKNFXKPNETKTYFXKXQHHXAPTKDEFDXKXWAXFSDVDLEKDVXSGXXGPXXXXHTNTLNPAHGRQVTXQEXXXFXTIXDETKSWYFTENMERNCRAPCNIQMEDPTFKENYRXXXXNGYIMDTXPGXVXXQDQRXRXXXXSMGSNENIXSXHXSGHVXTVRKKEEYKMALYNXYPGVFETXEMLPSKAGIWRXEXLIGEHLHAGXSTLXLXYSNKCQTPLGXASGHIRDFQITASGQYGQWXPKLXRLHYSGSINXXSTKEPFSWIKVDLLAPMXXXGIKTQGXRQKFSSLYXSQXIXMXSLDGKKWQTXRGNSTGTLMVXFGNVDSSGIKHNIFNPPXXXRYIRLHPTHYSIRSTXRMEXXGXDLNSXSMPLGXESKAISDAQXTASSYFTNMFXTXSPSKXRLHLQGRSNXXRPQVNNPKEWXQXDXQKTMKXTGXTTQGXKSLLTSXYXKEXLXSSSQDGHQWTLFFQNGKVKVXQGNQDSFTPVVNSXDPPLLTRYXRXHPQSWVHQXXXRXEXLGCEXQDLY

SEQ ID NO: 91 - protein, 732 aa, Homo sapiens
  SITE (46)..(46): Xaa at position 46 is Leu, Ala, Val, Gly, or Ile
  SITE (65)..(65): Xaa at position 65 is His, Phe, Tyr, Lys, Arg, Gly, Ser Thr, Ala, Val, Leu, Ile, Asn, Met, or Gln
  SITE (70)..(70): Xaa at position 70 is Tyr, Phe, Met, His, Ile, Leu, Val Ala, or Gly
  SITE (75)..(75): Xaa at position 75 is Leu, Ala, Val, Gly, or Ile
  SITE (76)..(76): Xaa at position 76 is Ile, Ala, Val, Leu, or Gly
  SITE (77)..(77): Xaa at position 77 is Val, Ala, Gly, Leu, or Ile
  SITE (83)..(83): Xaa at position 83 is Phe, Tyr, Met, His, Ile, Leu, Val Ala, or Gly
  SITE (85)..(85): Xaa at position 85 is Val, Ala, Gly, Leu, or Ile
  SITE (87)..(87): Xaa at position 87 is Ile, Ala, Val, Leu, or Gly
  SITE (89)..(89): Xaa at position 89 is Phe, Tyr, Met, His, Ile, Leu, Val Ala, or Gly
  SITE (100)..(100): Xaa at position 100 is Phe, Tyr, Met, His, Ile, Leu, Val Ala, or Gly
  SITE (102)..(102): Xaa at position 102 is Val, Ala, Gly, Leu, or Ile
  SITE (104)..(104): Xaa at position 104 is Tyr, Phe, Met, His, Ile, Leu, Val Ala, or Gly
  SITE (105)..(105): Xaa at position 105 is Val, Ala, Gly, Leu, or Ile
  SITE (106)..(106): Xaa at position 106 is Ile, Ala, Val, Leu, or Gly
  SITE (120)..(120): Xaa at position 120 is Val, Ala, Gly, Leu, or Ile
  SITE (133)..(133): Xaa at position 133 is Ala, Gly, or Pro
  SITE (136)..(136): Xaa at position 136 is Val, Ala, Gly, Leu, or Ile
  SITE (143)..(143): Xaa at position 143 is Val, Ala, Gly, Leu, or Ile
  SITE (145)..(145): Xaa at position 145 is Leu, Ala, Val, Gly, or Ile
  SITE (147)..(147): Xaa at position 147 is Ile, Ala, Val, Leu, or Gly
  SITE (155)..(155): Xaa at position 155 is Val, Ala, Gly, Leu, or Ile
  SITE (158)..(158): Xaa at position 158 is Phe, Tyr, Met, His, Ile, Leu, Val Ala, or Gly
  SITE (161)..(161): Xaa at position 161 is Tyr, Phe, Met, His, Ile, Leu, Val Ala, or Gly
  SITE (162)..(162): Xaa at position 162 is Val, Ala, Gly, Leu, or Ile
  SITE (163)..(163): Xaa at position 163 is Ala, Gly, or Pro
  SITE (182)..(182): Xaa at position 182 is Tyr, Phe, Met, His, Ile, Leu, Val Ala, or Gly
  SITE (183)..(183): Xaa at position 183 is Ile, Ala, Val, Leu, or Gly
  SITE (184)..(184): Xaa at position 184 is Leu, Ala, Val, Gly, or Ile
  SITE (185)..(185): Xaa at position 185 is Phe, Tyr, Met, His, Ile, Leu, Val Ala, or Gly
  SITE (194)..(194): Xaa at position 194 is Val, Ala, Gly, Leu, or Ile
  SITE (196)..(196): Xaa at position 196 is Leu, Ala, Val, Gly, or Ile
  SITE (205)..(205): Xaa at position 205 is Tyr, Phe, Met, His, Ile, Leu, Val Ala, or Gly
  SITE (206)..(206): Xaa at position 206 is Val, Ala, Gly, Leu, or Ile
  SITE (213)..(213): Xaa at position 213 is Ile, Ala, Val, Leu, or Gly
  SITE (214)..(214): Xaa at position 214 is Phe, Tyr, Met, His, Ile, Leu, Val Ala, or Gly
  SITE (226)..(226): Xaa at position 226 is Trp, Tyr, Phe, Met, His, Ile, Leu Val, Ala, or Gly
  SITE (235)..(235): Xaa at position 235 is Ile, Ala, Val, Leu, or Gly
  SITE (239)..(239): Xaa at position 239 is Cys, Ala, Val, Gly, Ser, or Thr
  SITE (242)..(242): Xaa at position 242 is Val, Ala, Gly, Leu, or Ile
  SITE (243)..(243): Xaa at position 243 is Met, Ile, Leu, Val, Ala, or Gly
  SITE (250)..(250): Xaa at position 250 is Leu, Ala, Val, Gly, or Ile
  SITE (259)..(259): Xaa at position 259 is Val, Ala, Gly, Leu, or Ile
  SITE (266)..(266): Xaa at position 266 is Met, Ile, Leu, Val, Ala, or Gly
  SITE (275)..(275): Xaa at position 275 is Val, Ala, Gly, Leu, or Ile
  SITE (276)..(276): Xaa at position 276 is Leu, Ala, Val, Gly, or Ile
  SITE (292)..(292): Xaa at position 292 is Ala, Gly, or Pro
  SITE (293)..(293): Xaa at position 293 is Trp, Tyr, Phe, Met, His, Ile, Leu Val, Ala, or Gly
  SITE (299)..(299): Xaa at position 299 is Ile, Ala, Val, Leu, or Gly
  SITE (303)..(303): Xaa at position 303 is Tyr, Phe, Met, His, Ile, Leu, Val Ala, or Gly
  SITE (310)..(310): Xaa at position 310 is Val, Ala, Gly, Leu, or Ile
  SITE (315)..(315): Xaa at position 315 is Cys, Ala, Val, Gly, Ser, or Thr
  SITE (316)..(316): Xaa at position 316 is Trp, Tyr, Phe, Met, His, Ile, Leu Val, Ala, or Gly
  SITE (317)..(317): Xaa at position 317 is Val, Ala, Gly, Leu, or Ile
  SITE (318)..(318): Xaa at position 318 is Phe, Tyr, Met, His, Ile, Leu, Val Ala, or Gly
  SITE (319)..(319): Xaa at position 319 is Ala, Gly, or Pro
  SITE (321)..(321): Xaa at position 321 is Val, Ala, Gly, Leu, or Ile
  SITE (322)..(322): Xaa at position 322 is Phe, Tyr, Met, His, Ile, Leu, Val Ala, or Gly
  SITE (326)..(326): Xaa at position 326 is Leu, Ala, Val, Gly, or Ile
  SITE (328)..(328): Xaa at position 328 is Cys, Ala, Val, Gly, Ser, or Thr
  SITE (329)..(329): Xaa at position 329 is Leu, Ala, Val, Gly, or Ile
  SITE (331)..(331): Xaa at position 331 is Ile, Ala, Val, Leu, or Gly
  SITE (333)..(333): Xaa at position 333 is Ala, Gly, or Pro
  SITE (336)..(336): Xaa at position 336 is Val, Ala, Gly, Leu, or Ile
  SITE (339)..(339): Xaa at position 339 is Tyr, Phe, Met, His, Ile, Leu, Val Ala, or Gly
  SITE (342)..(342): Xaa at position 342 is Ala, Gly, or Pro
  SITE (349)..(349): Xaa at position 349 is Leu, Ala, Val, Gly, or Ile
  SITE (353)..(353): Xaa at position 353 is Ile, Ala, Val, Leu, or Gly
  SITE (355)..(355): Xaa at position 355 is Leu, Ala, Val, Gly, or Ile
  SITE (373)..(373): Xaa at position 373 is Tyr, Phe, Met, His, Ile, Leu, Val Ala, or Gly
  SITE (374)..(374): Xaa at position 374 is His, Phe, Tyr, Lys, Arg, Gly, Ser Thr, Ala, Val, Leu, Ile, Asn, Met, or Gln
  SITE (375)..(375): Xaa at position 375 is Cys, Ala, Val, Gly, Ser, or Thr
  SITE (376)..(376): Xaa at position 376 is Trp, Tyr, Phe, Met, His, Ile, Leu Val, Ala, or Gly
  SITE (379)..(379): Xaa at position 379 is Ala, Gly, or Pro
  SITE (381)..(381): Xaa at position 381 is Met, Ile, Leu, Val, Ala, or Gly
  SITE (390)..(390): Xaa at position 390 is Phe, Tyr, Met, His, Ile, Leu, Val Ala, or Gly
  SITE (395)..(395): Xaa at position 395 is Ala, Gly, or Pro
  SITE (396)..(396): Xaa at position 396 is Val, Ala, Gly, Leu, or Ile
  SITE (410)..(410): Xaa at position 410 is Cys, Ala, Val, Gly, Ser, or Thr
  SITE (413)..(413): Xaa at position 413 is Ala, Gly, or Pro
  SITE (417)..(417): Xaa at position 417 is Ala, Gly, or Pro
  SITE (418)..(418): Xaa at position 418 is Ile, Ala, Val, Leu, or Gly
  SITE (420)..(420): Xaa at position 420 is His, Phe, Tyr, Lys, Arg, Gly, Ser Thr, Ala, Val, Leu, Ile, Asn, Met, or Gln
  SITE (422)..(422): Xaa at position 422 is His, Phe, Tyr, Lys, Arg, Gly, Ser Thr, Ala, Val, Leu, Ile, Asn, Met, or Gln
  SITE (429)..(429): Xaa at position 429 is Ala, Gly, or Pro
  SITE (432)..(432): Xaa at position 432 is Val, Ala, Gly, Leu, or Ile
  SITE (433)..(433): Xaa at position 433 is Phe, Tyr, Met, His, Ile, Leu, Val Ala, or Gly
  SITE (434)..(434): Xaa at position 434 is Ala, Gly, or Pro
  SITE (436)..(436): Xaa at position 436 is Val, Ala, Gly, Leu, or Ile
  SITE (440)..(440): Xaa at position 440 is Leu, Ala, Val, Gly, or Ile
  SITE (441)..(441): Xaa at position 441 is Ile, Ala, Val, Leu, or Gly
  SITE (442)..(442): Xaa at position 442 is Tyr, Phe, Met, His, Ile, Leu, Val Ala, or Gly
  SITE (461)..(461): Xaa at position 461 is Ile, Ala, Val, Leu, or Gly
  SITE (465)..(465): Xaa at position 465 is Ile, Ala, Val, Leu, or Gly
  SITE (466)..(466): Xaa at position 466 is Val, Ala, Gly, Leu, or Ile
  SITE (482)..(482): Xaa at position 482 is Tyr, Phe, Met, His, Ile, Leu, Val Ala, or Gly
  SITE (493)..(493): Xaa at position 493 is Leu, Ala, Val, Gly, or Ile
  SITE (498)..(498): Xaa at position 498 is Ala, Gly, or Pro
  SITE (519)..(519): Xaa at position 519 is Val, Ala, Gly, Leu, or Ile
  SITE (521)..(521): Xaa at position 521 is Met, Ile, Leu, Val, Ala, or Gly
  SITE (523)..(523): Xaa at position 523 is Phe, Tyr, Met, His, Ile, Leu, Val Ala, or Gly
  SITE (534)..(534): Xaa at position 534 is Phe, Tyr, Met, His, Ile, Leu, Val Ala, or Gly
  SITE (536)..(536): Xaa at position 536 is Leu, Ala, Val, Gly, or Ile
  SITE (538)..(538): Xaa at position 538 is Ile, Ala, Val, Leu, or Gly
  SITE (540)..(540): Xaa at position 540 is Phe, Tyr, Met, His, Ile, Leu, Val Ala, or Gly
  SITE (550)..(550): Xaa at position 550 is Ile, Ala, Val, Leu, or Gly
  SITE (552)..(552): Xaa at position 552 is Ala, Gly, or Pro
  SITE (553)..(553): Xaa at position 553 is Tyr, Phe, Met, His, Ile, Leu, Val Ala, or Gly
  SITE (554)..(554): Xaa at position 554 is Leu, Ala, Val, Gly, or Ile
  SITE (556)..(556): Xaa at position 556 is Ala, Gly, or Pro
  SITE (558)..(558): Xaa at position 558 is Ile, Ala, Val, Leu, or Gly
  SITE (561)..(561): Xaa at position 561 is Tyr, Phe, Met, His, Ile, Leu, Val Ala, or Gly
  SITE (576)..(576): Xaa at position 576 is Val, Ala, Gly, Leu, or Ile
  SITE (578)..(578): Xaa at position 578 is Leu, Ala, Val, Gly, or Ile
  SITE (590)..(590): Xaa at position 590 is Ile, Ala, Val, Leu, or Gly
  SITE (595)..(595): Xaa at position 595 is Tyr, Phe, Met, His, Ile, Leu, Val Ala, or Gly
  SITE (605)..(605): Xaa at position 605 is Leu, Ala, Val, Gly, or Ile
  SITE (606)..(606): Xaa at position 606 is His, Phe, Tyr, Lys, Arg, Gly, Ser Thr, Ala, Val, Leu, Ile, Asn, Met, or Gln
  SITE (607)..(607): Xaa at position 607 is Phe, Tyr, Met, His, Ile, Leu, Val Ala, or Gly
  SITE (608)..(608): Xaa at position 608 is Phe, Tyr, Met, His, Ile, Leu, Val Ala, or Gly
  SITE (609)..(609): Xaa at position 609 is Val, Ala, Gly, Leu, or Ile
  SITE (611)..(611): Xaa at position 611 is Ala, Gly, or Pro
  SITE (613)..(613): Xaa at position 613 is Ile, Ala, Val, Leu, or Gly
  SITE (619)..(619): Xaa at position 619 is Val, Ala, Gly, Leu, or Ile
  SITE (620)..(620): Xaa at position 620 is Leu, Ala, Val, Gly, or Ile
  SITE (628)..(628): Xaa at position 628 is Leu, Ala, Val, Gly, or Ile
  SITE (642)..(642): Xaa at position 642 is Val, Ala, Gly, Leu, or Ile
  SITE (647)..(647): Xaa at position 647 is Met, Ile, Leu, Val, Ala, or Gly
  SITE (649)..(649): Xaa at position 649 is Val, Ala, Gly, Leu, or Ile
  SITE (651)..(651): Xaa at position 651 is Val, Ala, Gly, Leu, or Ile
  SITE (653)..(653): Xaa at position 653 is Phe, Tyr, Met, His, Ile, Leu, Val Ala, or Gly
  SITE (661)..(661): Xaa at position 661 is Leu, Ala, Val, Gly, or Ile
  SITE (664)..(664): Xaa at position 664 is Val, Ala, Gly, Leu, or Ile
  SITE (666)..(666): Xaa at position 666 is Val, Ala, Gly, Leu, or Ile
  SITE (668)..(668): Xaa at position 668 is Leu, Ala, Val, Gly, or Ile
  SITE (684)..(684): Xaa at position 684 is Ile, Ala, Val, Leu, or Gly
  SITE (696)..(696): Xaa at position 696 is Cys, Ala, Val, Gly, Ser, or Thr
  SITE (706)..(706): Xaa at position 706 is Leu, Ala, Val, Gly, or Ile
  SITE (707)..(707): Xaa at position 707 is Ile, Ala, Val, Leu, or Gly
  SITE (708)..(708): Xaa at position 708 is Ala, Gly, or Pro
  SITE (710)..(710): Xaa at position 710 is Met, Ile, Leu, Val, Ala, or Gly
  SITE (715)..(715): Xaa at position 715 is Leu, Ala, Val, Gly, or Ile
  SITE (717)..(717): Xaa at position 717 is His, Phe, Tyr, Lys, Arg, Gly, Ser Thr, Ala, Val, Leu, Ile, Asn, Met, or Gln
  SITE (718)..(718): Xaa at position 718 is Val, Ala, Gly, Leu, or Ile
  SITE (724)..(724): Xaa at position 724 is Val, Ala, Gly, Leu, or Ile
MSETSRTAFGGRRAVPPNNSNAAEDDLPTVELQGVVPRGVNLQEFXNVTSVHLFKERWDTNKVDXHTDKXENNKXXXRRGQSXYXQXDXSRPYDPRRDLXRXEXXXGRYPQENKGTYIPXPIVSELQSGKWGXKIXMREDRSXRXSXQSSPKCIXGKXRMXXXVWTPYGVLRTSRNPETDTXXXXNPWCEDDAXYXDNEKEREEXXLNDIGVXXYGEVNDIKTRSXSYGQFEDGXLDTXLYXXDRAQMDXSGRGNPIKXSRVGSAXVNAKDDEGXXVGSWDNIYAYGVPPSXXTGSVDXLLEXRSSENPXRYGQXXXXXGXXNTFXRXXGXPXRIXTNXFSXHDNDANXQMDXFXEEDGNVNSKLTKDSVWNXXXXNEXWXTRPDLPVGXGGWQXXDSTPQENSDGMYRXGPXSVQXXKXGXVCFQFDXPFXXXEXNSDXXXITAKKDGTHVVENVDATHXGKLXXTKQIGGDGMMDITDTXKFQEGQEEERXALETXLMYGAKKPLNTEGVMKSRSNXDXDXEVENAVLGKDXKXSXTXRNNSHNRYTXTXXXSXNXTFXTGVPKAEFKKETFDXTXEPLSFKKEAVLXQAGEXMGQLLEQASXXXXXTXRXNETRDXXAKQKSTVXTIPEIIIKVRGTQXVGSDXTXTXQXTNPLKETXRNXWXHXDGPGVTRPMKKMFREXRPNSTVQWEEVXRPWVSGHRKXXXSXSSDSXRXXYGELDXQIQRRPSM

SEQ ID NO: 92 - protein, 218 aa, Homo sapiens
  SITE (35)..(35): Xaa at position 35 is Val, Ala, Gly, Leu, or Ile
  SITE (37)..(37): Xaa at position 37 is Ile, Ala, Val, Leu, or Gly
  SITE (42)..(42): Xaa at position 42 is Ile, Ala, Val, Leu, or Gly
  SITE (49)..(49): Xaa at position 49 is Leu, Ala, Val, Gly, or Ile
  SITE (50)..(50): Xaa at position 50 is Ala, Gly, or Pro
  SITE (53)..(53): Xaa at position 53 is Val, Ala, Gly, Leu, or Ile
  SITE (57)..(57): Xaa at position 57 is Met, Ile, Leu, Val, Ala, or Gly
  SITE (62)..(62): Xaa at position 62 is Ile, Ala, Val, Leu, or Gly
  SITE (63)..(63): Xaa at position 63 is Val, Ala, Gly, Leu, or Ile
  SITE (64)..(64): Xaa at position 64 is Ala, Gly, or Pro
  SITE (65)..(65): Xaa at position 65 is Leu, Ala, Val, Gly, or Ile
  SITE (66)..(66): Xaa at position 66 is Cys, Ala, Val, Gly, Ser, or Thr
  SITE (68)..(68): Xaa at position 68 is Leu, Ala, Val, Gly, or Ile
  SITE (74)..(74): Xaa at position 74 is Phe, Tyr, Met, His, Ile, Leu, Val Ala, or Gly
  SITE (75)..(75): Xaa at position 75 is Phe, Tyr, Met, His, Ile, Leu, Val Ala, or Gly
  SITE (78)..(78): Xaa at position 78 is Leu, Ala, Val, Gly, or Ile
  SITE (79)..(79): Xaa at position 79 is Leu, Ala, Val, Gly, or Ile
  SITE (82)..(82): Xaa at position 82 is Ile, Ala, Val, Leu, or Gly
  SITE (93)..(93): Xaa at position 93 is Ile, Ala, Val, Leu, or Gly
  SITE (100)..(100): Xaa at position 100 is Ile, Ala, Val, Leu, or Gly
  SITE (125)..(125): Xaa at position 125 is Leu, Ala, Val, Gly, or Ile
  SITE (130)..(130): Xaa at position 130 is Val, Ala, Gly, Leu, or Ile
  SITE (131)..(131): Xaa at position 131 is Leu, Ala, Val, Gly, or Ile
  SITE (132)..(132): Xaa at position 132 is Ile, Ala, Val, Leu, or Gly
  SITE (133)..(133): Xaa at position 133 is Val, Ala, Gly, Leu, or Ile
  SITE (137)..(137): Xaa at position 137 is Ile, Ala, Val, Leu, or Gly
  SITE (143)..(143): Xaa at position 143 is Met, Ile, Leu, Val, Ala, or Gly
  SITE (146)..(146): Xaa at position 146 is Leu, Ala, Val, Gly, or Ile
  SITE (149)..(149): Xaa at position 149 is Leu, Ala, Val, Gly, or Ile
  SITE (150)..(150): Xaa at position 150 is Val, Ala, Gly, Leu, or Ile
  SITE (160)..(160): Xaa at position 160 is Val, Ala, Gly, Leu, or Ile
  SITE (161)..(161): Xaa at position 161 is Ala, Gly, or Pro
  SITE (163)..(163): Xaa at position 163 is Leu, Ala, Val, Gly, or Ile
  SITE (164)..(164): Xaa at position 164 is Leu, Ala, Val, Gly, or Ile
  SITE (181)..(181): Xaa at position 181 is Phe, Tyr, Met, His, Ile, Leu, Val Ala, or Gly
  SITE (183)..(183): Xaa at position 183 is Ile, Ala, Val, Leu, or Gly
  SITE (188)..(188): Xaa at position 188 is Val, Ala, Gly, Leu, or Ile
  SITE (189)..(189): Xaa at position 189 is Val, Ala, Gly, Leu, or Ile
  SITE (191)..(191): Xaa at position 191 is Tyr, Phe, Met, His, Ile, Leu, Val Ala, or Gly
  SITE (192)..(192): Xaa at position 192 is Ala, Gly, or Pro
  SITE (199)..(199): Xaa at position 199 is Phe, Tyr, Met, His, Ile, Leu, Val Ala, or Gly
  SITE (202)..(202): Xaa at position 202 is Leu, Ala, Val, Gly, or Ile
  SITE (205)..(205): Xaa at position 205 is Val, Ala, Gly, Leu, or Ile
  SITE (206)..(206): Xaa at position 206 is Cys, Ala, Val, Gly, Ser, or Thr
  SITE (207)..(207): Xaa at position 207 is Val, Ala, Gly, Leu, or Ile
MATRSPGVVISDDEPGYDLDLFCIPNHYAEDLERXFXPHGLXMDRTERXXRDXMKEXGGHHXXXXXVXKGGYKXXADXXDYXKALNRNSDRSXPMTVDFXRLKSYCNDQSTGDIKVIGGDDLSTXTGKNXXXXEDIXDTGKTXQTXLSXXRQYNPKMVKXXSXXVKRTPRSVGYKPDFVGXEXPDKFXXGXXLDYNEYXRDXNHXXXISETGKAKYKA

SEQ ID NO: 93 - protein, 1130 aa, Homo sapiens
  SITE (88)..(88): Xaa at position 88 is Leu, Ala, Val, Gly, or Ile
  SITE (100)..(100): Xaa at position 100 is Cys, Ala, Val, Gly, Ser, or Thr
  SITE (102)..(102): Xaa at position 102 is Ala, Gly, or Pro
  SITE (111)..(111): Xaa at position 111 is Val, Ala, Gly, Leu, or Ile
  SITE (127)..(127): Xaa at position 127 is Trp, Tyr, Phe, Met, His, Ile, Leu Val, Ala, or Gly
  SITE (137)..(137): Xaa at position 137 is Ala, Gly, or Pro
  SITE (141)..(141): Xaa at position 141 is Leu, Ala, Val, Gly, or Ile
  SITE (149)..(149): Xaa at position 149 is Phe, Tyr, Met, His, Ile, Leu, Val Ala, or Gly
  SITE (150)..(150): Xaa at position 150 is Leu, Ala, Val, Gly, or Ile
  SITE (151)..(151): Xaa at position 151 is Val, Ala, Gly, Leu, or Ile
  SITE (163)..(163): Xaa at position 163 is Ile, Ala, Val, Leu, or Gly
  SITE (165)..(165): Xaa at position 165 is Leu, Ala, Val, Gly, or Ile
  SITE (179)..(179): Xaa at position 179 is Ala, Gly, or Pro
  SITE (198)..(198): Xaa at position 198 is Leu, Ala, Val, Gly, or Ile
  SITE (199)..(199): Xaa at position 199 is Val, Ala, Gly, Leu, or Ile
  SITE (202)..(202): Xaa at position 202 is His, Phe, Tyr, Lys, Arg, Gly, Ser Thr, Ala, Val, Leu, Ile, Asn, Met, or Gln
  SITE (213)..(213): Xaa at position 213 is Leu, Ala, Val, Gly, or Ile
  SITE (217)..(217): Xaa at position 217 is Ala, Gly, or Pro
  SITE (242)..(242): Xaa at position 242 is Ile, Ala, Val, Leu, or Gly
  SITE (268)..(268): Xaa at position 268 is Val, Ala, Gly, Leu, or Ile
  SITE (270)..(270): Xaa at position 270 is Val, Ala, Gly, Leu, or Ile
  SITE (283)..(283): Xaa at position 283 is Phe, Tyr, Met, His, Ile, Leu, Val Ala, or Gly
  SITE (284)..(284): Xaa at position 284 is Leu, Ala, Val, Gly, or Ile
  SITE (287)..(287): Xaa at position 287 is Ala, Gly, or Pro
  SITE (289)..(289): Xaa at position 289 is Val, Ala, Gly, Leu, or Ile
  SITE (290)..(290): Xaa at position 290 is Met, Ile, Leu, Val, Ala, or Gly
  SITE (293)..(293): Xaa at position 293 is Ile, Ala, Val, Leu, or Gly
  SITE (298)..(298): Xaa at position 298 is Leu, Ala, Val, Gly, or Ile
  SITE (301)..(301): Xaa at position 301 is Leu, Ala, Val, Gly, or Ile
  SITE (304)..(304): Xaa at position 304 is Val, Ala, Gly, Leu, or Ile
  SITE (305)..(305): Xaa at position 305 is Cys, Ala, Val, Gly, Ser, or Thr
  SITE (312)..(312): Xaa at position 312 is Tyr, Phe, Met, His, Ile, Leu, Val Ala, or Gly
  SITE (313)..(313): Xaa at position 313 is Ile, Ala, Val, Leu, or Gly
  SITE (314)..(314): Xaa at position 314 is Ile, Ala, Val, Leu, or Gly
  SITE (323)..(323): Xaa at position 323 is Leu, Ala, Val, Gly, or Ile
  SITE (327)..(327): Xaa at position 327 is Leu, Ala, Val, Gly, or Ile
  SITE (335)..(335): Xaa at position 335 is Val, Ala, Gly, Leu, or Ile
  SITE (339)..(339): Xaa at position 339 is Val, Ala, Gly, Leu, or Ile
  SITE (340)..(340): Xaa at position 340 is Leu, Ala, Val, Gly, or Ile
  SITE (343)..(343): Xaa at position 343 is Met, Ile, Leu, Val, Ala, or Gly
  SITE (344)..(344): Xaa at position 344 is Ala, Gly, or Pro
  SITE (347)..(347): Xaa at position 347 is Ile, Ala, Val, Leu, or Gly
  SITE (350)..(350): Xaa at position 350 is Ala, Gly, or Pro
  SITE (351)..(351): Xaa at position 351 is Met, Ile, Leu, Val, Ala, or Gly
  SITE (354)..(354): Xaa at position 354 is Leu, Ala, Val, Gly, or Ile
  SITE (360)..(360): Xaa at position 360 is Ile, Ala, Val, Leu, or Gly
  SITE (361)..(361): Xaa at position 361 is His, Phe, Tyr, Lys, Arg, Gly, Ser Thr, Ala, Val, Leu, Ile, Asn, Met, or Gln
  SITE (364)..(364): Xaa at position 364 is Leu, Ala, Val, Gly, or Ile
  SITE (365)..(365): Xaa at position 365 is Ala, Gly, or Pro
  SITE (366)..(366): Xaa at position 366 is Ala, Gly, or Pro
  SITE (369)..(369): Xaa at position 369 is Cys, Ala, Val, Gly, Ser, or Thr
  SITE (371)..(371): Xaa at position 371 is Val, Ala, Gly, Leu, or Ile
  SITE (377)..(377): Xaa at position 377 is Val, Ala, Gly, Leu, or Ile
  SITE (379)..(379): Xaa at position 379 is Val, Ala, Gly, Leu, or Ile
  SITE (382)..(382): Xaa at position 382 is Phe, Tyr, Met, His, Ile, Leu, Val Ala, or Gly
  SITE (384)..(384): Xaa at position 384 is Leu, Ala, Val, Gly, or Ile
  SITE (401)..(401): Xaa at position 401 is Phe, Tyr, Met, His, Ile, Leu, Val Ala, or Gly
  SITE (407)..(407): Xaa at position 407 is Ala, Gly, or Pro
  SITE (411)..(411): Xaa at position 411 is Leu, Ala, Val, Gly, or Ile
  SITE (422)..(422): Xaa at position 422 is Val, Ala, Gly, Leu, or Ile
  SITE (423)..(423): Xaa at position 423 is Trp, Tyr, Phe, Met, His, Ile, Leu Val, Ala, or Gly
  SITE (425)..(425): Xaa at position 425 is Phe, Tyr, Met, His, Ile, Leu, Val Ala, or Gly
  SITE (427)..(427): Xaa at position 427 is Val, Ala, Gly, Leu, or Ile
  SITE (428)..(428): Xaa at position 428 is Leu, Ala, Val, Gly, or Ile
  SITE (429)..(429): Xaa at position 429 is Leu, Ala, Val, Gly, or Ile
  SITE (440)..(440): Xaa at position 440 is Tyr, Phe, Met, His, Ile, Leu, Val Ala, or Gly
  SITE (448)..(448): Xaa at position 448 is Val, Ala, Gly, Leu, or Ile
  SITE (452)..(452): Xaa at position 452 is Leu, Ala, Val, Gly, or Ile
  SITE (458)..(458): Xaa at position 458 is Met, Ile, Leu, Val, Ala, or Gly
  SITE (464)..(464): Xaa at position 464 is Cys, Ala, Val, Gly, Ser, or Thr
  SITE (472)..(472): Xaa at position 472 is Met, Ile, Leu, Val, Ala, or Gly
  SITE (475)..(475): Xaa at position 475 is Cys, Ala, Val, Gly, Ser, or Thr
  SITE (476)..(476): Xaa at position 476 is Trp, Tyr, Phe, Met, His, Ile, Leu Val, Ala, or Gly
  SITE (486)..(486): Xaa at position 486 is Phe, Tyr, Met, His, Ile, Leu, Val Ala, or Gly
  SITE (489)..(489): Xaa at position 489 is Ile, Ala, Val, Leu, or Gly
  SITE (493)..(493): Xaa at position 493 is Phe, Tyr, Met, His, Ile, Leu, Val Ala, or Gly
MLEICLKLVGCKSKKGLSSSSSCYLEEALQRPVASDFEPQGLSEAARWNSKENLLAGPSENDPNLFVALYDFVASGDNTLSITKGEKXRVLGYNHNGEWXEXQTKNGQGWXPSNYITPVNSLEKHSXYHGPVSRNAXEYLXSSGINGSXXXRESESSPGQRSXSXRYEGRVYHYRINTXSDGKLYVSSESRFNTLAEXXHHXSTVADGLITTXHYPXPKRNKPTVYGVSPNYDKWEMERTDXTMKHKLGGGQYGEVYEGVWKKYSLTXAXKTLKEDTMEVEEXXKEXAXXKEXKHPNXVQXLGXXTREPPFXXXTEFMTYGNXLDYXRECNRQEXNAVXXLYXXTQXSSXXEYXEKKNFXXRDXXXRNXLXGENHLXKXADXGXSRLMTGDTYTAHAGAKXPIKWTXPESXAYNKFSIKSDXXAXGXXXWEIATYGMSPXPGIDLSQXYELXEKDYRXERPEGXPEKVYELXRAXXQWNPSDRPSXAEXHQAXETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 94 - protein, 1210 aa, Homo sapiens
  SITE (41)..(41): Xaa at position 41 is Leu, Ala, Val, Gly, or Ile
  SITE (55)..(55): Xaa at position 55 is Phe, Tyr, Met, His, Ile, Leu, Val Ala, or Gly
  SITE (58)..(58): Xaa at position 58 is Cys, Ala, Val, Gly, Ser, or Thr
  SITE (61)..(61): Xaa at position 61 is Val, Ala, Gly, Leu, or Ile
  SITE (65)..(65): Xaa at position 65 is Leu, Ala, Val, Gly, or Ile
  SITE (67)..(67): Xaa at position 67 is Ile, Ala, Val, Leu, or Gly
  SITE (70)..(70): Xaa at position 70 is Val, Ala, Gly, Leu, or Ile
  SITE (79)..(79): Xaa at position 79 is Leu, Ala, Val, Gly, or Ile
  SITE (82)..(82): Xaa at position 82 is Ile, Ala, Val, Leu, or Gly
  SITE (85)..(85): Xaa at position 85 is Val, Ala, Gly, Leu, or Ile
  SITE (88)..(88): Xaa at position 88 is Tyr, Phe, Met, His, Ile, Leu, Val Ala, or Gly
  SITE (89)..(89): Xaa at position 89 is Val, Ala, Gly, Leu, or Ile
  SITE (90)..(90): Xaa at position 90 is Leu, Ala, Val, Gly, or Ile
  SITE (91)..(91): Xaa at position 91 is Ile, Ala, Val, Leu, or Gly
  SITE (92)..(92): Xaa at position 92 is Ala, Gly, or Pro
  SITE (96)..(96): Xaa at position 96 is Val, Ala, Gly, Leu, or Ile
  SITE (99)..(99): Xaa at position 99 is Ile, Ala, Val, Leu, or Gly
  SITE (101)..(101): Xaa at position 101 is Leu, Ala, Val, Gly, or Ile
  SITE (104)..(104): Xaa at position 104 is Leu, Ala, Val, Gly, or Ile
  SITE (106)..(106): Xaa at position 106 is Ile, Ala, Val, Leu, or Gly
  SITE (107)..(107): Xaa at position 107 is Ile, Ala, Val, Leu, or Gly
  SITE (118)..(118): Xaa at position 118 is Ala, Gly, or Pro
  SITE (119)..(119): Xaa at position 119 is Leu, Ala, Val, Gly, or Ile
  SITE (120)..(120): Xaa at position 120 is Ala, Gly, or Pro
  SITE (121)..(121): Xaa at position 121 is Val, Ala, Gly, Leu, or Ile
  SITE (132)..(132): Xaa at position 132 is Leu, Ala, Val, Gly, or Ile
  SITE (135)..(135): Xaa at position 135 is Leu, Ala, Val, Gly, or Ile
  SITE (137)..(137): Xaa at position 137 is Met, Ile, Leu, Val, Ala, or Gly
  SITE (140)..(140): Xaa at position 140 is Leu, Ala, Val, Gly, or Ile
  SITE (143)..(143): Xaa at position 143 is Ile, Ala, Val, Leu, or Gly
  SITE (147)..(147): Xaa at position 147 is Ala, Gly, or Pro
  SITE (148)..(148): Xaa at position 148 is Val, Ala, Gly, Leu, or Ile
  SITE (150)..(150): Xaa at position 150 is Phe, Tyr, Met, His, Ile, Leu, Val Ala, or Gly
  SITE (156)..(156): Xaa at position 156 is Leu, Ala, Val, Gly, or Ile
  SITE (159)..(159): Xaa at position 159 is Val, Ala, Gly, Leu, or Ile
  SITE (167)..(167): Xaa at position 167 is Ile, Ala, Val, Leu, or Gly
  SITE (168)..(168): Xaa at position 168 is Val, Ala, Gly, Leu, or Ile
  SITE (199)..(199): Xaa at position 199 is Cys, Ala, Val, Gly, Ser, or Thr
  SITE (200)..(200): Xaa at position 200 is Trp, Tyr, Phe, Met, His, Ile, Leu Val, Ala, or Gly
  SITE (223)..(223): Xaa at position 223 is Cys, Ala, Val, Gly, Ser, or Thr
  SITE (236)..(236): Xaa at position 236 is Cys, Ala, Val, Gly, Ser, or Thr
  SITE (237)..(237): Xaa at position 237 is Ala, Gly, or Pro
  SITE (238)..(238): Xaa at position 238 is Ala, Gly, or Pro
  SITE (240)..(240): Xaa at position 240 is Cys, Ala, Val, Gly, Ser, or Thr
  SITE (260)..(260): Xaa at position 260 is Cys, Ala, Val, Gly, Ser, or Thr
  SITE (300)..(300): Xaa at position 300 is Val, Ala, Gly, Leu, or Ile
  SITE (301)..(301): Xaa at position 301 is Val, Ala, Gly, Leu, or Ile
  SITE (326)..(326): Xaa at position 326 is Cys, Ala, Val, Gly, Ser, or Thr
  SITE (337)..(337): Xaa at position 337 is Cys, Ala, Val, Gly, Ser, or Thr
  SITE (340)..(340): Xaa at position 340 is Ile, Ala, Val, Leu, or Gly
  SITE (345)..(345): Xaa at position 345 is Phe, Tyr, Met, His, Ile, Leu, Val Ala, or Gly
  SITE (351)..(351): Xaa at position 351 is Ile, Ala, Val, Leu, or Gly
  SITE (356)..(356): Xaa at position 356 is Ile, Ala, Val, Leu, or Gly
  SITE (359)..(359): Xaa at position 359 is Phe, Tyr, Met, His, Ile, Leu, Val Ala, or Gly
  SITE (362)..(362): Xaa at position 362 is Cys, Ala, Val, Gly, Ser, or Thr
  SITE (365)..(365): Xaa at position 365 is Ile, Ala, Val, Leu, or Gly
  SITE (369)..(369): Xaa at position 369 is Leu, Ala, Val, Gly, or Ile
  SITE (371)..(371): Xaa at position 371 is Ile, Ala, Val, Leu, or Gly
  SITE (374)..(374): Xaa at position 374 is Val, Ala, Gly, Leu, or Ile
  SITE (375)..(375): Xaa at position 375 is Ala, Gly, or Pro
  SITE (392)..(392): Xaa at position 392 is Leu, Ala, Val, Gly, or Ile
  SITE (395)..(395): Xaa at position 395 is Leu, Ala, Val, Gly, or Ile
  SITE (398)..(398): Xaa at position 398 is Val, Ala, Gly, Leu, or Ile
  SITE (401)..(401): Xaa at position 401 is Ile, Ala, Val, Leu, or Gly
  SITE (405)..(405): Xaa at position 405 is Leu, Ala, Val, Gly, or Ile
  SITE (406)..(406): Xaa at position 406 is Leu, Ala, Val, Gly, or Ile
  SITE (407)..(407): Xaa at position 407 is Ile, Ala, Val, Leu, or Gly
  SITE (417)..(417): Xaa at position 417 is Leu, Ala, Val, Gly, or Ile
  SITE (419)..(419): Xaa at position 419 is Ala, Gly, or Pro
  SITE (420)..(420): Xaa at position 420 is Phe, Tyr, Met, His, Ile, Leu, Val Ala, or Gly
  SITE (423)..(423): Xaa at position 423 is Leu, Ala, Val, Gly, or Ile
  SITE (426)..(426): Xaa at position 426 is Ile, Ala, Val, Leu, or Gly
  SITE (438)..(438): Xaa at position 438 is Leu, Ala, Val, Gly, or Ile
  SITE (439)..(439): Xaa at position 439 is Ala, Gly, or Pro
  SITE (440)..(440): Xaa at position 440 is Val, Ala, Gly, Leu, or Ile
  SITE (441)..(441): Xaa at position 441 is Val, Ala, Gly, Leu, or Ile
  SITE (443)..(443): Xaa at position 443 is Leu, Ala, Val, Gly, or Ile
  SITE (445)..(445): Xaa at position 445 is Ile, Ala, Val, Leu, or Gly
  SITE (448)..(448): Xaa at position 448 is Leu, Ala, Val, Gly, or Ile
  SITE (450)..(450): Xaa at position 450 is Leu, Ala, Val, Gly, or Ile
  SITE (453)..(453): Xaa at position 453 is Leu, Ala, Val, Gly, or Ile
  SITE (456)..(456): Xaa at position 456 is Ile, Ala, Val, Leu, or Gly
  SITE (461)..(461): Xaa at position 461 is Val, Ala, Gly, Leu, or Ile
  SITE (463)..(463): Xaa at position 463 is Ile, Ala, Val, Leu, or Gly
  SITE (469)..(469): Xaa at position 469 is Leu, Ala, Val, Gly, or Ile
  SITE (470)..(470): Xaa at position 470 is Cys, Ala, Val, Gly, Ser, or Thr
  SITE (471)..(471): Xaa at position 471 is Tyr, Phe, Met, His, Ile, Leu, Val Ala, or Gly
  SITE (472)..(472): Xaa at position 472 is Ala, Gly, or Pro
  SITE (475)..(475): Xaa at position 475 is Ile, Ala, Val, Leu, or Gly
  SITE (480)..(480): Xaa at position 480 is Leu, Ala, Val, Gly, or Ile
  SITE (499)..(499): Xaa at position 499 is Cys, Ala, Val, Gly, Ser, or Thr
  SITE (510)..(510): Xaa at position 510 is Cys, Ala, Val, Gly, Ser, or Thr
  SITE (515)..(515): Xaa at position 515 is Cys, Ala, Val, Gly, Ser, or Thr
  SITE (516)..(516): Xaa at position 516 is Trp, Tyr, Phe, Met, His, Ile, Leu Val, Ala, or Gly
  SITE (571)..(571): Xaa at position 571 is Cys, Ala, Val, Gly, Ser, or Thr
  SITE (624)..(624): Xaa at position 624 is Cys, Ala, Val, Gly, Ser, or Thr
MRPSGTAGAALLALLAALCPASRALEEKKVCQGTSNKLTQXGTFEDHFLSLQRMXNNXEVXLGNXEXTYXQRNYDLSFXKTXQEXAGXXXXXLNTXERXPXENXQXXRGNMYYENSYXXXXLSNYDANKTGXKEXPXRNXQEXLHGXXRXSNNPAXCNXESIQWRDXXSSDFLSNMSMDFQNHLGSCQKCDPSCPNGSXXGAGEENCQKLTKIICAQQCSGRXRGKSPSDCCHNQXXXGXTGPRESDCLVCRKFRDEATXKDTCPPLMLYNPTTYQMDVNPEGKYSFGATCVKKCPRNYXXTDHGSCVRACGADSYEMEEDGVRKXKKCEGPCRKVXNGXGIGEXKDSLSXNATNXKHXKNXTSXSGDXHXLPXXFRGDSFTHTPPLDPQEXDIXKTXKEXTGFXXXQAWPENRTDXHXXENXEIXRGRTKQHGQFSXXXXSXNXTSXGXRSXKEXSDGDXIXSGNKNXXXXNTXNWKKXFGTSGQKTKIISNRGENSXKATGQVCHALXSPEGXXGPEPRDCVSCRNVSRGRECVDKCNLLEGEPREFVENSECIQCHPECLPQAMNITXTGRGPDNCIQCAHYIDGPHCVKTCPAGVMGENNTLVWKYADAGHVCHLCHPNXTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 95 - protein, 194 aa, Homo sapiens
  SITE (5)..(5): Xaa at position 5 is Leu, Ala, Val, Gly, or Ile
  SITE (10)..(10): Xaa at position 10 is Ile, Ala, Val, Leu, or Gly
  SITE (12)..(12): Xaa at position 12 is Phe, Tyr, Met, His, Ile, Leu, Val Ala, or Gly
  SITE (13)..(13): Xaa at position 13 is Val, Ala, Gly, Leu, or Ile
  SITE (14)..(14): Xaa at position 14 is Val, Ala, Gly, Leu, or Ile
  SITE (25)..(25): Xaa at position 25 is Cys, Ala, Val, Gly, Ser, or Thr
  SITE (28)..(28): Xaa at position 28 is Ile, Ala, Val, Leu, or Gly
  SITE (60)..(60): Xaa at position 60 is Ile, Ala, Val, Leu, or Gly
  SITE (73)..(73): Xaa at position 73 is Leu, Ala, Val, Gly, or Ile
  SITE (76)..(76): Xaa at position 76 is Leu, Ala, Val, Gly, or Ile
  SITE (80)..(80): Xaa at position 80 is Met, Ile, Leu, Val, Ala, or Gly
  SITE (90)..(90): Xaa at position 90 is Phe, Tyr, Met, His, Ile, Leu, Val Ala, or Gly
  SITE (91)..(91): Xaa at position 91 is Leu, Ala, Val, Gly, or Ile
  SITE (92)..(92): Xaa at position 92 is Ile, Ala, Val, Leu, or Gly
  SITE (95)..(95): Xaa at position 95 is Tyr, Phe, Met, His, Ile, Leu, Val Ala, or Gly
  SITE (105)..(105): Xaa at position 105 is Phe, Tyr, Met, His, Ile, Leu, Val Ala, or Gly
  SITE (109)..(109): Xaa at position 109 is Ile, Ala, Val, Leu, or Gly
  SITE (114)..(114): Xaa at position 114 is Leu, Ala, Val, Gly, or Ile
  SITE (115)..(115): Xaa at position 115 is Leu, Ala, Val, Gly, or Ile
  SITE (116)..(116): Xaa at position 116 is Leu, Ala, Val, Gly, or Ile
  SITE (118)..(118): Xaa at position 118 is Val, Ala, Gly, Leu, or Ile
  SITE (125)..(125): Xaa at position 125 is Met, Ile, Leu, Val, Ala, or Gly
  SITE (146)..(146): Xaa at position 146 is Ile, Ala, Val, Leu, or Gly
  SITE (160)..(160): Xaa at position 160 is Val, Ala, Gly, Leu, or Ile
  SITE (164)..(164): Xaa at position 164 is Tyr, Phe, Met, His, Ile, Leu, Val Ala, or Gly
  SITE (173)..(173): Xaa at position 173 is Val, Ala, Gly, Leu, or Ile
  SITE (186)..(186): Xaa at position 186 is Val, Ala, Gly, Leu, or Ile
MEEKXKKTKXIXXXGGPGSGKGTQXEKXVQKYGYTHLSTGDLLRSEVSSGSARGKKLSEXMEKGQLVPLETVXDMXRDAXVAKVNTSKGXXXDGXPREVQQGEEXERRXGQPTXXXYXDAGPETXTQRLLKRGETSGRVDDNEETXKKRLETYYKATEPXIAFXEKRGIVRKXNAEGSVDSVFSQXCTHLDALK

SEQ ID NO: 96 - protein, 622 aa, Homo sapiens
  SITE (87)..(87): Xaa at position 87 is Tyr, Phe, Met, His, Ile, Leu, Val Ala, or Gly
  SITE (90)..(90): Xaa at position 90 is Cys, Ala, Val, Gly, Ser, or Thr
  SITE (93)..(93): Xaa at position 93 is Ala, Gly, or Pro
  SITE (100)..(100): Xaa at position 100 is Leu, Ala, Val, Gly, or Ile
  SITE (103)..(103): Xaa at position 103 is Cys, Ala, Val, Gly, Ser, or Thr
  SITE (109)..(109): Xaa at position 109 is Ala, Gly, or Pro
  SITE (116)..(116): Xaa at position 116 is Tyr, Phe, Met, His, Ile, Leu, Val Ala, or Gly
  SITE (129)..(129): Xaa at position 129 is Cys, Ala, Val, Gly, Ser, or Thr
  SITE (157)..(157): Xaa at position 157 is Cys, Ala, Val, Gly, Ser, or Thr
  SITE (168)..(168): Xaa at position 168 is Trp, Tyr, Phe, Met, His, Ile, Leu Val, Ala, or Gly
  SITE (169)..(169): Xaa at position 169 is Cys, Ala, Val, Gly, Ser, or Thr
  SITE (170)..(170): Xaa at position 170 is Tyr, Phe, Met, His, Ile, Leu, Val Ala, or Gly
  SITE (181)..(181): Xaa at position 181 is Cys, Ala, Val, Gly, Ser, or Thr
  SITE (183)..(183): Xaa at position 183 is Ile, Ala, Val, Leu, or Gly
  SITE (242)..(242): Xaa at position 242 is Ala, Gly, or Pro
  SITE (262)..(262): Xaa at position 262 is Cys, Ala, Val, Gly, Ser, or Thr
  SITE (272)..(272): Xaa at position 272 is Val, Ala, Gly, Leu, or Ile
  SITE (273)..(273): Xaa at position 273 is Trp, Tyr, Phe, Met, His, Ile, Leu Val, Ala, or Gly
  SITE (274)..(274): Xaa at position 274 is Cys, Ala, Val, Gly, Ser, or Thr
  SITE (285)..(285): Xaa at position 285 is Tyr, Phe, Met, His, Ile, Leu, Val Ala, or Gly
  SITE (286)..(286): Xaa at position 286 is Cys, Ala, Val, Gly, Ser, or Thr
  SITE (295)..(295): Xaa at position 295 is Val, Ala, Gly, Leu, or Ile
  SITE (324)..(324): Xaa at position 324 is Phe, Tyr, Met, His, Ile, Leu, Val Ala, or Gly
  SITE (329)..(329): Xaa at position 329 is Phe, Tyr, Met, His, Ile, Leu, Val Ala, or Gly
  SITE (336)..(336): Xaa at position 336 is Cys, Ala, Val, Gly, Ser, or Thr
  SITE (355)..(355): Xaa at position 355 is Leu, Ala, Val, Gly, or Ile
  SITE (364)..(364): Xaa at position 364 is Ile, Ala, Val, Leu, or Gly
  SITE (365)..(365): Xaa at position 365 is Val, Ala, Gly, Leu, or Ile
  SITE (370)..(370): Xaa at position 370 is Ala, Gly, or Pro
  SITE (374)..(374): Xaa at position 374 is Met, Ile, Leu, Val, Ala, or Gly
  SITE (377)..(377): Xaa at position 377 is Trp, Tyr, Phe, Met, His, Ile, Leu Val, Ala, or Gly
  SITE (379)..(379): Xaa at position 379 is Val, Ala, Gly, Leu, or Ile
  SITE (380)..(380): Xaa at position 380 is Met, Ile, Leu, Val, Ala, or Gly
  SITE (381)..(381): Xaa at position 381 is Leu, Ala, Val, Gly, or Ile
  SITE (382)..(382): Xaa at position 382 is Phe, Tyr, Met, His, Ile, Leu, Val Ala, or Gly
  SITE (390)..(390): Xaa at position 390 is Leu, Ala, Val, Gly, or Ile
  SITE (391)..(391): Xaa at position 391 is Cys, Ala, Val, Gly, Ser, or Thr
  SITE (393)..(393): Xaa at position 393 is Ala, Gly, or Pro
  SITE (395)..(395): Xaa at position 395 is Leu, Ala, Val, Gly, or Ile
  SITE (396)..(396): Xaa at position 396 is Ile, Ala, Val, Leu, or Gly
  SITE (400)..(400): Xaa at position 400 is Trp, Tyr, Phe, Met, His, Ile, Leu Val, Ala, or Gly
  SITE (401)..(401): Xaa at position 401 is Val, Ala, Gly, Leu, or Ile
  SITE (402)..(402): Xaa at position 402 is Leu, Ala, Val, Gly, or Ile
  SITE (404)..(404): Xaa at position 404 is Ala, Gly, or Pro
  SITE (405)..(405): Xaa at position 405 is Ala, Gly, or Pro
  SITE (406)..(406): Xaa at position 406 is His, Phe, Tyr, Lys, Arg, Gly, Ser Thr, Ala, Val, Leu, Ile, Asn, Met, or Gln
  SITE (407)..(407): Xaa at position 407 is Cys, Ala, Val, Gly, Ser, or Thr
  SITE (408)..(408): Xaa at position 408 is Leu, Ala, Val, Gly, or Ile
  SITE (409)..(409): Xaa at position 409 is Leu, Ala, Val, Gly, or Ile
  SITE (422)..(422): Xaa at position 422 is Leu, Ala, Val, Gly, or Ile
  SITE (423)..(423): Xaa at position 423 is Leu, Ala, Val, Gly, or Ile
  SITE (424)..(424): Xaa at position 424 is Val, Ala, Gly, Leu, or Ile
  SITE (426)..(426): Xaa at position 426 is Ile, Ala, Val, Leu, or Gly
  SITE (444)..(444): Xaa at position 444 is Leu, Ala, Val, Gly, or Ile
  SITE (450)..(450): Xaa at position 450 is His, Phe, Tyr, Lys, Arg, Gly, Ser Thr, Ala, Val, Leu, Ile, Asn, Met, or Gln
  SITE (463)..(463): Xaa at position 463 is Ile, Ala, Val, Leu, or Gly
  SITE (464)..(464): Xaa at position 464 is Ala, Gly, or Pro
  SITE (465)..(465): Xaa at position 465 is Leu, Ala, Val, Gly, or Ile
  SITE (466)..(466): Xaa at position 466 is Met, Ile, Leu, Val, Ala, or Gly
  SITE (468)..(468): Xaa at position 468 is Leu, Ala, Val, Gly, or Ile
  SITE (472)..(472): Xaa at position 472 is Val, Ala, Gly, Leu, or Ile
  SITE (478)..(478): Xaa at position 478 is Ile, Ala, Val, Leu, or Gly
  SITE (479)..(479): Xaa at position 479 is His, Phe, Tyr, Lys, Arg, Gly, Ser Thr, Ala, Val, Leu, Ile, Asn, Met, or Gln
  SITE (481)..(481): Xaa at position 481 is Val, Ala, Gly, Leu, or Ile
  SITE (482)..(482): Xaa at position 482 is Cys, Ala, Val, Gly, Ser, or Thr
  SITE (483)..(483): Xaa at position 483 is Leu, Ala, Val, Gly, or Ile
  SITE (489)..(489): Xaa at position 489 is Ala, Gly, or Pro
  SITE (492)..(492): Xaa at position 492 is Leu, Ala, Val, Gly, or Ile
  SITE (493)..(493): Xaa at position 493 is Leu, Ala, Val, Gly, or Ile
  SITE (495)..(495): Xaa at position 495 is Ala, Gly, or Pro
  SITE (501)..(501): Xaa at position 501 is Val, Ala, Gly, Leu, or Ile
  SITE (504)..(504): Xaa at position 504 is Trp, Tyr, Phe, Met, His, Ile, Leu Val, Ala, or Gly
  SITE (507)..(507): Xaa at position 507 is Leu, Ala, Val, Gly, or Ile
  SITE (523)..(523): Xaa at position 523 is Leu, Ala, Val, Gly, or Ile
  SITE (525)..(525): Xaa at position 525 is Val, Ala, Gly, Leu, or Ile
  SITE (526)..(526): Xaa at position 526 is Val, Ala, Gly, Leu, or Ile
  SITE (528)..(528): Xaa at position 528 is Leu, Ala, Val, Gly, or Ile
  SITE (530)..(530): Xaa at position 530 is Ile, Ala, Val, Leu, or Gly
  SITE (531)..(531): Xaa at position 531 is Val, Ala, Gly, Leu, or Ile
  SITE (536)..(536): Xaa at position 536 is Cys, Ala, Val, Gly, Ser, or Thr
  SITE (544)..(544): Xaa at position 544 is Ile, Ala, Val, Leu, or Gly
  SITE (548)..(548): Xaa at position 548 is Met, Ile, Leu, Val, Ala, or Gly
  SITE (549)..(549): Xaa at position 549 is Phe, Tyr, Met, His, Ile, Leu, Val Ala, or Gly
  SITE (550)..(550): Xaa at position 550 is Cys, Ala, Val, Gly, Ser, or Thr
  SITE (551)..(551): Xaa at position 551 is Ala, Gly, or Pro
  SITE (563)..(563): Xaa at position 563 is Ala, Gly, or Pro
  SITE (564)..(564): Xaa at position 564 is Cys, Ala, Val, Gly, Ser, or Thr
  SITE (572)..(572): Xaa at position 572 is Phe, Tyr, Met, His, Ile, Leu, Val Ala, or Gly
  SITE (573)..(573): Xaa at position 573 is Val, Ala, Gly, Leu, or Ile
  SITE (574)..(574): Xaa at position 574 is Met, Ile, Leu, Val, Ala, or Gly
  SITE (582)..(582): Xaa at position 582 is Trp, Tyr, Phe, Met, His, Ile, Leu Val, Ala, or Gly
  SITE (585)..(585): Xaa at position 585 is Met, Ile, Leu, Val, Ala, or Gly
  SITE (587)..(587): Xaa at position 587 is Ile, Ala, Val, Leu, or Gly
  SITE (588)..(588): Xaa at position 588 is Val, Ala, Gly, Leu, or Ile
  SITE (594)..(594): Xaa at position 594 is Cys, Ala, Val, Gly, Ser, or Thr
  SITE (600)..(600): Xaa at position 600 is Tyr, Phe, Met, His, Ile, Leu, Val Ala, or Gly
  SITE (602)..(602): Xaa at position 602 is Phe, Tyr, Met, His, Ile, Leu, Val Ala, or Gly
  SITE (603)..(603): Xaa at position 603 is Tyr, Phe, Met, His, Ile, Leu, Val Ala, or Gly
  SITE (605)..(605): Xaa at position 605 is His, Phe, Tyr, Lys, Arg, Gly, Ser Thr, Ala, Val, Leu, Ile, Asn, Met, or Gln
  SITE (606)..(606): Xaa at position 606 is Val, Ala, Gly, Leu, or Ile
  SITE (607)..(607): Xaa at position 607 is Phe, Tyr, Met, His, Ile, Leu, Val Ala, or Gly
  SITE (609)..(609): Xaa at position 609 is Leu, Ala, Val, Gly, or Ile
  SITE (612)..(612): Xaa at position 612 is Trp, Tyr, Phe, Met, His, Ile, Leu Val, Ala, or Gly
  SITE (613)..(613): Xaa at position 613 is Ile, Ala, Val, Leu, or Gly
  SITE (616)..(616): Xaa at position 616 is Val, Ala, Gly, Leu, or Ile
  SITE (617)..(617): Xaa at position 617 is Ile, Ala, Val, Leu, or Gly
MAHVRGLQLPGCLALAALCSLVHSQHVFLAPQQARSLLQRVRRANTFLEEVRKGNLERECVEETCSYEEAFEALESSTATDVFWAKXTAXETXRTPRDKXAAXLEGNCXEGLGTNXRGHVNITRSGIEXQLWRSRYPHKPEINSTTHPGADLQENFXRNPDSSTTGPXXXTTDPTVRRQEXSXPVCGQDQVTVAMTPRSEGSSVNLSPPLEQCVPDRGQQYQGRLAVTTHGLPCLAWASAQXKALSKHQDFNSAVQLVENFXRNPDGDEEGXXXYVAGKPGDFGXXDLNYCEEAXEEETGDGLDEDSDRAIEGRTATSEYQTFXNPRTXGSGEADXGLRPLFEKKSLEDKTEREXLESYIDGRXXEGSDXEIGXSPXQXXXXRKSPQELXXGXSXXSDRXXXTXXXXXXYPPWDKNFTENDXXXRXGKHSRTRYERNIEKISMXEKIYIXPRYNWRENLDRDXXXXKXKKPXAFSDYXXPXXXPDRETXASXXQXGYKGRXTGXGNXKETWTANVGKGQPSVXQXXNXPXXERPVXKDSTRIRXTDNXXXXGYKPDEGKRGDXXEGDSGGPXXXKSPFNNRXYQXGXXSWGEGXDRDGKXGXXTXXXRXKKXXQKXXDQFGE

SEQ ID NO: 97 - protein, 461 aa, Homo sapiens
  SITE (128)..(128): Xaa at position 128 is Cys, Ala, Val, Gly, Ser, or Thr
  SITE (132)..(132): Xaa at position 132 is Val, Ala, Gly, Leu, or Ile
  SITE (227)..(227): Xaa at position 227 is Val, Ala, Gly, Leu, or Ile
  SITE (233)..(233): Xaa at position 233 is Ala, Gly, or Pro
  SITE (242)..(242): Xaa at position 242 is Val, Ala, Gly, Leu, or Ile
  SITE (243)..(243): Xaa at position 243 is Val, Ala, Gly, Leu, or Ile
  SITE (244)..(244): Xaa at position 244 is Leu, Ala, Val, Gly, or Ile
  SITE (256)..(256): Xaa at position 256 is Ile, Ala, Val, Leu, or Gly
  SITE (257)..(257): Xaa at position 257 is Val, Ala, Gly, Leu, or Ile
  SITE (262)..(262): Xaa at position 262 is Ile, Ala, Val, Leu, or Gly
  SITE (263)..(263): Xaa at position 263 is Val, Ala, Gly, Leu, or Ile
  SITE (265)..(265): Xaa at position 265 is Ala, Gly, or Pro
  SITE (266)..(266): Xaa at position 266 is Ala, Gly, or Pro
  SITE (275)..(275): Xaa at position 275 is Ile, Ala, Val, Leu, or Gly
  SITE (277)..(277): Xaa at position 277 is Val, Ala, Gly, Leu, or Ile
  SITE (278)..(278): Xaa at position 278 is Val, Ala, Gly, Leu, or Ile
  SITE (279)..(279): Xaa at position 279 is Ala, Gly, or Pro
  SITE (316)..(316): Xaa at position 316 is Ile, Ala, Val, Leu, or Gly
  SITE (317)..(317): Xaa at position 317 is Ala, Gly, or Pro
  SITE (318)..(318): Xaa at position 318 is Leu, Ala, Val, Gly, or Ile
  SITE (319)..(319): Xaa at position 319 is Leu, Ala, Val, Gly, or Ile
  SITE (321)..(321): Xaa at position 321 is Leu, Ala, Val, Gly, or Ile
  SITE (331)..(331): Xaa at position 331 is Val, Ala, Gly, Leu, or Ile
  SITE (353)..(353): Xaa at position 353 is Val, Ala, Gly, Leu, or Ile
  SITE (356)..(356): Xaa at position 356 is Trp, Tyr, Phe, Met, His, Ile, Leu Val, Ala, or Gly
  SITE (369)..(369): Xaa at position 369 is Leu, Ala, Val, Gly, or Ile
  SITE (374)..(374): Xaa at position 374 is Val, Ala, Gly, Leu, or Ile
  SITE (382)..(382): Xaa at position 382 is Cys, Ala, Val, Gly, Ser, or Thr
  SITE (395)..(395): Xaa at position 395 is Phe, Tyr, Met, His, Ile, Leu, Val Ala, or Gly
  SITE (396)..(396): Xaa at position 396 is Cys, Ala, Val, Gly, Ser, or Thr
  SITE (397)..(397): Xaa at position 397 is Ala, Gly, or Pro
  SITE (415)..(415): Xaa at position 415 is His, Phe, Tyr, Lys, Arg, Gly, Ser Thr, Ala, Val, Leu, Ile, Asn, Met, or Gln
  SITE (416)..(416): Xaa at position 416 is Val, Ala, Gly, Leu, or Ile
  SITE (425)..(425): Xaa at position 425 is Leu, Ala, Val, Gly, or Ile
  SITE (428)..(428): Xaa at position 428 is Ile, Ala, Val, Leu, or Gly
  SITE (443)..(443): Xaa at position 443 is Ile, Ala, Val, Leu, or Gly
  SITE (444)..(444): Xaa at position 444 is Tyr, Phe, Met, His, Ile, Leu, Val Ala, or Gly
  SITE (447)..(447): Xaa at position 447 is Val, Ala, Gly, Leu, or Ile
  SITE (450)..(450): Xaa at position 450 is Tyr, Phe, Met, His, Ile, Leu, Val Ala, or Gly
  SITE (451)..(451): Xaa at position 451 is Val, Ala, Gly, Leu, or Ile
  SITE (454)..(454): Xaa at position 454 is Ile, Ala, Val, Leu, or Gly
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNXELDXTCNIKNGRCEQFCKNSADNKVVCSCTEGYRLAENQKSCEPAVPFPCGRVSVSQTSKLTRAETVFPDVDYVNSTEAETILDNITQSTQSFNDFTRXVGGEDXKPGQFPWQXXXNGKVDAFCGGSXXNEKWXXTXXHCVETGVKXTXXXGEHNIEETEHTEQKRNVIRIIPHHNYNAAINKYNHDXXXXEXDEPLVLNSYXTPICIADKEYTNIFLKFGSGYXSGXGRVFHKGRSALVXQYLRXPLVDRATXLRSTKFTIYNNMXXXGFHEGGRDSCQGDSGGPXXTEVEGTSFXTGXISWGEECAMKGKYGXXTKXSRXXNWXKEKTKLT

SEQ ID NO: 98 - protein, 488 aa, Homo sapiens
  SITE (121)..(121): Xaa at position 121 is Cys, Ala, Val, Gly, Ser, or Thr
  SITE (136)..(136): Xaa at position 136 is Cys, Ala, Val, Gly, Ser, or Thr
  SITE (235)..(235): Xaa at position 235 is Ile, Ala, Val, Leu, or Gly
  SITE (236)..(236): Xaa at position 236 is Val, Ala, Gly, Leu, or Ile
  SITE (241)..(241): Xaa at position 241 is Cys, Ala, Val, Gly, Ser, or Thr
  SITE (246)..(246): Xaa at position 246 is Cys, Ala, Val, Gly, Ser, or Thr
  SITE (250)..(250): Xaa at position 250 is Ala, Gly, or Pro
  SITE (251)..(251): Xaa at position 251 is Leu, Ala, Val, Gly, or Ile
  SITE (252)..(252): Xaa at position 252 is Leu, Ala, Val, Gly, or Ile
  SITE (253)..(253): Xaa at position 253 is Ile, Ala, Val, Leu, or Gly
  SITE (261)..(261): Xaa at position 261 is Cys, Ala, Val, Gly, Ser, or Thr
  SITE (265)..(265): Xaa at position 265 is Ile, Ala, Val, Leu, or Gly
  SITE (266)..(266): Xaa at position 266 is Leu, Ala, Val, Gly, or Ile
  SITE (271)..(271): Xaa at position 271 is Ile, Ala, Val, Leu, or Gly
  SITE (272)..(272): Xaa at position 272 is Leu, Ala, Val, Gly, or Ile
  SITE (274)..(274): Xaa at position 274 is Ala, Gly, or Pro
  SITE (275)..(275): Xaa at position 275 is Ala, Gly, or Pro
  SITE (277)..(277): Xaa at position 277 is Cys, Ala, Val, Gly, Ser, or Thr
  SITE (286)..(286): Xaa at position 286 is Val, Ala, Gly, Leu, or Ile
  SITE (288)..(288): Xaa at position 288 is Val, Ala, Gly, Leu, or Ile
  SITE (302)..(302): Xaa at position 302 is Val, Ala, Gly, Leu, or Ile
  SITE (309)..(309): Xaa at position 309 is Ile, Ala, Val, Leu, or Gly
  SITE (311)..(311): Xaa at position 311 is His, Phe, Tyr, Lys, Arg, Gly, Ser Thr, Ala, Val, Leu, Ile, Asn, Met, or Gln
  SITE (323)..(323): Xaa at position 323 is Ile, Ala, Val, Leu, or Gly
  SITE (324)..(324): Xaa at position 324 is Ala, Gly, or Pro
  SITE (325)..(325): Xaa at position 325 is Val, Ala, Gly, Leu, or Ile
  SITE (326)..(326): Xaa at position 326 is Leu, Ala, Val, Gly, or Ile
  SITE (328)..(328): Xaa at position 328 is Leu, Ala, Val, Gly, or Ile
  SITE (338)..(338): Xaa at position 338 is Val, Ala, Gly, Leu, or Ile
  SITE (341)..(341): Xaa at position 341 is Ala, Gly, or Pro
  SITE (342)..(342): Xaa at position 342 is Cys, Ala, Val, Gly, Ser, or Thr
  SITE (349)..(349): Xaa at position 349 is Ala, Gly, or Pro
  SITE (353)..(353): Xaa at position 353 is Leu, Ala, Val, Gly, or Ile
  SITE (359)..(359): Xaa at position 359 is Gly, Ala, or Pro
  SITE (361)..(361): Xaa at position 361 is Val, Ala, Gly, Leu, or Ile
  SITE (364)..(364): Xaa at position 364 is Phe, Tyr, Met, His, Ile, Leu, Val Ala, or Gly
  SITE (377)..(377): Xaa at position 377 is Leu, Ala, Val, Gly, or Ile
  SITE (379)..(379): Xaa at position 379 is Met, Ile, Leu, Val, Ala, or Gly
  SITE (380)..(380): Xaa at position 380 is Leu, Ala, Val, Gly, or Ile
  SITE (382)..(382): Xaa at position 382 is Val, Ala, Gly, Leu, or Ile
  SITE (390)..(390): Xaa at position 390 is Cys, Ala, Val, Gly, Ser, or Thr
  SITE (392)..(392): Xaa at position 392 is Leu, Ala, Val, Gly, or Ile
  SITE (402)..(402): Xaa at position 402 is Met, Ile, Leu, Val, Ala, or Gly
  SITE (404)..(404): Xaa at position 404 is Cys, Ala, Val, Gly, Ser, or Thr
  SITE (405)..(405): Xaa at position 405 is Ala, Gly, or Pro
  SITE (423)..(423): Xaa at position 423 is His, Phe, Tyr, Lys, Arg, Gly, Ser Thr, Ala, Val, Leu, Ile, Asn, Met, or Gln
  SITE (424)..(424): Xaa at position 424 is Val, Ala, Gly, Leu, or Ile
  SITE (432)..(432): Xaa at position 432 is Phe, Tyr, Met, His, Ile, Leu, Val Ala, or Gly
  SITE (433)..(433): Xaa at position 433 is Val, Ala, Gly, Leu, or Ile
  SITE (436)..(436): Xaa at position 436 is Ile, Ala, Val, Leu, or Gly
  SITE (444)..(444): Xaa at position 444 is Ala, Gly, or Pro
  SITE (451)..(451): Xaa at position 451 is Ile, Ala, Val, Leu, or Gly
  SITE (452)..(452): Xaa at position 452 is Tyr, Phe, Met, His, Ile, Leu, Val Ala, or Gly
  SITE (455)..(455): Xaa at position 455 is Val, Ala, Gly, Leu, or Ile
  SITE (458)..(458): Xaa at position 458 is Phe, Tyr, Met, His, Ile, Leu, Val Ala, or Gly
  SITE (461)..(461): Xaa at position 461 is Trp, Tyr, Phe, Met, His, Ile, Leu Val, Ala, or Gly
  SITE (462)..(462): Xaa at position 462 is Ile, Ala, Val, Leu, or Gly
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNXELFTRKLCSLDNGDXDQFCHEEQNSVVCSCARGYTLADNGKACIPTGPYPCGKQTLERRKRSVAQATSSSGEAPDSITWKPYDAADLDPTENPFDLLDFNQTQPERGDNNLTRXXGGQEXKDGEXPWQXXXXNEENEGFXGGTXXSEFYXXTXXHXLYQAKRFKXRXGDRNTEQEEGGEAXHEVEVVXKXNRFTKETYDFDXXXXRXKTPITFRMNXAPXXLPERDWXESTXMTQKTXIXSGXGRTHEKGRQSTRXKXXEXPYVDRNSXKXSSSFIITQNXFXXGYDTKQEDACQGDSGGPXXTRFKDTYXXTGXVSWGEGCXRKGKYGXXTKXTAXLKXXDRSMKTRGLPKAKSHAPEVITSSPLK

SEQ ID NO: 99 - protein, 253 aa, Homo sapiens
  SITE (26)..(26): Xaa at position 26 is Ile, Ala, Val, Leu, or Gly
  SITE (27)..(27): Xaa at position 27 is Leu, Ala, Val, Gly, or Ile
  SITE (40)..(40): Xaa at position 40 is Met, Ile, Leu, Val, Ala, or Gly
  SITE (41)..(41): Xaa at position 41 is Ala, Gly, or Pro
  SITE (43)..(43): Xaa at position 43 is Val, Ala, Gly, Leu, or Ile
  SITE (51)..(51): Xaa at position 51 is Cys, Ala, Val, Gly, Ser, or Thr
  SITE (54)..(54): Xaa at position 54 is Val, Ala, Gly, Leu, or Ile
  SITE (55)..(55): Xaa at position 55 is Leu, Ala, Val, Gly, or Ile
  SITE (61)..(61): Xaa at position 61 is Val, Ala, Gly, Leu, or Ile
  SITE (62)..(62): Xaa at position 62 is Leu, Ala, Val, Gly, or Ile
  SITE (64)..(64): Xaa at position 64 is Ala, Gly, or Pro
  SITE (67)..(67): Xaa at position 67 is Cys, Ala, Val, Gly, Ser, or Thr
  SITE (78)..(78): Xaa at position 78 is Val, Ala, Gly, Leu, or Ile
  SITE (80)..(80): Xaa at position 80 is Leu, Ala, Val, Gly, or Ile
  SITE (115)..(115): Xaa at position 115 is Leu, Ala, Val, Gly, or Ile
  SITE (116)..(116): Xaa at position 116 is Leu, Ala, Val, Gly, or Ile
  SITE (117)..(117): Xaa at position 117 is Leu, Ala, Val, Gly, or Ile
  SITE (118)..(118): Xaa at position 118 is Leu, Ala, Val, Gly, or Ile
  SITE (120)..(120): Xaa at position 120 is Leu, Ala, Val, Gly, or Ile
  SITE (126)..(126): Xaa at position 126 is Leu, Ala, Val, Gly, or Ile
  SITE (133)..(133): Xaa at position 133 is Leu, Ala, Val, Gly, or Ile
  SITE (148)..(148): Xaa at position 148 is Cys, Ala, Val, Gly, Ser, or Thr
  SITE (150)..(150): Xaa at position 150 is Val, Ala, Gly, Leu, or Ile
  SITE (151)..(151): Xaa at position 151 is Ala, Gly, or Pro
  SITE (153)..(153): Xaa at position 153 is Trp, Tyr, Phe, Met, His, Ile, Leu Val, Ala, or Gly
  SITE (169)..(169): Xaa at position 169 is Val, Ala, Gly, Leu, or Ile
  SITE (171)..(171): Xaa at position 171 is Leu, Ala, Val, Gly, or Ile
  SITE (179)..(179): Xaa at position 179 is Cys, Ala, Val, Gly, Ser, or Thr
  SITE (189)..(189): Xaa at position 189 is Ile, Ala, Val, Leu, or Gly
  SITE (193)..(193): Xaa at position 193 is Leu, Ala, Val, Gly, or Ile
  SITE (195)..(195): Xaa at position 195 is Cys, Ala, Val, Gly, Ser, or Thr
  SITE (196)..(196): Xaa at position 196 is Ala, Gly, or Pro
  SITE (204)..(204): Xaa at position 204 is Cys, Ala, Val, Gly, Ser, or Thr
  SITE (212)..(212): Xaa at position 212 is Leu, Ala, Val, Gly, or Ile
  SITE (218)..(218): Xaa at position 218 is Leu, Ala, Val, Gly, or Ile
  SITE (221)..(221): Xaa at position 221 is Val, Ala, Gly, Leu, or Ile
  SITE (222)..(222): Xaa at position 222 is Val, Ala, Gly, Leu, or Ile
  SITE (229)..(229): Xaa at position 229 is Cys, Ala, Val, Gly, Ser, or Thr
  SITE (238)..(238): Xaa at position 238 is Tyr, Phe, Met, His, Ile, Leu, Val Ala, or Gly
  SITE (241)..(241): Xaa at position 241 is Val, Ala, Gly, Leu, or Ile
  SITE (248)..(248): Xaa at position 248 is Ile, Ala, Val, Leu, or Gly
MHSWERLAVLVLLGAAACAAPPRGRXXGGREAEAHARPYXXSXQLNGAHLXGGXXVAEQWXXSXAHXLEDAADGKVQXLXGAHSLSQPEPSKRLYDVLRAVPHPDSQPDTIDHDXXXXQXSEKATXGPAVRPXPWQRVDRDVAPGTLXDXXGXGIVNHAGRRPDSLQHXLXPVLDRATXNRRTHHDGAXTERXMXXESNRRDSXKGDSGGPXVCGGVXEGXXTSGSRVXGNRKKPGIXTRXASYAAWXDSVLA

SEQ ID NO: 100 - protein, 810 aa, Homo sapiens
  SITE (31)..(31): Xaa at position 31 is Ala, Gly, or Pro
  SITE (49)..(49): Xaa at position 49 is Cys, Ala, Val, Gly, Ser, or Thr
  SITE (53)..(53): Xaa at position 53 is Cys, Ala, Val, Gly, Ser, or Thr
  SITE (61)..(61): Xaa at position 61 is Cys, Ala, Val, Gly, Ser, or Thr
  SITE (63)..(63): Xaa at position 63 is Ala, Gly, or Pro
  SITE (64)..(64): Xaa at position 64 is Phe, Tyr, Met, His, Ile, Leu, Val Ala, or Gly
  SITE (73)..(73): Xaa at position 73 is Cys, Ala, Val, Gly, Ser, or Thr
  SITE (76)..(76): Xaa at position 76 is Met, Ile, Leu, Val, Ala, or Gly
  SITE (111)..(111): Xaa at position 111 is Tyr, Phe, Met, His, Ile, Leu, Val Ala, or Gly
  SITE (127)..(127): Xaa at position 127 is Trp, Tyr, Phe, Met, His, Ile, Leu Val, Ala, or Gly
  SITE (152)..(152): Xaa at position 152 is Cys, Ala, Val, Gly, Ser, or Thr
  SITE (163)..(163): Xaa at position 163 is Trp, Tyr, Phe, Met, His, Ile, Leu Val, Ala, or Gly
  SITE (164)..(164): Xaa at position 164 is Cys, Ala, Val, Gly, Ser, or Thr
  SITE (165)..(165): Xaa at position 165 is Tyr, Phe, Met, His, Ile, Leu, Val Ala, or Gly
  SITE (176)..(176): Xaa at position 176 is Cys, Ala, Val, Gly, Ser, or Thr
  SITE (178)..(178): Xaa at position 178 is Ile, Ala, Val, Leu, or Gly
  SITE (186)..(186): Xaa at position 186 is Met, Ile, Leu, Val, Ala, or Gly
  SITE (193)..(193): Xaa at position 193 is Tyr, Phe, Met, His, Ile, Leu, Val Ala, or Gly
  SITE (209)..(209): Xaa at position 209 is Trp, Tyr, Phe, Met, His, Ile, Leu Val, Ala, or Gly
  SITE (217)..(217): Xaa at position 217 is His, Phe, Tyr, Lys, Arg, Gly, Ser Thr, Ala, Val, Leu, Ile, Asn, Met, or Gln
  SITE (219)..(219): Xaa at position 219 is Tyr, Phe, Met, His, Ile, Leu, Val Ala, or Gly
  SITE (234)..(234): Xaa at position 234 is Cys, Ala, Val, Gly, Ser, or Thr
  SITE (244)..(244): Xaa at position 244 is Trp, Tyr, Phe, Met, His, Ile, Leu Val, Ala, or Gly
  SITE (245)..(245): Xaa at position 245 is Cys, Ala, Val, Gly, Ser, or Thr
  SITE (246)..(246): Xaa at position 246 is Phe, Tyr, Met, His, Ile, Leu, Val Ala, or Gly
  SITE (257)..(257): Xaa at position 257 is Cys, Ala, Val, Gly, Ser, or Thr
  SITE (259)..(259): Xaa at position 259 is Ile, Ala, Val, Leu, or Gly
  SITE (283)..(283): Xaa at position 283 is Tyr, Phe, Met, His, Ile, Leu, Val Ala, or Gly
  SITE (296)..(296): Xaa at position 296 is Cys, Ala, Val, Gly, Ser, or Thr
  SITE (299)..(299): Xaa at position 299 is Trp, Tyr, Phe, Met, His, Ile, Leu Val, Ala, or Gly
  SITE (319)..(319): Xaa at position 319 is Leu, Ala, Val, Gly, or Ile
  SITE (324)..(324): Xaa at position 324 is Cys, Ala, Val, Gly, Ser, or Thr
  SITE (334)..(334): Xaa at position 334 is Trp, Tyr, Phe, Met, His, Ile, Leu Val, Ala, or Gly
  SITE (335)..(335): Xaa at position 335 is Cys, Ala, Val, Gly, Ser, or Thr
  SITE (336)..(336): Xaa at position 336 is His, Phe, Tyr, Lys, Arg, Gly, Ser Thr, Ala, Val, Leu, Ile, Asn, Met, or Gln
  SITE (347)..(347): Xaa at position 347 is Cys, Ala, Val, Gly, Ser, or Thr
  SITE (349)..(349): Xaa at position 349 is Ile, Ala, Val, Leu, or Gly
  SITE (385)..(385): Xaa at position 385 is Tyr, Phe, Met, His, Ile, Leu, Val Ala, or Gly
  SITE (398)..(398): Xaa at position 398 is Cys, Ala, Val, Gly, Ser, or Thr
  SITE (401)..(401): Xaa at position 401 is Trp, Tyr, Phe, Met, His, Ile, Leu Val, Ala, or Gly
  SITE (407)..(407): Xaa at position 407 is His, Phe, Tyr, Lys, Arg, Gly, Ser Thr, Ala, Val, Leu, Ile, Asn, Met, or Gln
  SITE (409)..(409): Xaa at position 409 is His, Phe, Tyr, Lys, Arg, Gly, Ser Thr, Ala, Val, Leu, Ile, Asn, Met, or Gln
  SITE (421)..(421): Xaa at position 421 is Leu, Ala, Val, Gly, or Ile
  SITE (426)..(426): Xaa at position 426 is Cys, Ala, Val, Gly, Ser, or Thr
  SITE (436)..(436): Xaa at position 436 is Trp, Tyr, Phe, Met, His, Ile, Leu Val, Ala, or Gly
  SITE (437)..(437): Xaa at position 437 is Cys, Ala, Val, Gly, Ser, or Thr
  SITE (438)..(438): Xaa at position 438 is Phe, Tyr, Met, His, Ile, Leu, Val Ala, or Gly
  SITE (449)..(449): Xaa at position 449 is Cys, Ala, Val, Gly, Ser, or Thr
  SITE (451)..(451): Xaa at position 451 is Leu, Ala, Val, Gly, or Ile
  SITE (489)..(489): Xaa at position 489 is Tyr, Phe, Met, His, Ile, Leu, Val Ala, or Gly
  SITE (502)..(502): Xaa at position 502 is Cys, Ala, Val, Gly, Ser, or Thr
  SITE (505)..(505): Xaa at position 505 is Trp, Tyr, Phe, Met, His, Ile, Leu Val, Ala, or Gly
  SITE (513)..(513): Xaa at position 513 is His, Phe, Tyr, Lys, Arg, Gly, Ser Thr, Ala, Val, Leu, Ile, Asn, Met, or Gln
  SITE (531)..(531): Xaa at position 531 is Cys, Ala, Val, Gly, Ser, or Thr
  SITE (542)..(542): Xaa at position 542 is Trp, Tyr, Phe, Met, His, Ile, Leu Val, Ala, or Gly
  SITE (543)..(543): Xaa at position 543 is Cys, Ala, Val, Gly, Ser, or Thr
  SITE (544)..(544): Xaa at position 544 is Tyr, Phe, Met, His, Ile, Leu, Val Ala, or Gly
  SITE (555)..(555): Xaa at position 555 is Cys, Ala, Val, Gly, Ser, or Thr
  SITE (557)..(557): Xaa at position 557 is Val, Ala, Gly, Leu, or Ile
  SITE (577)..(577): Xaa at position 577 is Cys, Ala, Val, Gly, Ser, or Thr
  SITE (581)..(581): Xaa at position 581 is Val, Ala, Gly, Leu, or Ile
  SITE (594)..(594): Xaa at position 594 is Trp, Tyr, Phe, Met, His, Ile, Leu Val, Ala, or Gly
  SITE (596)..(596): Xaa at position 596 is Val, Ala, Gly, Leu, or Ile
  SITE (598)..(598): Xaa at position 598 is Leu, Ala, Val, Gly, or Ile
  SITE (607)..(607): Xaa at position 607 is Cys, Ala, Val, Gly, Ser, or Thr
  SITE (611)..(611): Xaa at position 611 is Leu, Ala, Val, Gly, or Ile
  SITE (617)..(617): Xaa at position 617 is Val, Ala, Gly, Leu, or Ile
  SITE (618)..(618): Xaa at position 618 is Leu, Ala, Val, Gly, or Ile
  SITE (620)..(620): Xaa at position 620 is Ala, Gly, or Pro
  SITE (623)..(623): Xaa at position 623 is Cys, Ala, Val, Gly, Ser, or Thr
  SITE (633)..(633): Xaa at position 633 is Tyr, Phe, Met, His, Ile, Leu, Val Ala, or Gly
  SITE (635)..(635): Xaa at position 635 is Val, Ala, Gly, Leu, or Ile
  SITE (636)..(636): Xaa at position 636 is Ile, Ala, Val, Leu, or Gly
  SITE (637)..(637): Xaa at position 637 is Leu, Ala, Val, Gly, or Ile
  SITE (654)..(654): Xaa at position 654 is Val, Ala, Gly, Leu, or Ile
  SITE (666)..(666): Xaa at position 666 is Ile, Ala, Val, Leu, or Gly
  SITE (667)..(667): Xaa at position 667 is Ala, Gly, or Pro
  SITE (668)..(668): Xaa at position 668 is Leu, Ala, Val, Gly, or Ile
  SITE (669)..(669): Xaa at position 669 is Leu, Ala, Val, Gly, or Ile
  SITE (671)..(671): Xaa at position 671 is Leu, Ala, Val, Gly, or Ile
  SITE (681)..(681): Xaa at position 681 is Val, Ala, Gly, Leu, or Ile
  SITE (682)..(682): Xaa at position 682 is Ile, Ala, Val, Leu, or Gly
  SITE (684)..(684): Xaa at position 684 is Ala, Gly, or Pro
  SITE (685)..(685): Xaa at position 685 is Cys, Ala, Val, Gly, Ser, or Thr
  SITE (699)..(699): Xaa at position 699 is Cys, Ala, Val, Gly, Ser, or Thr
  SITE (701)..(701): Xaa at position 701 is Ile, Ala, Val, Leu, or Gly
  SITE (704)..(704): Xaa at position 704 is Trp, Tyr, Phe, Met, His, Ile, Leu Val, Ala, or Gly
  SITE (716)..(716): Xaa at position 716 is Leu, Ala, Val, Gly, or Ile
  SITE (719)..(719): Xaa at position 719 is Ala, Gly, or Pro
  SITE (721)..(721): Xaa at position 721 is Leu, Ala, Val, Gly, or Ile
  SITE (723)..(723): Xaa at position 723 is Val, Ala, Gly, Leu, or Ile
  SITE (729)..(729): Xaa at position 729 is Cys, Ala, Val, Gly, Ser, or Thr
  SITE (735)..(735): Xaa at position 735 is Leu, Ala, Val, Gly, or Ile
  SITE (744)..(744): Xaa at position 744 is Leu, Ala, Val, Gly, or Ile
  SITE (745)..(745): Xaa at position 745 is Cys, Ala, Val, Gly, Ser, or Thr
  SITE (746)..(746): Xaa at position 746 is Ala, Gly, or Pro
  SITE (748)..(748): Xaa at position 748 is His, Phe, Tyr, Lys, Arg, Gly, Ser Thr, Ala, Val, Leu, Ile, Asn, Met, or Gln
  SITE (764)..(764): Xaa at position 764 is Leu, Ala, Val, Gly, or Ile
  SITE (765)..(765): Xaa at position 765 is Val, Ala, Gly, Leu, or Ile
  SITE (766)..(766): Xaa at position 766 is Cys, Ala, Val, Gly, Ser, or Thr
  SITE (772)..(772): Xaa at position 772 is Tyr, Phe, Met, His, Ile, Leu, Val Ala, or Gly
  SITE (774)..(774): Xaa at position 774 is Leu, Ala, Val, Gly, or Ile
  SITE (777)..(777): Xaa at position 777 is Val, Ala, Gly, Leu, or Ile
  SITE (785)..(785): Xaa at position 785 is Ala, Gly, or Pro
  SITE (792)..(792): Xaa at position 792 is Val, Ala, Gly, Leu, or Ile
  SITE (793)..(793): Xaa at position 793 is Tyr, Phe, Met, His, Ile, Leu, Val Ala, or Gly
  SITE (794)..(794): Xaa at position 794 is Val, Ala, Gly, Leu, or Ile
  SITE (796)..(796): Xaa at position 796 is Val, Ala, Gly, Leu, or Ile
  SITE (799)..(799): Xaa at position 799 is Phe, Tyr, Met, His, Ile, Leu, Val Ala, or Gly
  SITE (800)..(800): Xaa at position 800 is Val, Ala, Gly, Leu, or Ile
  SITE (803)..(803): Xaa at position 803 is Ile, Ala, Val, Leu, or Gly
MEHKEVVLLLLLFLKSGQGEPLDDYVNTQGXSLFSVTKKQLGAGSIEEXAAKXEEDEEFTXRXXQYHSKEQQXVIXAENRKSSIIIRMRDVVLFEKKVYLSECKTGNGKNXRGTMSKTKNGITCQKXSSTSPHRPRFSPATHPSEGLEENYXRNPDNDPQGPXXXTTDPEKRYDYXDXLECEEECXHCSGENXDGKISKTMSGLECQAXDSQSPHAXGXIPSKFPNKNLKKNYXRNPDRELRPXXXTTDPNKRWELXDXPRCTTPPPSSGPTYQCLKGTGENXRGNVAVTVSGHTXQHXSAQTPHTHNRTPENFPCKNXDENYXRNPDGKRAPXXXTTNSQVRWEYXKXPSCDSSPVSTEQLAPTAPPELTPVVQDCYHGDGQSXRGTSSTTTTGKKXQSXSSMTPXRXQKTPENYPNAGXTMNYXRNPDADKGPXXXTTDPSVRWEYXNXKKCSGTEASVVAPPPVVLLPDVETPSEEDCMFGNGKGXRGKRATTVTGTPXQDXAAQEPHRXSIFTPETNPRAGLEKNYXRNPDGDVGGPXXXTTNPRKLYDYXDXPQCAAPSFDCGKPQVEPKKXPGRXVGGCVAHPHSWPXQXSXRTRFGMHFXGGTXISPEWXXTXAHXLEKSPRPSSXKXXXGAHQEVNLEPHVQEIEXSRLFLEPTRKDXXXXKXSSPAVITDKXXPXXLPSPNYVVADRTEXFXTGXGETQGTFGAGLXKEXQXPXIENKVXNRYEFXNGRVQSTEXXXGXLAGGTDSCQGDSGGPXXXFEKDKXIXQGXTSWGLGCXRPNKPGXXXRXSRXXTWXEGVMRNN

SEQ ID NO: 101 - protein, 615 aa, Homo sapiens
  SITE (135)..(135): Xaa at position 135 is Cys, Ala, Val, Gly, Ser, or Thr
  SITE (158)..(158): Xaa at position 158 is Val, Ala, Gly, Leu, or Ile
  SITE (161)..(161): Xaa at position 161 is Cys, Ala, Val, Gly, Ser, or Thr
  SITE (163)..(163): Xaa at position 163 is Cys, Ala, Val, Gly, Ser, or Thr
  SITE (209)..(209): Xaa at position 209 is Cys, Ala, Val, Gly, Ser, or Thr
  SITE (388)..(388): Xaa at position 388 is Ala, Gly, or Pro
  SITE (389)..(389): Xaa at position 389 is Ala, Gly, or Pro
  SITE (398)..(398): Xaa at position 398 is Ala, Gly, or Pro
  SITE (401)..(401): Xaa at position 401 is Leu, Ala, Val, Gly, or Ile
  SITE (408)..(408): Xaa at position 408 is Leu, Ala, Val, Gly, or Ile
  SITE (410)..(410): Xaa at position 410 is Ala, Gly, or Pro
  SITE (411)..(411): Xaa at position 411 is Ala, Gly, or Pro
  SITE (414)..(414): Xaa at position 414 is Leu, Ala, Val, Gly, or Ile
  SITE (425)..(425): Xaa at position 425 is Val, Ala, Gly, Leu, or Ile
  SITE (427)..(427): Xaa at position 427 is Leu, Ala, Val, Gly, or Ile
  SITE (462)..(462): Xaa at position 462 is Leu, Ala, Val, Gly, or Ile
  SITE (463)..(463): Xaa at position 463 is Ala, Gly, or Pro
  SITE (464)..(464): Xaa at position 464 is Leu, Ala, Val, Gly, or Ile
  SITE (465)..(465): Xaa at position 465 is Leu, Ala, Val, Gly, or Ile
  SITE (467)..(467): Xaa at position 467 is Leu, Ala, Val, Gly, or Ile
  SITE (482)..(482): Xaa at position 482 is Val, Ala, Gly, Leu, or Ile
  SITE (500)..(500): Xaa at position 500 is Cys, Ala, Val, Gly, Ser, or Thr
  SITE (503)..(503): Xaa at position 503 is Ala, Gly, or Pro
  SITE (505)..(505): Xaa at position 505 is Trp, Tyr, Phe, Met, His, Ile, Leu Val, Ala, or Gly
  SITE (532)..(532): Xaa at position 532 is Cys, Ala, Val, Gly, Ser, or Thr
  SITE (548)..(548): Xaa at position 548 is Cys, Ala, Val, Gly, Ser, or Thr
  SITE (549)..(549): Xaa at position 549 is Ala, Gly, or Pro
  SITE (567)..(567): Xaa at position 567 is Leu, Ala, Val, Gly, or Ile
  SITE (568)..(568): Xaa at position 568 is Val, Ala, Gly, Leu, or Ile
  SITE (569)..(569): Xaa at position 569 is Cys, Ala, Val, Gly, Ser, or Thr
  SITE (580)..(580): Xaa at position 580 is Leu, Ala, Val, Gly, or Ile
  SITE (583)..(583): Xaa at position 583 is Ile, Ala, Val, Leu, or Gly
  SITE (598)..(598): Xaa at position 598 is Val, Ala, Gly, Leu, or Ile
  SITE (602)..(602): Xaa at position 602 is Val, Ala, Gly, Leu, or Ile
  SITE (609)..(609): Xaa at position 609 is Ile, Ala, Val, Leu, or Gly
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKXFEPQLLRFFHKNEIWYRTEQAAXARXQXKGPDAHCQRLASQACRTNPCLHGGRCLEVEGHRLCHCPVGYTGAFXDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIXXLYWGHSFCXGSXIAPCWVXTXXHCXQDRPAPEDLTXVXGQERRNHSCEPCQTLAVRSYRLHEAFSPVSYQHDXXXXRXQEDADGSCALLSPYXQPVCLPSGAARPSETTLXQVXGXGHQFEGAEEYASFLQEAQVPFLSLERXSAPDVHGSSILPGMLXXGFLEGGTDACQGDSGGPXXXEDQAAERRLTXQGXISWGSGCGDRNKPGXYTDXAYYLAWXREHTVS

SEQ ID NO: 102 - protein, 764 aa, Homo sapiens
  SITE (58)..(58): Xaa at position 58 is Leu, Ala, Val, Gly, or Ile
  SITE (96)..(96): Xaa at position 96 is Ala, Gly, or Pro
  SITE (103)..(103): Xaa at position 103 is Cys, Ala, Val, Gly, Ser, or Thr
  SITE (121)..(121): Xaa at position 121 is Tyr, Phe, Met, His, Ile, Leu, Val Ala, or Gly
  SITE (127)..(127): Xaa at position 127 is Ile, Ala, Val, Leu, or Gly
  SITE (145)..(145): Xaa at position 145 is Cys, Ala, Val, Gly, Ser, or Thr
  SITE (158)..(158): Xaa at position 158 is Cys, Ala, Val, Gly, Ser, or Thr
  SITE (165)..(165): Xaa at position 165 is Cys, Ala, Val, Gly, Ser, or Thr
  SITE (177)..(177): Xaa at position 177 is Val, Ala, Gly, Leu, or Ile
  SITE (187)..(187): Xaa at position 187 is Val, Ala, Gly, Leu, or Ile
  SITE (205)..(205): Xaa at position 205 is Cys, Ala, Val, Gly, Ser, or Thr
  SITE (223)..(223): Xaa at position 223 is Met, Ile, Leu, Val, Ala, or Gly
  SITE (230)..(230): Xaa at position 230 is Val, Ala, Gly, Leu, or Ile
  SITE (231)..(231): Xaa at position 231 is Ala, Gly, or Pro
  SITE (234)..(234): Xaa at position 234 is Phe, Tyr, Met, His, Ile, Leu, Val Ala, or Gly
  SITE (235)..(235): Xaa at position 235 is Leu, Ala, Val, Gly, or Ile
  SITE (242)..(242): Xaa at position 242 is Ile, Ala, Val, Leu, or Gly
  SITE (269)..(269): Xaa at position 269 is Met, Ile, Leu, Val, Ala, or Gly
  SITE (271)..(271): Xaa at position 271 is Ile, Ala, Val, Leu, or Gly
  SITE (272)..(272): Xaa at position 272 is Tyr, Phe, Met, His, Ile, Leu, Val Ala, or Gly
  SITE (273)..(273): Xaa at position 273 is Leu, Ala, Val, Gly, or Ile
  SITE (274)..(274): Xaa at position 274 is Val, Ala, Gly, Leu, or Ile
  SITE (275)..(275): Xaa at position 275 is Leu, Ala, Val, Gly, or Ile
  SITE (281)..(281): Xaa at position 281 is Ile, Ala, Val, Leu, or Gly
  SITE (286)..(286): Xaa at position 286 is Phe, Tyr, Met, His, Ile, Leu, Val Ala, or Gly
  SITE (289)..(289): Xaa at position 289 is Ala, Gly, or Pro
  SITE (292)..(292): Xaa at position 292 is Cys, Ala, Val, Gly, Ser, or Thr
  SITE (293)..(293): Xaa at position 293 is Leu, Ala, Val, Gly, or Ile
  SITE (297)..(297): Xaa at position 297 is Ile, Ala, Val, Leu, or Gly
  SITE (300)..(300): Xaa at position 300 is Val, Ala, Gly, Leu, or Ile
  SITE (309)..(309): Xaa at position 309 is Tyr, Phe, Met, His, Ile, Leu, Val Ala, or Gly
  SITE (311)..(311): Xaa at position 311 is Leu, Ala, Val, Gly, or Ile
  SITE (312)..(312): Xaa at position 312 is Val, Ala, Gly, Leu, or Ile
  SITE (314)..(314): Xaa at position 314 is Tyr, Phe, Met, His, Ile, Leu, Val Ala, or Gly
  SITE (315)..(315): Xaa at position 315 is Ala, Gly, or Pro
  SITE (322)..(322): Xaa at position 322 is Val, Ala, Gly, Leu, or Ile
  SITE (324)..(324): Xaa at position 324 is Val, Ala, Gly, Leu, or Ile
  SITE (335)..(335): Xaa at position 335 is Val, Ala, Gly, Leu, or Ile
  SITE (339)..(339): Xaa at position 339 is Leu, Ala, Val, Gly, or Ile
  SITE (342)..(342): Xaa at position 342 is Ile, Ala, Val, Leu, or Gly
  SITE (358)..(358): Xaa at position 358 is Ala, Gly, or Pro
  SITE (359)..(359): Xaa at position 359 is Leu, Ala, Val, Gly, or Ile
  SITE (362)..(362): Xaa at position 362 is Val, Ala, Gly, Leu, or Ile
  SITE (383)..(383): Xaa at position 383 is Val, Ala, Gly, Leu, or Ile
  SITE (384)..(384): Xaa at position 384 is Ile, Ala, Val, Leu, or Gly
  SITE (385)..(385): Xaa at position 385 is Ile, Ala, Val, Leu, or Gly
  SITE (386)..(386): Xaa at position 386 is Leu, Ala, Val, Gly, or Ile
  SITE (387)..(387): Xaa at position 387 is Met, Ile, Leu, Val, Ala, or Gly
  SITE (391)..(391): Xaa at position 391 is Leu, Ala, Val, Gly, or Ile
  SITE (401)..(401): Xaa at position 401 is Val, Ala, Gly, Leu, or Ile
  SITE (405)..(405): Xaa at position 405 is Ile, Ala, Val, Leu, or Gly
  SITE (409)..(409): Xaa at position 409 is Leu, Ala, Val, Gly, or Ile
  SITE (411)..(411): Xaa at position 411 is Ile, Ala, Val, Leu, or Gly
  SITE (426)..(426): Xaa at position 426 is Tyr, Phe, Met, His, Ile, Leu, Val Ala, or Gly
  SITE (427)..(427): Xaa at position 427 is Val, Ala, Gly, Leu, or Ile
  SITE (428)..(428): Xaa at position 428 is Phe, Tyr, Met, His, Ile, Leu, Val Ala, or Gly
  SITE (430)..(430): Xaa at position 430 is Val, Ala, Gly, Leu, or Ile
  SITE (439)..(439): Xaa at position 439 is Ile, Ala, Val, Leu, or Gly
  SITE (443)..(443): Xaa at position 443 is Ala, Gly, or Pro
  SITE (451)..(451): Xaa at position 451 is His, Phe, Tyr, Lys, Arg, Gly, Ser Thr, Ala, Val, Leu, Ile, Asn, Met, or Gln
  SITE (453)..(453): Xaa at position 453 is Phe, Tyr, Met, His, Ile, Leu, Val Ala, or Gly
  SITE (455)..(455): Xaa at position 455 is Val, Ala, Gly, Leu, or Ile
  SITE (458)..(458): Xaa at position 458 is Met, Ile, Leu, Val, Ala, or Gly
  SITE (461)..(461): Xaa at position 461 is Leu, Ala, Val, Gly, or Ile
  SITE (464)..(464): Xaa at position 464 is Val, Ala, Gly, Leu, or Ile
  SITE (465)..(465): Xaa at position 465 is Phe, Tyr, Met, His, Ile, Leu, Val Ala, or Gly
  SITE (468)..(468): Xaa at position 468 is Met, Ile, Leu, Val, Ala, or Gly
  SITE (481)..(481): Xaa at position 481 is Val, Ala, Gly, Leu, or Ile
  SITE (495)..(495): Xaa at position 495 is Trp, Tyr, Phe, Met, His, Ile, Leu Val, Ala, or Gly
  SITE (497)..(497): Xaa at position 497 is Ala, Gly, or Pro
  SITE (499)..(499): Xaa at position 499 is Ile, Ala, Val, Leu, or Gly
  SITE (501)..(501): Xaa at position 501 is Val, Ala, Gly, Leu, or Ile
  SITE (511)..(511): Xaa at position 511 is Cys, Ala, Val, Gly, Ser, or Thr
  SITE (512)..(512): Xaa at position 512 is Met, Ile, Leu, Val, Ala, or Gly
  SITE (514)..(514): Xaa at position 514 is Ala, Gly, or Pro
  SITE (515)..(515): Xaa at position 515 is Val, Ala, Gly, Leu, or Ile
  SITE (516)..(516): Xaa at position 516 is Val, Ala, Gly, Leu, or Ile
  SITE (520)..(520): Xaa at position 520 is Phe, Tyr, Met, His, Ile, Leu, Val Ala, or Gly
  SITE (521)..(521): Xaa at position 521 is Val, Ala, Gly, Leu, or Ile
  SITE (522)..(522): Xaa at position 522 is Leu, Ala, Val, Gly, or Ile
  SITE (524)..(524): Xaa at position 524 is Ala, Gly, or Pro
  SITE (525)..(525): Xaa at position 525 is Ala, Gly, or Pro
  SITE (527)..(527): Xaa at position 527 is Cys, Ala, Val, Gly, Ser, or Thr
  SITE (528)..(528): Xaa at position 528 is Phe, Tyr, Met, His, Ile, Leu, Val Ala, or Gly
  SITE (530)..(530): Xaa at position 530 is Val, Ala, Gly, Leu, or Ile
  SITE (539)..(539): Xaa at position 539 is Val, Ala, Gly, Leu, or Ile
  SITE (541)..(541): Xaa at position 541 is Val, Ala, Gly, Leu, or Ile
  SITE (569)..(569): Xaa at position 569 is Ile, Ala, Val, Leu, or Gly
  SITE (577)..(577): Xaa at position 577 is Val, Ala, Gly, Leu, or Ile
  SITE (578)..(578): Xaa at position 578 is Ala, Gly, or Pro
  SITE (579)..(579): Xaa at position 579 is Leu, Ala, Val, Gly, or Ile
  SITE (580)..(580): Xaa at position 580 is Ile, Ala, Val, Leu, or Gly
  SITE (582)..(582): Xaa at position 582 is Leu, Ala, Val, Gly, or Ile
  SITE (596)..(596): Xaa at position 596 is Cys, Ala, Val, Gly, Ser, or Thr
  SITE (599)..(599): Xaa at position 599 is Cys, Ala, Val, Gly, Ser, or Thr
  SITE (606)..(606): Xaa at position 606 is Ala, Gly, or Pro
  SITE (607)..(607): Xaa at position 607 is Leu, Ala, Val, Gly, or Ile
  SITE (622)..(622): Xaa at position 622 is Leu, Ala, Val, Gly, or Ile
  SITE (628)..(628): Xaa at position 628 is Ile, Ala, Val, Leu, or Gly
  SITE (630)..(630): Xaa at position 630 is Ala, Gly, or Pro
  SITE (631)..(631): Xaa at position 631 is Leu, Ala, Val, Gly, or Ile
  SITE (632)..(632): Xaa at position 632 is Phe, Tyr, Met, His, Ile, Leu, Val Ala, or Gly
  SITE (633)..(633): Xaa at position 633 is Val, Ala, Gly, Leu, or Ile
  SITE (645)..(645): Xaa at position 645 is Val, Ala, Gly, Leu, or Ile
  SITE (647)..(647): Xaa at position 647 is Ile, Ala, Val, Leu, or Gly
  SITE (656)..(656): Xaa at position 656 is Cys, Ala, Val, Gly, Ser, or Thr
  SITE (660)..(660): Xaa at position 660 is Ala, Gly, or Pro
  SITE (663)..(663): Xaa at position 663 is Ala, Gly, or Pro
  SITE (669)..(669): Xaa at position 669 is Val, Ala, Gly, Leu, or Ile
  SITE (675)..(675): Xaa at position 675 is Val, Ala, Gly, Leu, or Ile
  SITE (676)..(676): Xaa at position 676 is Val, Ala, Gly, Leu, or Ile
  SITE (680)..(680): Xaa at position 680 is Phe, Tyr, Met, His, Ile, Leu, Val Ala, or Gly
  SITE (681)..(681): Xaa at position 681 is Leu, Ala, Val, Gly, or Ile
  SITE (682)..(682): Xaa at position 682 is Cys, Ala, Val, Gly, Ser, or Thr
  SITE (695)..(695): Xaa at position 695 is Cys, Ala, Val, Gly, Ser, or Thr
  SITE (703)..(703): Xaa at position 703 is Leu, Ala, Val, Gly, or Ile
  SITE (704)..(704): Xaa at position 704 is Ile, Ala, Val, Leu, or Gly
  SITE (705)..(705): Xaa at position 705 is Val, Ala, Gly, Leu, or Ile
  SITE (711)..(711): Xaa at position 711 is Phe, Tyr, Met, His, Ile, Leu, Val Ala, or Gly
  SITE (712)..(712): Xaa at position 712 is Ile, Ala, Val, Leu, or Gly
  SITE (714)..(714): Xaa at position 714 is Val, Ala, Gly, Leu, or Ile
  SITE (716)..(716): Xaa at position 716 is Val, Ala, Gly, Leu, or Ile
  SITE (721)..(721): Xaa at position 721 is Val, Ala, Gly, Leu, or Ile
  SITE (738)..(738): Xaa at position 738 is Ala, Gly, or Pro
  SITE (741)..(741): Xaa at position 741 is Phe, Tyr, Met, His, Ile, Leu, Val Ala, or Gly
  SITE (742)..(742): Xaa at position 742 is His, Phe, Tyr, Lys, Arg, Gly, Ser Thr, Ala, Val, Leu, Ile, Asn, Met, or Gln
  SITE (743)..(743): Xaa at position 743 is Ile, Ala, Val, Leu, or Gly
  SITE (745)..(745): Xaa at position 745 is Leu, Ala, Val, Gly, or Ile
  SITE (748)..(748): Xaa at position 748 is Val, Ala, Gly, Leu, or Ile
  SITE (752)..(752): Xaa at position 752 is Leu, Ala, Val, Gly, or Ile
  SITE (756)..(756): Xaa at position 756 is Leu, Ala, Val, Gly, or Ile
  SITE (761)..(761): Xaa at position 761 is Leu, Ala, Val, Gly, or Ile
  SITE (764)..(764): Xaa at position 764 is Leu, Ala, Val, Gly, or Ile
MGSNLSPQLCLMPFILGLLSGGVTTTPWSLARPQGSCSLEGVEIKGGSFRLLQEGQAXEYVCPSGFYPYPVQTRTCRSTGSWSTLKTQDQKTVRKXECRAIHXPRPHDFENGEYWPRSPYXNVSDEXSFHCYDGYTLRGSANRTXQVNGRWSGQTAIXDNGAGYXSNPGIPIGTRKXGSQYRLEDSXTYHCSRGLTLRGSQRRTXQEGGSWSGTEPSCQDSFXYDTPQEXXEAXXSSLTETXEGVDAEDGHGPGEQQKRKIVLDPSGSXNXXXXXDGSDSXGASNXTGXKKXXVNLXEKXASYGVKPRXGXXTXXTYPKIWXKXSEADSSNADWXTKQXNEXNYEDHKLKSGTNTKKXXQAXYSMMSWPDDVPPEGWNRTRHXXXXXTDGXHNMGGDPITXIDEXRDLXYXGKDRKNPREDYLDVXXXGXGPLVNQVNXNALXSKKDNEQXVXKXKDXENXEDXXYQXIDESQSLSLCGMXWEHRKGTDYHKQPXQXKXSXIRPSKGHESXXGXXXSEYXXXTXXHXXTXDDKEHSIKXSXGGEKRDLEIEVVLFHPNYNINGKKEAGXPEFYDYDXXXXKXKNKLKYGQTIRPIXLPXTEGTTRXXRLPPTTTCQQQKEEXLPAQDXKXXXXSEEEKKLTRKEXYXKNGDKKGSXERDXQYXPGYDKXKDISEXXTPRXXXTGGVSPYADPNTXRGDSGGPXXXHKRSRXXQXGXISWGXVDVCKNQKRQKQVPAHXRDXXXNXFQXLPWXKEKXQDEDXGFX

SEQ ID NO: 103 - protein, 406 aa, Homo sapiens
  SITE (90)..(90): Xaa at position 90 is Ile, Ala, Val, Leu, or Gly
  SITE (92)..(92): Xaa at position 92 is Ile, Ala, Val, Leu, or Gly
  SITE (99)..(99): Xaa at position 99 is Phe, Tyr, Met, His, Ile, Leu, Val Ala, or Gly
  SITE (101)..(101): Xaa at position 101 is Val, Ala, Gly, Leu, or Ile
  SITE (102)..(102): Xaa at position 102 is Val, Ala, Gly, Leu, or Ile
  SITE (103)..(103): Xaa at position 103 is Phe, Tyr, Met, His, Ile, Leu, Val Ala, or Gly
  SITE (110)..(110): Xaa at position 110 is Val, Ala, Gly, Leu, or Ile
  SITE (111)..(111): Xaa at position 111 is Trp, Tyr, Phe, Met, His, Ile, Leu Val, Ala, or Gly
  SITE (112)..(112): Xaa at position 112 is Val, Ala, Gly, Leu, or Ile
  SITE (117)..(117): Xaa at position 117 is Cys, Ala, Val, Gly, Ser, or Thr
  SITE (123)..(123): Xaa at position 123 is Ala, Gly, or Pro
  SITE (124)..(124): Xaa at position 124 is Cys, Ala, Val, Gly, Ser, or Thr
  SITE (130)..(130): Xaa at position 130 is Phe, Tyr, Met, His, Ile, Leu, Val Ala, or Gly
  SITE (154)..(154): Xaa at position 154 is Val, Ala, Gly, Leu, or Ile
  SITE (162)..(162): Xaa at position 162 is Ile, Ala, Val, Leu, or Gly
  SITE (163)..(163): Xaa at position 163 is Ile, Ala, Val, Leu, or Gly
  SITE (165)..(165): Xaa at position 165 is Val, Ala, Gly, Leu, or Ile
  SITE (170)..(170): Xaa at position 170 is Val, Ala, Gly, Leu, or Ile
  SITE (173)..(173): Xaa at position 173 is Met, Ile, Leu, Val, Ala, or Gly
  SITE (174)..(174): Xaa at position 174 is Phe, Tyr, Met, His, Ile, Leu, Val Ala, or Gly
  SITE (180)..(180): Xaa at position 180 is Met, Ile, Leu, Val, Ala, or Gly
  SITE (193)..(193): Xaa at position 193 is Val, Ala, Gly, Leu, or Ile
  SITE (194)..(194): Xaa at position 194 is Val, Ala, Gly, Leu, or Ile
  SITE (196)..(196): Xaa at position 196 is Met, Ile, Leu, Val, Ala, or Gly
  SITE (198)..(198): Xaa at position 198 is Phe, Tyr, Met, His, Ile, Leu, Val Ala, or Gly
  SITE (209)..(209): Xaa at position 209 is Ile, Ala, Val, Leu, or Gly
  SITE (210)..(210): Xaa at position 210 is Phe, Tyr, Met, His, Ile, Leu, Val Ala, or Gly
  SITE (213)..(213): Xaa at position 213 is Ile, Ala, Val, Leu, or Gly
  SITE (218)..(218): Xaa at position 218 is Val, Ala, Gly, Leu, or Ile
  SITE (223)..(223): Xaa at position 223 is Val, Ala, Gly, Leu, or Ile
  SITE (224)..(224): Xaa at position 224 is Phe, Tyr, Met, His, Ile, Leu, Val Ala, or Gly
  SITE (226)..(226): Xaa at position 226 is Phe, Tyr, Met, His, Ile, Leu, Val Ala, or Gly
  SITE (227)..(227): Xaa at position 227 is Tyr, Phe, Met, His, Ile, Leu, Val Ala, or Gly
  SITE (228)..(228): Xaa at position 228 is Tyr, Phe, Met, His, Ile, Leu, Val Ala, or Gly
  SITE (242)..(242): Xaa at position 242 is Ile, Ala, Val, Leu, or Gly
  SITE (262)..(262): Xaa at position 262 is Ile, Ala, Val, Leu, or Gly
  SITE (266)..(266): Xaa at position 266 is Val, Ala, Gly, Leu, or Ile
  SITE (267)..(267): Xaa at position 267 is Trp, Tyr, Phe, Met, His, Ile, Leu Val, Ala, or Gly
  SITE (269)..(269): Xaa at position 269 is Ile, Ala, Val, Leu, or Gly
  SITE (271)..(271): Xaa at position 271 is Met, Ile, Leu, Val, Ala, or Gly
  SITE (274)..(274): Xaa at position 274 is Val, Ala, Gly, Leu, or Ile
  SITE (288)..(288): Xaa at position 288 is Leu, Ala, Val, Gly, or Ile
  SITE (289)..(289): Xaa at position 289 is Ala, Gly, or Pro
  SITE (291)..(291): Xaa at position 291 is Val, Ala, Gly, Leu, or Ile
  SITE (298)..(298): Xaa at position 298 is Ile, Ala, Val, Leu, or Gly
  SITE (305)..(305): Xaa at position 305 is Ile, Ala, Val, Leu, or Gly
  SITE (308)..(308): Xaa at position 308 is Leu, Ala, Val, Gly, or Ile
  SITE (309)..(309): Xaa at position 309 is Met, Ile, Leu, Val, Ala, or Gly
  SITE (322)..(322): Xaa at position 322 is Val, Ala, Gly, Leu, or Ile
  SITE (323)..(323): Xaa at position 323 is Val, Ala, Gly, Leu, or Ile
  SITE (325)..(325): Xaa at position 325 is Cys, Ala, Val, Gly, Ser, or Thr
  SITE (331)..(331): Xaa at position 331 is Leu, Ala, Val, Gly, or Ile
  SITE (334)..(334): Xaa at position 334 is Ile, Ala, Val, Leu, or Gly
  SITE (336)..(336): Xaa at position 336 is Phe, Tyr, Met, His, Ile, Leu, Val Ala, or Gly
  SITE (338)..(338): Xaa at position 338 is Leu, Ala, Val, Gly, or Ile
  SITE (343)..(343): Xaa at position 343 is Tyr, Phe, Met, His, Ile, Leu, Val Ala, or Gly
  SITE (345)..(345): Xaa at position 345 is Leu, Ala, Val, Gly, or Ile
  SITE (350)..(350): Xaa at position 350 is Tyr, Phe, Met, His, Ile, Leu, Val Ala, or Gly
  SITE (352)..(352): Xaa at position 352 is Phe, Tyr, Met, His, Ile, Leu, Val Ala, or Gly
  SITE (362)..(362): Xaa at position 362 is Cys, Ala, Val, Gly, Ser, or Thr
  SITE (364)..(364): Xaa at position 364 is Leu, Ala, Val, Gly, or Ile
  SITE (365)..(365): Xaa at position 365 is Ala, Gly, or Pro
  SITE (366)..(366): Xaa at position 366 is Ile, Ala, Val, Leu, or Gly
  SITE (380)..(380): Xaa at position 380 is Ala, Gly, or Pro
  SITE (381)..(381): Xaa at position 381 is Leu, Ala, Val, Gly, or Ile
  SITE (383)..(383): Xaa at position 383 is Ala, Gly, or Pro
  SITE (385)..(385): Xaa at position 385 is Phe, Tyr, Met, His, Ile, Leu, Val Ala, or Gly
  SITE (386)..(386): Xaa at position 386 is Ile, Ala, Val, Leu, or Gly
  SITE (390)..(390): Xaa at position 390 is Tyr, Phe, Met, His, Ile, Leu, Val Ala, or Gly
  SITE (393)..(393): Xaa at position 393 is Phe, Tyr, Met, His, Ile, Leu, Val Ala, or Gly
  SITE (400)..(400): Xaa at position 400 is Ile, Ala, Val, Leu, or Gly
  SITE (402)..(402): Xaa at position 402 is Phe, Tyr, Met, His, Ile, Leu, Val Ala, or Gly
  SITE (403)..(403): Xaa at position 403 is Ala, Gly, or Pro
MDGWRRMPRWGLLLLLWGSCTFGLPTDTTTFKRIFLKRMPSIRESLKERGVDMARLGPEWSQPMKRLTLGNTTSSVILTNYMDTQYYGEXGXGTPPQTXKXXXDTGSSNXXXPSSKXSRLYTXXVYHKLXDASDSSSYKHNGTELTLRYSTGTXSGFLSQDXXTXGGITXTQXXGEVTEXPALPFMLAEFDGXXGXGXIEQAIGRVTPXXDNXISQGXLKEDXXSXXXNRDSENSQSLGGQXVLGGSDPQHYEGNFHYINLXKTGXXQXQXKGXSVGSSTLLCEDGCXXLXDTGASYXSGSTSSXEKXXEALGAKKRLFDYXXKXNEGPTXPDXSXHXGGKEXTXTSADXVXQESYSSKKLXTXXXHAMDIPPPTGPTWXXGXTXXRKFXTEXDRRNNRXGXXLAR

SEQ ID NO: 104 - protein, 260 aa, Homo sapiens
  SITE (16)..(16): Xaa at position 16 is Trp, Tyr, Phe, Met, His, Ile, Leu Val, Ala, or Gly
  SITE (31)..(31): Xaa at position 31 is Val, Ala, Gly, Leu, or Ile
  SITE (33)..(33): Xaa at position 33 is Ile, Ala, Val, Leu, or Gly
  SITE (51)..(51): Xaa at position 51 is Tyr, Phe, Met, His, Ile, Leu, Val Ala, or Gly
  SITE (59)..(59): Xaa at position 59 is Ile, Ala, Val, Leu, or Gly
  SITE (65)..(65): Xaa at position 65 is Ala, Gly, or Pro
  SITE (66)..(66): Xaa at position 66 is Phe, Tyr, Met, His, Ile, Leu, Val Ala, or Gly
  SITE (68)..(68): Xaa at position 68 is Val, Ala, Gly, Leu, or Ile
  SITE (70)..(70): Xaa at position 70 is Phe, Tyr, Met, His, Ile, Leu, Val Ala, or Gly
  SITE (77)..(77): Xaa at position 77 is Ala, Gly, or Pro
  SITE (78)..(78): Xaa at position 78 is Val, Ala, Gly, Leu, or Ile
  SITE (79)..(79): Xaa at position 79 is Leu, Ala, Val, Gly, or Ile
  SITE (88)..(88): Xaa at position 88 is Tyr, Phe, Met, His, Ile, Leu, Val Ala, or Gly
  SITE (90)..(90): Xaa at position 90 is Leu, Ala, Val, Gly, or Ile
  SITE (93)..(93): Xaa at position 93 is Phe, Tyr, Met, His, Ile, Leu, Val Ala, or Gly
  SITE (94)..(94): Xaa at position 94 is His, Phe, Tyr, Lys, Arg, Gly, Ser Thr, Ala, Val, Leu, Ile, Asn, Met, or Gln
  SITE (95)..(95): Xaa at position 95 is Phe, Tyr, Met, His, Ile, Leu, Val Ala, or Gly
  SITE (96)..(96): Xaa at position 96 is His, Phe, Tyr, Lys, Arg, Gly, Ser Thr, Ala, Val, Leu, Ile, Asn, Met, or Gln
  SITE (97)..(97): Xaa at position 97 is Trp, Tyr, Phe, Met, His, Ile, Leu Val, Ala, or Gly
  SITE (107)..(107): Xaa at position 107 is His, Phe, Tyr, Lys, Arg, Gly, Ser Thr, Ala, Val, Leu, Ile, Asn, Met, or Gln
  SITE (115)..(115): Xaa at position 115 is Ala, Gly, or Pro
  SITE (116)..(116): Xaa at position 116 is Ala, Gly, or Pro
  SITE (118)..(118): Xaa at position 118 is Leu, Ala, Val, Gly, or Ile
  SITE (119)..(119): Xaa at position 119 is His, Phe, Tyr, Lys, Arg, Gly, Ser Thr, Ala, Val, Leu, Ile, Asn, Met, or Gln
  SITE (120)..(120): Xaa at position 120 is Leu, Ala, Val, Gly, or Ile
  SITE (121)..(121): Xaa at position 121 is Val, Ala, Gly, Leu, or Ile
  SITE (122)..(122): Xaa at position 122 is His, Phe, Tyr, Lys, Arg, Gly, Ser Thr, Ala, Val, Leu, Ile, Asn, Met, or Gln
  SITE (123)..(123): Xaa at position 123 is Trp, Tyr, Phe, Met, His, Ile, Leu Val, Ala, or Gly
  SITE (133)..(133): Xaa at position 133 is Ala, Gly, or Pro
  SITE (134)..(134): Xaa at position 134 is Val, Ala, Gly, Leu, or Ile
  SITE (140)..(140): Xaa at position 140 is Leu, Ala, Val, Gly, or Ile
  SITE (141)..(141): Xaa at position 141 is Ala, Gly, or Pro
  SITE (142)..(142): Xaa at position 142 is Val, Ala, Gly, Leu, or Ile
  SITE (143)..(143): Xaa at position 143 is Leu, Ala, Val, Gly, or Ile
  SITE (145)..(145): Xaa at position 145 is Ile, Ala, Val, Leu, or Gly
  SITE (146)..(146): Xaa at position 146 is Phe, Tyr, Met, His, Ile, Leu, Val Ala, or Gly
  SITE (147)..(147): Xaa at position 147 is Leu, Ala, Val, Gly, or Ile
  SITE (149)..(149): Xaa at position 149 is Val, Ala, Gly, Leu, or Ile
  SITE (156)..(156): Xaa at position 156 is Leu, Ala, Val, Gly, or Ile
  SITE (159)..(159): Xaa at position 159 is Val, Ala, Gly, Leu, or Ile
  SITE (160)..(160): Xaa at position 160 is Val, Ala, Gly, Leu, or Ile
  SITE (162)..(162): Xaa at position 162 is Val, Ala, Gly, Leu, or Ile
  SITE (163)..(163): Xaa at position 163 is Leu, Ala, Val, Gly, or Ile
  SITE (166)..(166): Xaa at position 166 is Ile, Ala, Val, Leu, or Gly
  SITE (175)..(175): Xaa at position 175 is Phe, Tyr, Met, His, Ile, Leu, Val Ala, or Gly
  SITE (178)..(178): Xaa at position 178 is Phe, Tyr, Met, His, Ile, Leu, Val Ala, or Gly
  SITE (183)..(183): Xaa at position 183 is Leu, Ala, Val, Gly, or Ile
  SITE (184)..(184): Xaa at position 184 is Leu, Ala, Val, Gly, or Ile
  SITE (188)..(188): Xaa at position 188 is Leu, Ala, Val, Gly, or Ile
  SITE (190)..(190): Xaa at position 190 is Tyr, Phe, Met, His, Ile, Leu, Val Ala, or Gly
  SITE (191)..(191): Xaa at position 191 is Trp, Tyr, Phe, Met, His, Ile, Leu Val, Ala, or Gly
  SITE (193)..(193): Xaa at position 193 is Tyr, Phe, Met, His, Ile, Leu, Val Ala, or Gly
  SITE (197)..(197): Xaa at position 197 is Leu, Ala, Val, Gly, or Ile
  SITE (202)..(202): Xaa at position 202 is Leu, Ala, Val, Gly, or Ile
  SITE (203)..(203): Xaa at position 203 is Leu, Ala, Val, Gly, or Ile
  SITE (205)..(205): Xaa at position 205 is Cys, Ala, Val, Gly, Ser, or Thr
  SITE (206)..(206): Xaa at position 206 is Val, Ala, Gly, Leu, or Ile
  SITE (208)..(208): Xaa at position 208 is Trp, Tyr, Phe, Met, His, Ile, Leu Val, Ala, or Gly
  SITE (209)..(209): Xaa at position 209 is Ile, Ala, Val, Leu, or Gly
  SITE (210)..(210): Xaa at position 210 is Val, Ala, Gly, Leu, or Ile
  SITE (211)..(211): Xaa at position 211 is Leu, Ala, Val, Gly, or Ile
  SITE (215)..(215): Xaa at position 215 is Ile, Ala, Val, Leu, or Gly
  SITE (217)..(217): Xaa at position 217 is Val, Ala, Gly, Leu, or Ile
  SITE (222)..(222): Xaa at position 222 is Val, Ala, Gly, Leu, or Ile
  SITE (225)..(225): Xaa at position 225 is Phe, Tyr, Met, His, Ile, Leu, Val Ala, or Gly
  SITE (228)..(228): Xaa at position 228 is Leu, Ala, Val, Gly, or Ile
  SITE (230)..(230): Xaa at position 230 is Phe, Tyr, Met, His, Ile, Leu, Val Ala, or Gly
  SITE (240)..(240): Xaa at position 240 is Met, Ile, Leu, Val, Ala, or Gly
  SITE (250)..(250): Xaa at position 250 is Leu, Ala, Val, Gly, or Ile
  SITE (255)..(255): Xaa at position 255 is Ile, Ala, Val, Leu, or Gly
  SITE (257)..(257): Xaa at position 257 is Ala, Gly, or Pro
MSHHWGYGKHNGPEHXHKDFPIAKGERQSPXDXDTHTAKYDPSLKPLSVSXDQATSLRXLNNGHXXNXEXDDSQDKXXXKGGPLDGTXRXIQXXXXXGSLDGQGSEXTVDKKKYXXEXXXXXXNTKYGDFGKXXQQPDGXXXXGXXXKXGSAKPGXQKXXDXXDSXKTKGKSADXTNXDPRGXXPESXDXXTXPGSXTTPPXXEXXTXXXXKEPXSXSSEQXLKXRKXNXNGEGEPEELXVDNWRPAQPXKNRQXKXSFK

SEQ ID NO: 105 - protein, 412 aa, Homo sapiens
  SITE (7)..(7): Xaa at position 7 is Val, Ala, Gly, Leu, or Ile
  SITE (8)..(8): Xaa at position 8 is Val, Ala, Gly, Leu, or Ile
  SITE (9)..(9): Xaa at position 9 is Leu, Ala, Val, Gly, or Ile
  SITE (19)..(19): Xaa at position 19 is Cys, Ala, Val, Gly, Ser, or Thr
  SITE (20)..(20): Xaa at position 20 is Ile, Ala, Val, Leu, or Gly
  SITE (21)..(21): Xaa at position 21 is Leu, Ala, Val, Gly, or Ile
  SITE (23)..(23): Xaa at position 23 is Trp, Tyr, Phe, Met, His, Ile, Leu Val, Ala, or Gly
  SITE (24)..(24): Xaa at position 24 is Leu, Ala, Val, Gly, or Ile
  SITE (31)..(31): Xaa at position 31 is Val, Ala, Gly, Leu, or Ile
  SITE (32)..(32): Xaa at position 32 is Ile, Ala, Val, Leu, or Gly
  SITE (33)..(33): Xaa at position 33 is Ala, Gly, or Pro
  SITE (34)..(34): Xaa at position 34 is Tyr, Phe, Met, His, Ile, Leu, Val Ala, or Gly
  SITE (35)..(35): Xaa at position 35 is Leu, Ala, Val, Gly, or Ile
  SITE (51)..(51): Xaa at position 51 is Ala, Gly, or Pro
  SITE (64)..(64): Xaa at position 64 is Val, Ala, Gly, Leu, or Ile
  SITE (68)..(68): Xaa at position 68 is Phe, Tyr, Met, His, Ile, Leu, Val Ala, or Gly
  SITE (69)..(69): Xaa at position 69 is Val, Ala, Gly, Leu, or Ile
  SITE (72)..(72): Xaa at position 72 is Phe, Tyr, Met, His, Ile, Leu, Val Ala, or Gly
  SITE (73)..(73): Xaa at position 73 is Ile, Ala, Val, Leu, or Gly
  SITE (77)..(77): Xaa at position 77 is Ile, Ala, Val, Leu, or Gly
  SITE (89)..(89): Xaa at position 89 is Leu, Ala, Val, Gly, or Ile
  SITE (93)..(93): Xaa at position 93 is Leu, Ala, Val, Gly, or Ile
  SITE (94)..(94): Xaa at position 94 is Ala, Gly, or Pro
  SITE (97)..(97): Xaa at position 97 is Cys, Ala, Val, Gly, Ser, or Thr
  SITE (99)..(99): Xaa at position 99 is Ala, Gly, or Pro
  SITE (105)..(105): Xaa at position 105 is Ile, Ala, Val, Leu, or Gly
  SITE (106)..(106): Xaa at position 106 is Ala, Gly, or Pro
  SITE (113)..(113): Xaa at position 113 is Tyr, Phe, Met, His, Ile, Leu, Val Ala, or Gly
  SITE (132)..(132): Xaa at position 132 is Cys, Ala, Val, Gly, Ser, or Thr
  SITE (143)..(143): Xaa at position 143 is Ala, Gly, or Pro
  SITE (150)..(150): Xaa at position 150 is Phe, Tyr, Met, His, Ile, Leu, Val Ala, or Gly
  SITE (163)..(163): Xaa at position 163 is Tyr, Phe, Met, His, Ile, Leu, Val Ala, or Gly
  SITE (164)..(164): Xaa at position 164 is Ala, Gly, or Pro
  SITE (185)..(185): Xaa at position 185 is Leu, Ala, Val, Gly, or Ile
  SITE (186)..(186): Xaa at position 186 is Met, Ile, Leu, Val, Ala, or Gly
  SITE (187)..(187): Xaa at position 187 is His, Phe, Tyr, Lys, Arg, Gly, Ser Thr, Ala, Val, Leu, Ile, Asn, Met, or Gln
  SITE (190)..(190): Xaa at position 190 is Tyr, Phe, Met, His, Ile, Leu, Val Ala, or Gly
  SITE (195)..(195): Xaa at position 195 is Leu, Ala, Val, Gly, or Ile
  SITE (206)..(206): Xaa at position 206 is Leu, Ala, Val, Gly, or Ile
  SITE (223)..(223): Xaa at position 223 is Leu, Ala, Val, Gly, or Ile
  SITE (225)..(225): Xaa at position 225 is Ile, Ala, Val, Leu, or Gly
  SITE (227)..(227): Xaa at position 227 is Phe, Tyr, Met, His, Ile, Leu, Val Ala, or Gly
  SITE (235)..(235): Xaa at position 235 is Val, Ala, Gly, Leu, or Ile
  SITE (238)..(238): Xaa at position 238 is Val, Ala, Gly, Leu, or Ile
  SITE (250)..(250): Xaa at position 250 is Leu, Ala, Val, Gly, or Ile
  SITE (251)..(251): Xaa at position 251 is Phe, Tyr, Met, His, Ile, Leu, Val Ala, or Gly
  SITE (254)..(254): Xaa at position 254 is Leu, Ala, Val, Gly, or Ile
  SITE (257)..(257): Xaa at position 257 is Val, Ala, Gly, Leu, or Ile
  SITE (258)..(258): Xaa at position 258 is Ala, Gly, or Pro
  SITE (261)..(261): Xaa at position 261 is His, Phe, Tyr, Lys, Arg, Gly, Ser Thr, Ala, Val, Leu, Ile, Asn, Met, or Gln
  SITE (263)..(263): Xaa at position 263 is Val, Ala, Gly, Leu, or Ile
  SITE (269)..(269): Xaa at position 269 is Val, Ala, Gly, Leu, or Ile
  SITE (281)..(281): Xaa at position 281 is Ile, Ala, Val, Leu, or Gly
  SITE (286)..(286): Xaa at position 286 is Ala, Gly, or Pro
  SITE (289)..(289): Xaa at position 289 is Ile, Ala, Val, Leu, or Gly
  SITE (290)..(290): Xaa at position 290 is Leu, Ala, Val, Gly, or Ile
  SITE (293)..(293): Xaa at position 293 is Ala, Gly, or Pro
  SITE (294)..(294): Xaa at position 294 is His, Phe, Tyr, Lys, Arg, Gly, Ser Thr, Ala, Val, Leu, Ile, Asn, Met, or Gln
  SITE (297)..(297): Xaa at position 297 is Ile, Ala, Val, Leu, or Gly
  SITE (317)..(317): Xaa at position 317 is Phe, Tyr, Met, His, Ile, Leu, Val Ala, or Gly
  SITE (318)..(318): Xaa at position 318 is Ala, Gly, or Pro
  SITE (321)..(321): Xaa at position 321 is Val, Ala, Gly, Leu, or Ile
  SITE (322)..(322): Xaa at position 322 is Tyr, Phe, Met, His, Ile, Leu, Val Ala, or Gly
  SITE (331)..(331): Xaa at position 331 is Cys, Ala, Val, Gly, Ser, or Thr
  SITE (338)..(338): Xaa at position 338 is Ile, Ala, Val, Leu, or Gly
  SITE (345)..(345): Xaa at position 345 is Val, Ala, Gly, Leu, or Ile
  SITE (349)..(349): Xaa at position 349 is Val, Ala, Gly, Leu, or Ile
  SITE (351)..(351): Xaa at position 351 is Val, Ala, Gly, Leu, or Ile
  SITE (353)..(353): Xaa at position 353 is Val, Ala, Gly, Leu, or Ile
MSSKGSXXXAYSGGLDTSXXXVXXKEQGYDXXXXXANIGQKEDFEEARKKXLKLGAKKVFIEDXSREXXEEXXWPAXQSSALYEDRYLXGTSXXRPXIXRKQVEXXQREGAKXVSHGATGKGNDQVRFELSXYSLAPQIKVIXPWRMPEXYNRFKGRNDLMEXXKQHGIPIPVTPKNPWSMDENXXXISXEAGIXENPKNQAPPGXYTKTQDPAKAPNTPDIXEXEXKKGVPVKXTNXKDGTTHQTSLEXXMYXNEXXGKXGXGRIDIXENRFIGMKSRGXYETPXGTXXYHXXLDXEAFTMDREVRKIKQGLGLKXXELXXTGFWHSPEXEFVRHCXAKSQERXEGKXQXSXLKGQVYILGRESPLSLYNEELVSMNVQGDYEPTDATGFININSLRLKEYHRLQSKVTAK

SEQ ID NO: 106 - protein, 79 aa, Homo sapiens
  SITE (46)..(46): Xaa at position 46 is Val, Ala, Gly, Leu, or Ile
  SITE (47)..(47): Xaa at position 47 is Cys, Ala, Val, Gly, Ser, or Thr
  SITE (60)..(60): Xaa at position 60 is Leu, Ala, Val, Gly, or Ile
  SITE (61)..(61): Xaa at position 61 is Cys, Ala, Val, Gly, Ser, or Thr
  SITE (71)..(71): Xaa at position 71 is Ile, Ala, Val, Leu, or Gly
  SITE (73)..(73): Xaa at position 73 is Ile, Ala, Val, Leu, or Gly
MKVTGIFLLSALALLSLSGNTGADSLGREAKCYNELNGCTKIYDPXXGTDGNTYPNECVXXFENRKRQTSXLXQKSGPC

SEQ ID NO: 107 - protein, 464 aa, Homo sapiens
  SITE (49)..(49): Xaa at position 49 is Met, Ile, Leu, Val, Ala, or Gly
  SITE (75)..(75): Xaa at position 75 is Ala, Gly, or Pro
  SITE (80)..(80): Xaa at position 80 is Val, Ala, Gly, Leu, or Ile
  SITE (83)..(83): Xaa at position 83 is Leu, Ala, Val, Gly, or Ile
  SITE (86)..(86): Xaa at position 86 is Ala, Gly, or Pro
  SITE (90)..(90): Xaa at position 90 is Phe, Tyr, Met, His, Ile, Leu, Val Ala, or Gly
  SITE (91)..(91): Xaa at position 91 is Ala, Gly, or Pro
  SITE (94)..(94): Xaa at position 94 is Phe, Tyr, Met, His, Ile, Leu, Val Ala, or Gly
  SITE (95)..(95): Xaa at position 95 is Tyr, Phe, Met, His, Ile, Leu, Val Ala, or Gly
  SITE (98)..(98): Xaa at position 98 is Leu, Ala, Val, Gly, or Ile
  SITE (108)..(108): Xaa at position 108 is Ile, Ala, Val, Leu, or Gly
  SITE (109)..(109): Xaa at position 109 is Phe, Tyr, Met, His, Ile, Leu, Val Ala, or Gly
  SITE (110)..(110): Xaa at position 110 is Leu, Ala, Val, Gly, or Ile
  SITE (113)..(113): Xaa at position 113 is Leu, Ala, Val, Gly, or Ile
  SITE (115)..(115): Xaa at position 115 is Ile, Ala, Val, Leu, or Gly
  SITE (118)..(118): Xaa at position 118 is Ala, Gly, or Pro
  SITE (119)..(119): Xaa at position 119 is Phe, Tyr, Met, His, Ile, Leu, Val Ala, or Gly
  SITE (120)..(120): Xaa at position 120 is Ala, Gly, or Pro
  SITE (121)..(121): Xaa at position 121 is Met, Ile, Leu, Val, Ala, or Gly
  SITE (126)..(126): Xaa at position 126 is Ala, Gly, or Pro
  SITE (127)..(127): Xaa at position 127 is Cys, Ala, Val, Gly, Ser, or Thr
  SITE (131)..(131): Xaa at position 131 is Leu, Ala, Val, Gly, or Ile
  SITE (134)..(134): Xaa at position 134 is Leu, Ala, Val, Gly, or Ile
  SITE (135)..(135): Xaa at position 135 is Met, Ile, Leu, Val, Ala, or Gly
  SITE (137)..(137): Xaa at position 137 is Val, Ala, Gly, Leu, or Ile
  SITE (138)..(138): Xaa at position 138 is Phe, Tyr, Met, His, Ile, Leu, Val Ala, or Gly
  SITE (140)..(140): Xaa at position 140 is Phe, Tyr, Met, His, Ile, Leu, Val Ala, or Gly
  SITE (143)..(143): Xaa at position 143 is Ile, Ala, Val, Leu, or Gly
  SITE (151)..(151): Xaa at position 151 is Ile, Ala, Val, Leu, or Gly
  SITE (152)..(152): Xaa at position 152 is His, Phe, Tyr, Lys, Arg, Gly, Ser Thr, Ala, Val, Leu, Ile, Asn, Met, or Gln
  SITE (153)..(153): Xaa at position 153 is Phe, Tyr, Met, His, Ile, Leu, Val Ala, or Gly
  SITE (154)..(154): Xaa at position 154 is Phe, Tyr, Met, His, Ile, Leu, Val Ala, or Gly
  SITE (155)..(155): Xaa at position 155 is Phe, Tyr, Met, His, Ile, Leu, Val Ala, or Gly
  SITE (156)..(156): Xaa at position 156 is Ala, Gly, or Pro
  SITE (158)..(158): Xaa at position 158 is Leu, Ala, Val, Gly, or Ile
  SITE (162)..(162): Xaa at position 162 is Leu, Ala, Val, Gly, or Ile
  SITE (166)..(166): Xaa at position 166 is Ala, Gly, or Pro
  SITE (175)..(175): Xaa at position 175 is Ala, Gly, or Pro
  SITE (178)..(178): Xaa at position 178 is Leu, Ala, Val, Gly, or Ile
  SITE (179)..(179): Xaa at position 179 is Phe, Tyr, Met, His, Ile, Leu, Val Ala, or Gly
  SITE (197)..(197): Xaa at position 197 is Val, Ala, Gly, Leu, or Ile
  SITE (200)..(200): Xaa at position 200 is Ala, Gly, or Pro
  SITE (207)..(207): Xaa at position 207 is Phe, Tyr, Met, His, Ile, Leu, Val Ala, or Gly
  SITE (218)..(218): Xaa at position 218 is Ile, Ala, Val, Leu, or Gly
  SITE (222)..(222): Xaa at position 222 is Val, Ala, Gly, Leu, or Ile
  SITE (230)..(230): Xaa at position 230 is Ile, Ala, Val, Leu, or Gly
  SITE (234)..(234): Xaa at position 234 is Ile, Ala, Val, Leu, or Gly
  SITE (238)..(238): Xaa at position 238 is Ala, Gly, or Pro
  SITE (242)..(242): Xaa at position 242 is Leu, Ala, Val, Gly, or Ile
  SITE (244)..(244): Xaa at position 244 is Val, Ala, Gly, Leu, or Ile
  SITE (245)..(245): Xaa at position 245 is Leu, Ala, Val, Gly, or Ile
  SITE (246)..(246): Xaa at position 246 is Val, Ala, Gly, Leu, or Ile
  SITE (247)..(247): Xaa at position 247 is Leu, Ala, Val, Gly, or Ile
  SITE (248)..(248): Xaa at position 248 is Val, Ala, Gly, Leu, or Ile
  SITE (251)..(251): Xaa at position 251 is Ile, Ala, Val, Leu, or Gly
  SITE (253)..(253): Xaa at position 253 is Phe, Tyr, Met, His, Ile, Leu, Val Ala, or Gly
  SITE (257)..(257): Xaa at position 257 is Trp, Tyr, Phe, Met, His, Ile, Leu Val, Ala, or Gly
  SITE (261)..(261): Xaa at position 261 is Phe, Tyr, Met, His, Ile, Leu, Val Ala, or Gly
  SITE (271)..(271): Xaa at position 271 is Phe, Tyr, Met, His, Ile, Leu, Val Ala, or Gly
  SITE (281)..(281): Xaa at position 281 is Ala, Gly, or Pro
  SITE (283)..(283): Xaa at position 283 is Met, Ile, Leu, Val, Ala, or Gly
  SITE (284)..(284): Xaa at position 284 is Met, Ile, Leu, Val, Ala, or Gly
  SITE (301)..(301): Xaa at position 301 is Val, Ala, Gly, Leu, or Ile
  SITE (302)..(302): Xaa at position 302 is Leu, Ala, Val, Gly, or Ile
  SITE (304)..(304): Xaa at position 304 is Leu, Ala, Val, Gly, or Ile
  SITE (306)..(306): Xaa at position 306 is Phe, Tyr, Met, His, Ile, Leu, Val Ala, or Gly
  SITE (311)..(311): Xaa at position 311 is Ile, Ala, Val, Leu, or Gly
  SITE (313)..(313): Xaa at position 313 is Met, Ile, Leu, Val, Ala, or Gly
  SITE (314)..(314): Xaa at position 314 is Val, Ala, Gly, Leu, or Ile
  SITE (315)..(315): Xaa at position 315 is Leu, Ala, Val, Gly, or Ile
  SITE (316)..(316): Xaa at position 316 is Ile, Ala, Val, Leu, or Gly
  SITE (317)..(317): Xaa at position 317 is Leu, Ala, Val, Gly, or Ile
  SITE (327)..(327): Xaa at position 327 is Val, Ala, Gly, Leu, or Ile
  SITE (331)..(331): Xaa at position 331 is Leu, Ala, Val, Gly, or Ile
  SITE (343)..(343): Xaa at position 343 is Leu, Ala, Val, Gly, or Ile
  SITE (348)..(348): Xaa at position 348 is Leu, Ala, Val, Gly, or Ile
  SITE (349)..(349): Xaa at position 349 is Val, Ala, Gly, Leu, or Ile
  SITE (350)..(350): Xaa at position 350 is Val, Ala, Gly, Leu, or Ile
  SITE (352)..(352): Xaa at position 352 is Met, Ile, Leu, Val, Ala, or Gly
  SITE (357)..(357): Xaa at position 357 is Ile, Ala, Val, Leu, or Gly
  SITE (363)..(363): Xaa at position 363 is Leu, Ala, Val, Gly, or Ile
  SITE (367)..(367): Xaa at position 367 is Leu, Ala, Val, Gly, or Ile
  SITE (372)..(372): Xaa at position 372 is Leu, Ala, Val, Gly, or Ile
  SITE (375)..(375): Xaa at position 375 is Leu, Ala, Val, Gly, or Ile
  SITE (383)..(383): Xaa at position 383 is Leu, Ala, Val, Gly, or Ile
  SITE (386)..(386): Xaa at position 386 is Ile, Ala, Val, Leu, or Gly
  SITE (388)..(388): Xaa at position 388 is Ala, Gly, or Pro
  SITE (394)..(394): Xaa at position 394 is Leu, Ala, Val, Gly, or Ile
  SITE (396)..(396): Xaa at position 396 is Val, Ala, Gly, Leu, or Ile
  SITE (399)..(399): Xaa at position 399 is Ala, Gly, or Pro
  SITE (401)..(401): Xaa at position 401 is His, Phe, Tyr, Lys, Arg, Gly, Ser Thr, Ala, Val, Leu, Ile, Asn, Met, or Gln
  SITE (403)..(403): Xaa at position 403 is Ala, Gly, or Pro
  SITE (405)..(405): Xaa at position 405 is Leu, Ala, Val, Gly, or Ile
  SITE (407)..(407): Xaa at position 407 is Val, Ala, Gly, Leu, or Ile
  SITE (414)..(414): Xaa at position 414 is Ala, Gly, or Pro
  SITE (415)..(415): Xaa at position 415 is Ala, Gly, or Pro
  SITE (416)..(416): Xaa at position 416 is Ala, Gly, or Pro
  SITE (419)..(419): Xaa at position 419 is Ala, Gly, or Pro
  SITE (420)..(420): Xaa at position 420 is Val, Ala, Gly, Leu, or Ile
  SITE (421)..(421): Xaa at position 421 is Val, Ala, Gly, Leu, or Ile
  SITE (422)..(422): Xaa at position 422 is Ile, Ala, Val, Leu, or Gly
  SITE (423)..(423): Xaa at position 423 is Ala, Gly, or Pro
  SITE (434)..(434): Xaa at position 434 is Phe, Tyr, Met, His, Ile, Leu, Val Ala, or Gly
  SITE (436)..(436): Xaa at position 436 is Ala, Gly, or Pro
  SITE (440)..(440): Xaa at position 440 is Phe, Tyr, Met, His, Ile, Leu, Val Ala, or Gly
  SITE (441)..(441): Xaa at position 441 is Leu, Ala, Val, Gly, or Ile
  SITE (442)..(442): Xaa at position 442 is Val, Ala, Gly, Leu, or Ile
  SITE (443)..(443): Xaa at position 443 is Phe, Tyr, Met, His, Ile, Leu, Val Ala, or Gly
  SITE (444)..(444): Xaa at position 444 is Ile, Ala, Val, Leu, or Gly
  SITE (447)..(447): Xaa at position 447 is Val, Ala, Gly, Leu, or Ile
  SITE (453)..(453): Xaa at position 453 is Ile, Ala, Val, Leu, or Gly
  SITE (454)..(454): Xaa at position 454 is Phe, Tyr, Met, His, Ile, Leu, Val Ala, or Gly
  SITE (455)..(455): Xaa at position 455 is Met, Ile, Leu, Val, Ala, or Gly
  SITE (458)..(458): Xaa at position 458 is Val, Ala, Gly, Leu, or Ile
  SITE (459)..(459): Xaa at position 459 is Ala, Gly, or Pro
MYSNVIGTVTSGKRKVYLLSLLLIGFWDCVTCHGSPVDICTAKPRDIPXNPMCIYRSPEKKATEDEGSEQKIPEXTNRRXWEXSKXNSRXXTTXXQHXADSKNDNDNXXXSPXSXSTXXXXTKLGXXNDTXQQXXEXXKXDTXSEKTSDQXXXXXXKXNCRXYRKXNKSSKLVSXNRXXGDKSLTFNETYQDISELXYGXKLQPLDXKENAEQSRAAXNKWXSNKTEGRXTDVXPSEXINEXTXXXXXNTXYXKGLXKSKXSPENTRKELXYKADGESCSXSXXYQEGKFRYRRVAEGTQXXEXPXKGDDXTXXXXXPKPEKSLAKXEKEXTPEVLQEWLDEXEEMMXXXHXPRFRXEDGFSXKEQXQDMGXVDXFSPEKSKXPGXVXEGRDDXYXSDXFXKXFXEXNEEGSEXXXSTXXXXXGRSLNPNRVTXKXNRPXXXXXREXPLNTIXXXGRXXNPCVK

SEQ ID NO: 108 - protein, 418 aa, Homo sapiens
  SITE (47)..(47): Xaa at position 47 is Phe, Tyr, Met, His, Ile, Leu, Val Ala, or Gly
  SITE (50)..(50): Xaa at position 50 is Ile, Ala, Val, Leu, or Gly
  SITE (54)..(54): Xaa at position 54 is Leu, Ala, Val, Gly, or Ile
  SITE (57)..(57): Xaa at position 57 is Phe, Tyr, Met, His, Ile, Leu, Val Ala, or Gly
  SITE (58)..(58): Xaa at position 58 is Ala, Gly, or Pro
  SITE (59)..(59): Xaa at position 59 is Phe, Tyr, Met, His, Ile, Leu, Val Ala, or Gly
  SITE (61)..(61): Xaa at position 61 is Leu, Ala, Val, Gly, or Ile
  SITE (62)..(62): Xaa at position 62 is Tyr, Phe, Met, His, Ile, Leu, Val Ala, or Gly
  SITE (65)..(65): Xaa at position 65 is Leu, Ala, Val, Gly, or Ile
  SITE (74)..(74): Xaa at position 74 is Ile, Ala, Val, Leu, or Gly
  SITE (75)..(75): Xaa at position 75 is Phe, Tyr, Met, His, Ile, Leu, Val Ala, or Gly
  SITE (76)..(76): Xaa at position 76 is Phe, Tyr, Met, His, Ile, Leu, Val Ala, or Gly
  SITE (79)..(79): Xaa at position 79 is Val, Ala, Gly, Leu, or Ile
  SITE (81)..(81): Xaa at position 81 is Ile, Ala, Val, Leu, or Gly
  SITE (82)..(82): Xaa at position 82 is Ala, Gly, or Pro
  SITE (84)..(84): Xaa at position 84 is Ala, Gly, or Pro
  SITE (85)..(85): Xaa at position 85 is Phe, Tyr, Met, His, Ile, Leu, Val Ala, or Gly
  SITE (86)..(86): Xaa at position 86 is Ala, Gly, or Pro
  SITE (87)..(87): Xaa at position 87 is Met, Ile, Leu, Val, Ala, or Gly
  SITE (88)..(88): Xaa at position 88 is Leu, Ala, Val, Gly, or Ile
  SITE (100)..(100): Xaa at position 100 is Ile, Ala, Val, Leu, or Gly
  SITE (101)..(101): Xaa at position 101 is Leu, Ala, Val, Gly, or Ile
  SITE (104)..(104): Xaa at position 104 is Leu, Ala, Val, Gly, or Ile
  SITE (106)..(106): Xaa at position 106 is Phe, Tyr, Met, His, Ile, Leu, Val Ala, or Gly
  SITE (111)..(111): Xaa at position 111 is Ile, Ala, Val, Leu, or Gly
  SITE (116)..(116): Xaa at position 116 is Ile, Ala, Val, Leu, or Gly
  SITE (120)..(120): Xaa at position 120 is Phe, Tyr, Met, His, Ile, Leu, Val Ala, or Gly
  SITE (123)..(123): Xaa at position 123 is Leu, Ala, Val, Gly, or Ile
  SITE (124)..(124): Xaa at position 124 is Leu, Ala, Val, Gly, or Ile
  SITE (127)..(127): Xaa at position 127 is Leu, Ala, Val, Gly, or Ile
  SITE (134)..(134): Xaa at position 134 is Leu, Ala, Val, Gly, or Ile
  SITE (142)..(142): Xaa at position 142 is Leu, Ala, Val, Gly, or Ile
  SITE (143)..(143): Xaa at position 143 is Phe, Tyr, Met, His, Ile, Leu, Val Ala, or Gly
  SITE (144)..(144): Xaa at position 144 is Leu, Ala, Val, Gly, or Ile
  SITE (154)..(154): Xaa at position 154 is Phe, Tyr, Met, His, Ile, Leu, Val Ala, or Gly
  SITE (158)..(158): Xaa at position 158 is Val, Ala, Gly, Leu, or Ile
  SITE (161)..(161): Xaa at position 161 is Leu, Ala, Val, Gly, or Ile
  SITE (162)..(162): Xaa at position 162 is Tyr, Phe, Met, His, Ile, Leu, Val Ala, or Gly
  SITE (169)..(169): Xaa at position 169 is Val, Ala, Gly, Leu, or Ile
  SITE (171)..(171): Xaa at position 171 is Phe, Tyr, Met, His, Ile, Leu, Val Ala, or Gly
  SITE (177)..(177): Xaa at position 177 is Ala, Gly, or Pro
  SITE (181)..(181): Xaa at position 181 is Ile, Ala, Val, Leu, or Gly
  SITE (185)..(185): Xaa at position 185 is Val, Ala, Gly, Leu, or Ile
  SITE (193)..(193): Xaa at position 193 is Ile, Ala, Val, Leu, or Gly
  SITE (197)..(197): Xaa at position 197 is Val, Ala, Gly, Leu, or Ile
  SITE (205)..(205): Xaa at position 205 is Val, Ala, Gly, Leu, or Ile
  SITE (206)..(206): Xaa at position 206 is Phe, Tyr, Met, His, Ile, Leu, Val Ala, or Gly
  SITE (207)..(207): Xaa at position 207 is Ala, Gly, or Pro
  SITE (208)..(208): Xaa at position 208 is Leu, Ala, Val, Gly, or Ile
  SITE (209)..(209): Xaa at position 209 is Val, Ala, Gly, Leu, or Ile
  SITE (212)..(212): Xaa at position 212 is Ile, Ala, Val, Leu, or Gly
  SITE (213)..(213): Xaa at position 213 is Phe, Tyr, Met, His, Ile, Leu, Val Ala, or Gly
  SITE (214)..(214): Xaa at position 214 is Phe, Tyr, Met, His, Ile, Leu, Val Ala, or Gly
  SITE (218)..(218): Xaa at position 218 is Trp, Tyr, Phe, Met, His, Ile, Leu Val, Ala, or Gly
  SITE (222)..(222): Xaa at position 222 is Phe, Tyr, Met, His, Ile, Leu, Val Ala, or Gly
  SITE (224)..(224): Xaa at position 224 is Val, Ala, Gly, Leu, or Ile
  SITE (232)..(232): Xaa at position 232 is Phe, Tyr, Met, His, Ile, Leu, Val Ala, or Gly
  SITE (234)..(234): Xaa at position 234 is Val, Ala, Gly, Leu, or Ile
  SITE (242)..(242): Xaa at position 242 is Val, Ala, Gly, Leu, or Ile
  SITE (244)..(244): Xaa at position 244 is Met, Ile, Leu, Val, Ala, or Gly
  SITE (245)..(245): Xaa at position 245 is Met, Ile, Leu, Val, Ala, or Gly
  SITE (251)..(251): Xaa at position 251 is Phe, Tyr, Met, His, Ile, Leu, Val Ala, or Gly
  SITE (253)..(253): Xaa at position 253 is Ile, Ala, Val, Leu, or Gly
  SITE (259)..(259): Xaa at position 259 is Leu, Ala, Val, Gly, or Ile
  SITE (263)..(263): Xaa at position 263 is Val, Ala, Gly, Leu, or Ile
  SITE (264)..(264): Xaa at position 264 is Leu, Ala, Val, Gly, or Ile
  SITE (266)..(266): Xaa at position 266 is Met, Ile, Leu, Val, Ala, or Gly
  SITE (268)..(268): Xaa at position 268 is Tyr, Phe, Met, His, Ile, Leu, Val Ala, or Gly
  SITE (272)..(272): Xaa at position 272 is Ala, Gly, or Pro
  SITE (274)..(274): Xaa at position 274 is Ala, Gly, or Pro
  SITE (275)..(275): Xaa at position 275 is Ile, Ala, Val, Leu, or Gly
  SITE (276)..(276): Xaa at position 276 is Phe, Tyr, Met, His, Ile, Leu, Val Ala, or Gly
  SITE (277)..(277): Xaa at position 277 is Phe, Tyr, Met, His, Ile, Leu, Val Ala, or Gly
  SITE (278)..(278): Xaa at position 278 is Leu, Ala, Val, Gly, or Ile
  SITE (284)..(284): Xaa at position 284 is Leu, Ala, Val, Gly, or Ile
  SITE (287)..(287): Xaa at position 287 is Leu, Ala, Val, Gly, or Ile
  SITE (291)..(291): Xaa at position 291 is Leu, Ala, Val, Gly, or Ile
  SITE (295)..(295): Xaa at position 295 is Ile, Ala, Val, Leu, or Gly
  SITE (299)..(299): Xaa at position 299 is Phe, Tyr, Met, His, Ile, Leu, Val Ala, or Gly
  SITE (300)..(300): Xaa at position 300 is Leu, Ala, Val, Gly, or Ile
  SITE (308)..(308): Xaa at position 308 is Ala, Gly, or Pro
  SITE (310)..(310): Xaa at position 310 is Leu, Ala, Val, Gly, or Ile
  SITE (311)..(311): Xaa at position 311 is His, Phe, Tyr, Lys, Arg, Gly, Ser Thr, Ala, Val, Leu, Ile, Asn, Met, or Gln
  SITE (312)..(312): Xaa at position 312 is Leu, Ala, Val, Gly, or Ile
  SITE (317)..(317): Xaa at position 317 is Ile, Ala, Val, Leu, or Gly
  SITE (323)..(323): Xaa at position 323 is Leu, Ala, Val, Gly, or Ile
  SITE (327)..(327): Xaa at position 327 is Leu, Ala, Val, Gly, or Ile
  SITE (330)..(330): Xaa at position 330 is Leu, Ala, Val, Gly, or Ile
  SITE (332)..(332): Xaa at position 332 is Ile, Ala, Val, Leu, or Gly
  SITE (335)..(335): Xaa at position 335 is Val, Ala, Gly, Leu, or Ile
  SITE (340)..(340): Xaa at position 340 is Ala, Gly, or Pro
  SITE (342)..(342): Xaa at position 342 is Leu, Ala, Val, Gly, or Ile
  SITE (345)..(345): Xaa at position 345 is Val, Ala, Gly, Leu, or Ile
  SITE (351)..(351): Xaa at position 351 is Leu, Ala, Val, Gly, or Ile
  SITE (353)..(353): Xaa at position 353 is Leu, Ala, Val, Gly, or Ile
  SITE (356)..(356): Xaa at position 356 is Ala, Gly, or Pro
  SITE (357)..(357): Xaa at position 357 is Val, Ala, Gly, Leu, or Ile
  SITE (358)..(358): Xaa at position 358 is His, Phe, Tyr, Lys, Arg, Gly, Ser Thr, Ala, Val, Leu, Ile, Asn, Met, or Gln
  SITE (360)..(360): Xaa at position 360 is Ala, Gly, or Pro
  SITE (361)..(361): Xaa at position 361 is Val, Ala, Gly, Leu, or Ile
  SITE (362)..(362): Xaa at position 362 is Leu, Ala, Val, Gly, or Ile
  SITE (364)..(364): Xaa at position 364 is Ile, Ala, Val, Leu, or Gly
  SITE (371)..(371): Xaa at position 371 is Ala, Gly, or Pro
  SITE (372)..(372): Xaa at position 372 is Ala, Gly, or Pro
  SITE (374)..(374): Xaa at position 374 is Ala, Gly, or Pro
  SITE (375)..(375): Xaa at position 375 is Met, Ile, Leu, Val, Ala, or Gly
  SITE (376)..(376): Xaa at position 376 is Phe, Tyr, Met, His, Ile, Leu, Val Ala, or Gly
  SITE (377)..(377): Xaa at position 377 is Leu, Ala, Val, Gly, or Ile
  SITE (379)..(379): Xaa at position 379 is Ala, Gly, or Pro
  SITE (380)..(380): Xaa at position 380 is Ile, Ala, Val, Leu, or Gly
  SITE (388)..(388): Xaa at position 388 is Val, Ala, Gly, Leu, or Ile
  SITE (390)..(390): Xaa at position 390 is Phe, Tyr, Met, His, Ile, Leu, Val Ala, or Gly
  SITE (394)..(394): Xaa at position 394 is Phe, Tyr, Met, His, Ile, Leu, Val Ala, or Gly
  SITE (395)..(395): Xaa at position 395 is Val, Ala, Gly, Leu, or Ile
  SITE (396)..(396): Xaa at position 396 is Phe, Tyr, Met, His, Ile, Leu, Val Ala, or Gly
  SITE (397)..(397): Xaa at position 397 is Leu, Ala, Val, Gly, or Ile
  SITE (398)..(398): Xaa at position 398 is Met, Ile, Leu, Val, Ala, or Gly
  SITE (407)..(407): Xaa at position 407 is Leu, Ala, Val, Gly, or Ile
  SITE (408)..(408): Xaa at position 408 is Phe, Tyr, Met, His, Ile, Leu, Val Ala, or Gly
  SITE (409)..(409): Xaa at position 409 is Met, Ile, Leu, Val, Ala, or Gly
  SITE (412)..(412): Xaa at position 412 is Val, Ala, Gly, Leu, or Ile
  SITE (413)..(413): Xaa at position 413 is Val, Ala, Gly, Leu, or Ile
MPSSVSWGILLLAGLCCLVPVSLAEDPQGDAAQKTDTSHHDQDHPTXNKXTPNXAEXXXSXXRQXAHQSNSTNXXXSPXSXXTXXXXXSLGTKADTHDEXXEGXNXNLTEXPEAQXHEGXQEXXRTXNQPDSQXQLTTGNGXXXSEGLKLVDKXLEDXKKXXHSEAFTXNXGDTEEXKKQXNDYXEKGTQGKXVDLXKELDRDTXXXXXNYXXXKGKXERPXEXKDTEEEDXHXDQVTTVKXPXXKRLGMXNXQHCKKXSSWXXLXKXLGNXTXXXXXPDEGKXQHXENEXTHDXITKXXENEDRRSXSXXXPKLSXTGTYDXKSVXGQXGXTKXFSNGXDXSGXTEEAPXKXSKXXXKXXXTXDEKGTEXXGXXXXEXXPMSIPPEXKXNKPXXXXXIEQNTKSPXXXGKXXNPTQK

SEQ ID NO: 109 - protein, 485 aa, Homo sapiens
  SITE (44)..(44): Xaa at position 44 is Val, Ala, Gly, Leu, or Ile
  SITE (103)..(103): Xaa at position 103 is Ala, Gly, or Pro
  SITE (106)..(106): Xaa at position 106 is Val, Ala, Gly, Leu, or Ile
  SITE (109)..(109): Xaa at position 109 is Leu, Ala, Val, Gly, or Ile
  SITE (110)..(110): Xaa at position 110 is Ala, Gly, or Pro
  SITE (113)..(113): Xaa at position 113 is Leu, Ala, Val, Gly, or Ile
  SITE (115)..(115): Xaa at position 115 is Phe, Tyr, Met, His, Ile, Leu, Val Ala, or Gly
  SITE (117)..(117): Xaa at position 117 is Ile, Ala, Val, Leu, or Gly
  SITE (118)..(118): Xaa at position 118 is Tyr, Phe, Met, His, Ile, Leu, Val Ala, or Gly
  SITE (133)..(133): Xaa at position 133 is Val, Ala, Gly, Leu, or Ile
  SITE (134)..(134): Xaa at position 134 is Leu, Ala, Val, Gly, or Ile
  SITE (138)..(138): Xaa at position 138 is Ala, Gly, or Pro
  SITE (139)..(139): Xaa at position 139 is Val, Ala, Gly, Leu, or Ile
  SITE (140)..(140): Xaa at position 140 is Phe, Tyr, Met, His, Ile, Leu, Val Ala, or Gly
  SITE (143)..(143): Xaa at position 143 is Leu, Ala, Val, Gly, or Ile
  SITE (144)..(144): Xaa at position 144 is Ala, Gly, or Pro
  SITE (146)..(146): Xaa at position 146 is Leu, Ala, Val, Gly, or Ile
  SITE (158)..(158): Xaa at position 158 is Leu, Ala, Val, Gly, or Ile
  SITE (162)..(162): Xaa at position 162 is Leu, Ala, Val, Gly, or Ile
  SITE (164)..(164): Xaa at position 164 is Val, Ala, Gly, Leu, or Ile
  SITE (175)..(175): Xaa at position 175 is Leu, Ala, Val, Gly, or Ile
  SITE (180)..(180): Xaa at position 180 is Val, Ala, Gly, Leu, or Ile
  SITE (181)..(181): Xaa at position 181 is Leu, Ala, Val, Gly, or Ile
  SITE (183)..(183): Xaa at position 183 is Ala, Gly, or Pro
  SITE (184)..(184): Xaa at position 184 is Leu, Ala, Val, Gly, or Ile
  SITE (186)..(186): Xaa at position 186 is Ala, Gly, or Pro
  SITE (187)..(187): Xaa at position 187 is Val, Ala, Gly, Leu, or Ile
  SITE (191)..(191): Xaa at position 191 is Leu, Ala, Val, Gly, or Ile
  SITE (192)..(192): Xaa at position 192 is Val, Ala, Gly, Leu, or Ile
  SITE (203)..(203): Xaa at position 203 is Leu, Ala, Val, Gly, or Ile
  SITE (205)..(205): Xaa at position 205 is Leu, Ala, Val, Gly, or Ile
  SITE (208)..(208): Xaa at position 208 is Val, Ala, Gly, Leu, or Ile
  SITE (209)..(209): Xaa at position 209 is Val, Ala, Gly, Leu, or Ile
  SITE (211)..(211): Xaa at position 211 is Val, Ala, Gly, Leu, or Ile
  SITE (212)..(212): Xaa at position 212 is Phe, Tyr, Met, His, Ile, Leu, Val Ala, or Gly
  SITE (217)..(217): Xaa at position 217 is Leu, Ala, Val, Gly, or Ile
  SITE (219)..(219): Xaa at position 219 is Leu, Ala, Val, Gly, or Ile
  SITE (223)..(223): Xaa at position 223 is Phe, Tyr, Met, His, Ile, Leu, Val Ala, or Gly
  SITE (227)..(227): Xaa at position 227 is Leu, Ala, Val, Gly, or Ile
  SITE (230)..(230): Xaa at position 230 is Tyr, Phe, Met, His, Ile, Leu, Val Ala, or Gly
  SITE (241)..(241): Xaa at position 241 is Phe, Tyr, Met, His, Ile, Leu, Val Ala, or Gly
  SITE (247)..(247): Xaa at position 247 is Ala, Gly, or Pro
  SITE (255)..(255): Xaa at position 255 is Met, Ile, Leu, Val, Ala, or Gly
  SITE (258)..(258): Xaa at position 258 is Val, Ala, Gly, Leu, or Ile
  SITE (276)..(276): Xaa at position 276 is Leu, Ala, Val, Gly, or Ile
  SITE (277)..(277): Xaa at position 277 is Ala, Gly, or Pro
  SITE (278)..(278): Xaa at position 278 is Phe, Tyr, Met, His, Ile, Leu, Val Ala, or Gly
  SITE (281)..(281): Xaa at position 281 is Tyr, Phe, Met, His, Ile, Leu, Val Ala, or Gly
  SITE (282)..(282): Xaa at position 282 is Val, Ala, Gly, Leu, or Ile
  SITE (284)..(284): Xaa at position 284 is Phe, Tyr, Met, His, Ile, Leu, Val Ala, or Gly
  SITE (288)..(288): Xaa at position 288 is Met, Ile, Leu, Val, Ala, or Gly
  SITE (291)..(291): Xaa at position 291 is Phe, Tyr, Met, His, Ile, Leu, Val Ala, or Gly
  SITE (300)..(300): Xaa at position 300 is Phe, Tyr, Met, His, Ile, Leu, Val Ala, or Gly
  SITE (310)..(310): Xaa at position 310 is Val, Ala, Gly, Leu, or Ile
  SITE (313)..(313): Xaa at position 313 is Leu, Ala, Val, Gly, or Ile
  SITE (331)..(331): Xaa at position 331 is Val, Ala, Gly, Leu, or Ile
  SITE (334)..(334): Xaa at position 334 is Val, Ala, Gly, Leu, or Ile
  SITE (340)..(340): Xaa at position 340 is Ala, Gly, or Pro
  SITE (341)..(341): Xaa at position 341 is Cys, Ala, Val, Gly, Ser, or Thr
  SITE (342)..(342): Xaa at position 342 is Leu, Ala, Val, Gly, or Ile
  SITE (343)..(343): Xaa at position 343 is Leu, Ala, Val, Gly, or Ile
  SITE (344)..(344): Xaa at position 344 is Leu, Ala, Val, Gly, or Ile
  SITE (345)..(345): Xaa at position 345 is Ile, Ala, Val, Leu, or Gly
  SITE (356)..(356): Xaa at position 356 is Val, Ala, Gly, Leu, or Ile
  SITE (361)..(361): Xaa at position 361 is Phe, Tyr, Met, His, Ile, Leu, Val Ala, or Gly
  SITE (377)..(377): Xaa at position 377 is Ile, Ala, Val, Leu, or Gly
  SITE (379)..(379): Xaa at position 379 is Leu, Ala, Val, Gly, or Ile
  SITE (381)..(381): Xaa at position 381 is Met, Ile, Leu, Val, Ala, or Gly
  SITE (384)..(384): Xaa at position 384 is Leu, Ala, Val, Gly, or Ile
  SITE (392)..(392): Xaa at position 392 is Leu, Ala, Val, Gly, or Ile
  SITE (395)..(395): Xaa at position 395 is Leu, Ala, Val, Gly, or Ile
  SITE (396)..(396): Xaa at position 396 is Leu, Ala, Val, Gly, or Ile
  SITE (404)..(404): Xaa at position 404 is Ile, Ala, Val, Leu, or Gly
  SITE (405)..(405): Xaa at position 405 is Leu, Ala, Val, Gly, or Ile
  SITE (409)..(409): Xaa at position 409 is Leu, Ala, Val, Gly, or Ile
  SITE (411)..(411): Xaa at position 411 is Leu, Ala, Val, Gly, or Ile
  SITE (414)..(414): Xaa at position 414 is Leu, Ala, Val, Gly, or Ile
  SITE (424)..(424): Xaa at position 424 is Val, Ala, Gly, Leu, or Ile
  SITE (428)..(428): Xaa at position 428 is Ile, Ala, Val, Leu, or Gly
  SITE (430)..(430): Xaa at position 430 is Phe, Tyr, Met, His, Ile, Leu, Val Ala, or Gly
  SITE (432)..(432): Xaa at position 432 is Leu, Ala, Val, Gly, or Ile
  SITE (456)..(456): Xaa at position 456 is Leu, Ala, Val, Gly, or Ile
  SITE (460)..(460): Xaa at position 460 is Phe, Tyr, Met, His, Ile, Leu, Val Ala, or Gly
  SITE (461)..(461): Xaa at position 461 is Leu, Ala, Val, Gly, or Ile
  SITE (463)..(463): Xaa at position 463 is Ala, Gly, or Pro
  SITE (464)..(464): Xaa at position 464 is Val, Ala, Gly, Leu, or Ile
  SITE (469)..(469): Xaa at position 469 is Ala, Gly, or Pro
  SITE (471)..(471): Xaa at position 471 is Ala, Gly, or Pro
  SITE (472)..(472): Xaa at position 472 is Leu, Ala, Val, Gly, or Ile
  SITE (473)..(473): Xaa at position 473 is His, Phe, Tyr, Lys, Arg, Gly, Ser Thr, Ala, Val, Leu, Ile, Asn, Met, or Gln
  SITE (474)..(474): Xaa at position 474 is Phe, Tyr, Met, His, Ile, Leu, Val Ala, or Gly
  SITE (475)..(475): Xaa at position 475 is Leu, Ala, Val, Gly, or Ile
  SITE (478)..(478): Xaa at position 478 is Val, Ala, Gly, Leu, or Ile
MRKRAPQSEMAPAGVSLRATILCLLAWAGLAAGDRVYIHPFHLXIHNESTCEQLAKANAGKPKDPTFIPAPIQAKTSPVDEKALQDQLVLVAAKLDTEDKLRXAMXGMXXNFXGXRXXGMHSELWGVVHGATXXSPTXXXGTXXSXYLGALDHTADRXQAIXGXPWKDKNCTSRXDAHKXXSXXQXXQGLXXAQGRADSQAQXLXSTXXGXXTAPGXHXKQPXVQGXALXTPVVLPRSLDXTELDVXAEKIDRFXQAXTGWKTGCSLMGASVDSTXXXNTXXHXQGKXKGXSLLAEPQEXWVDNSTSVSXPMXSGMGTFQHWSDIQDNFSXTQXPFTESXXXXXXQPHYASDLDKXEGLTXQQNSLNWMKKLSPRTXHXTXPQXVLQGSYDXQDXXAQAELPAXXHTEXNXQKXSNDRIRVGEXLNSXFXEXEADEREPTESTQQLNKPEVLEVTXNRPXXFXXYDQSXTXXXXXGRXANPLSTA

SEQ ID NO: 110 - protein, 1663 aa, Homo sapiens
  SITE (25)..(25): Xaa at position 25 is Met, Ile, Leu, Val, Ala, or Gly
  SITE (28)..(28): Xaa at position 28 is Ile, Ala, Val, Leu, or Gly
  SITE (29)..(29): Xaa at position 29 is Ile, Ala, Val, Leu, or Gly
  SITE (34)..(34): Xaa at position 34 is Leu, Ala, Val, Gly, or Ile
  SITE (42)..(42): Xaa at position 42 is Met, Ile, Leu, Val, Ala, or Gly
  SITE (44)..(44): Xaa at position 44 is Leu, Ala, Val, Gly, or Ile
  SITE (46)..(46): Xaa at position 46 is Ala, Gly, or Pro
  SITE (47)..(47): Xaa at position 47 is His, Phe, Tyr, Lys, Arg, Gly, Ser Thr, Ala, Val, Leu, Ile, Asn, Met, or Gln
  SITE (55)..(55): Xaa at position 55 is Val, Ala, Gly, Leu, or Ile
  SITE (57)..(57): Xaa at position 57 is Val, Ala, Gly, Leu, or Ile
  SITE (59)..(59): Xaa at position 59 is Val, Ala, Gly, Leu, or Ile
  SITE (76)..(76): Xaa at position 76 is Leu, Ala, Val, Gly, or Ile
  SITE (86)..(86): Xaa at position 86 is Val, Ala, Gly, Leu, or Ile
  SITE (88)..(88): Xaa at position 88 is Phe, Tyr, Met, His, Ile, Leu, Val Ala, or Gly
  SITE (90)..(90): Xaa at position 90 is Ile, Ala, Val, Leu, or Gly
  SITE (106)..(106): Xaa at position 106 is Val, Ala, Gly, Leu, or Ile
  SITE (108)..(108): Xaa at position 108 is Val, Ala, Gly, Leu, or Ile
  SITE (110)..(110): Xaa at position 110 is Ala, Gly, or Pro
  SITE (112)..(112): Xaa at position 112 is Phe, Tyr, Met, His, Ile, Leu, Val Ala, or Gly
  SITE (117)..(117): Xaa at position 117 is Val, Ala, Gly, Leu, or Ile
  SITE (121)..(121): Xaa at position 121 is Val, Ala, Gly, Leu, or Ile
  SITE (122)..(122): Xaa at position 122 is Leu, Ala, Val, Gly, or Ile
  SITE (123)..(123): Xaa at position 123 is Val, Ala, Gly, Leu, or Ile
  SITE (129)..(129): Xaa at position 129 is Tyr, Phe, Met, His, Ile, Leu, Val Ala, or Gly
  SITE (138)..(138): Xaa at position 138 is Ile, Ala, Val, Leu, or Gly
  SITE (139)..(139): Xaa at position 139 is Tyr, Phe, Met, His, Ile, Leu, Val Ala, or Gly
  SITE (145)..(145): Xaa at position 145 is Val, Ala, Gly, Leu, or Ile
  SITE (147)..(147): Xaa at position 147 is Tyr, Phe, Met, His, Ile, Leu, Val Ala, or Gly
  SITE (149)..(149): Xaa at position 149 is Ile, Ala, Val, Leu, or Gly
  SITE (150)..(150): Xaa at position 150 is Phe, Tyr, Met, His, Ile, Leu, Val Ala, or Gly
  SITE (152)..(152): Xaa at position 152 is Val, Ala, Gly, Leu, or Ile
  SITE (163)..(163): Xaa at position 163 is Val, Ala, Gly, Leu, or Ile
  SITE (165)..(165): Xaa at position 165 is Val, Ala, Gly, Leu, or Ile
  SITE (167)..(167): Xaa at position 167 is Ile, Ala, Val, Leu, or Gly
  SITE (188)..(188): Xaa at position 188 is Val, Ala, Gly, Leu, or Ile
  SITE (189)..(189): Xaa at position 189 is Leu, Ala, Val, Gly, or Ile
  SITE (204)..(204): Xaa at position 204 is Trp, Tyr, Phe, Met, His, Ile, Leu Val, Ala, or Gly
  SITE (206)..(206): Xaa at position 206 is Ile, Ala, Val, Leu, or Gly
  SITE (208)..(208): Xaa at position 208 is Ala, Gly, or Pro
  SITE (210)..(210): Xaa at position 210 is Tyr, Phe, Met, His, Ile, Leu, Val Ala, or Gly
  SITE (222)..(222): Xaa at position 222 is Phe, Tyr, Met, His, Ile, Leu, Val Ala, or Gly
  SITE (224)..(224): Xaa at position 224 is Val, Ala, Gly, Leu, or Ile
  SITE (232)..(232): Xaa at position 232 is Phe, Tyr, Met, His, Ile, Leu, Val Ala, or Gly
  SITE (243)..(243): Xaa at position 243 is Tyr, Phe, Met, His, Ile, Leu, Val Ala, or Gly
  SITE (245)..(245): Xaa at position 245 is Ile, Ala, Val, Leu, or Gly
  SITE (251)..(251): Xaa at position 251 is Leu, Ala, Val, Gly, or Ile
  SITE (253)..(253): Xaa at position 253 is Val, Ala, Gly, Leu, or Ile
  SITE (255)..(255): Xaa at position 255 is Ile, Ala, Val, Leu, or Gly
  SITE (257)..(257): Xaa at position 257 is Ala, Gly, or Pro
  SITE (265)..(265): Xaa at position 265 is Val, Ala, Gly, Leu, or Ile
  SITE (269)..(269): Xaa at position 269 is Ala, Gly, or Pro
  SITE (271)..(271): Xaa at position 271 is Val, Ala, Gly, Leu, or Ile
  SITE (273)..(273): Xaa at position 273 is Phe, Tyr, Met, His, Ile, Leu, Val Ala, or Gly
  SITE (275)..(275): Xaa at position 275 is Ile, Ala, Val, Leu, or Gly
  SITE (284)..(284): Xaa at position 284 is Leu, Ala, Val, Gly, or Ile
  SITE (293)..(293): Xaa at position 293 is Ile, Ala, Val, Leu, or Gly
  SITE (300)..(300): Xaa at position 300 is Val, Ala, Gly, Leu, or Ile
  SITE (302)..(302): Xaa at position 302 is Leu, Ala, Val, Gly, or Ile
  SITE (319)..(319): Xaa at position 319 is Leu, Ala, Val, Gly, or Ile
  SITE (324)..(324): Xaa at position 324 is Leu, Ala, Val, Gly, or Ile
  SITE (326)..(326): Xaa at position 326 is Val, Ala, Gly, Leu, or Ile
  SITE (328)..(328): Xaa at position 328 is Ala, Gly, or Pro
  SITE (330)..(330): Xaa at position 330 is Val, Ala, Gly, Leu, or Ile
  SITE (346)..(346): Xaa at position 346 is Ile, Ala, Val, Leu, or Gly
  SITE (348)..(348): Xaa at position 348 is Ile, Ala, Val, Leu, or Gly
  SITE (355)..(355): Xaa at position 355 is Ile, Ala, Val, Leu, or Gly
  SITE (364)..(364): Xaa at position 364 is Phe, Tyr, Met, His, Ile, Leu, Val Ala, or Gly
  SITE (368)..(368): Xaa at position 368 is Met, Ile, Leu, Val, Ala, or Gly
  SITE (370)..(370): Xaa at position 370 is Phe, Tyr, Met, His, Ile, Leu, Val Ala, or Gly
  SITE (372)..(372): Xaa at position 372 is Leu, Ala, Val, Gly, or Ile
  SITE (374)..(374): Xaa at position 374 is Val, Ala, Gly, Leu, or Ile
  SITE (376)..(376): Xaa at position 376 is Val, Ala, Gly, Leu, or Ile
  SITE (384)..(384): Xaa at position 384 is Ala, Gly, or Pro
  SITE (387)..(387): Xaa at position 387 is Val, Ala, Gly, Leu, or Ile
  SITE (389)..(389): Xaa at position 389 is Val, Ala, Gly, Leu, or Ile
  SITE (400)..(400): Xaa at position 400 is Leu, Ala, Val, Gly, or Ile
  SITE (407)..(407): Xaa at position 407 is Ala, Gly, or Pro
  SITE (409)..(409): Xaa at position 409 is Leu, Ala, Val, Gly, or Ile
  SITE (422)..(422): Xaa at position 422 is Ile, Ala, Val, Leu, or Gly
  SITE (424)..(424): Xaa at position 424 is Val, Ala, Gly, Leu, or Ile
  SITE (443)..(443): Xaa at position 443 is Ala, Gly, or Pro
  SITE (446)..(446): Xaa at position 446 is Tyr, Phe, Met, His, Ile, Leu, Val Ala, or Gly
  SITE (455)..(455): Xaa at position 455 is Tyr, Phe, Met, His, Ile, Leu, Val Ala, or Gly
  SITE (456)..(456): Xaa at position 456 is Leu, Ala, Val, Gly, or Ile
  SITE (465)..(465): Xaa at position 465 is Leu, Ala, Val, Gly, or Ile
  SITE (473)..(473): Xaa at position 473 is Val, Ala, Gly, Leu, or Ile
  SITE (475)..(475): Xaa at position 475 is Phe, Tyr, Met, His, Ile, Leu, Val Ala, or Gly
  SITE (487)..(487): Xaa at position 487 is Ile, Ala, Val, Leu, or Gly
  SITE (490)..(490): Xaa at position 490 is Tyr, Phe, Met, His, Ile, Leu, Val Ala, or Gly
  SITE (493)..(493): Xaa at position 493 is Leu, Ala, Val, Gly, or Ile
  SITE (494)..(494): Xaa at position 494 is Ile, Ala, Val, Leu, or Gly
  SITE (521)..(521): Xaa at position 521 is Ile, Ala, Val, Leu, or Gly
  SITE (526)..(526): Xaa at position 526 is Ile, Ala, Val, Leu, or Gly
  SITE (529)..(529): Xaa at position 529 is Phe, Tyr, Met, His, Ile, Leu, Val Ala, or Gly
  SITE (531)..(531): Xaa at position 531 is Leu, Ala, Val, Gly, or Ile
  SITE (532)..(532): Xaa at position 532 is Val, Ala, Gly, Leu, or Ile
  SITE (533)..(533): Xaa at position 533 is Ala, Gly, or Pro
  SITE (534)..(534): Xaa at position 534 is Tyr, Phe, Met, His, Ile, Leu, Val Ala, or Gly
  SITE (535)..(535): Xaa at position 535 is Tyr, Phe, Met, His, Ile, Leu, Val Ala, or Gly
  SITE (537)..(537): Xaa at position 537 is Leu, Ala, Val, Gly, or Ile
  SITE (546)..(546): Xaa at position 546 is Val, Ala, Gly, Leu, or Ile
  SITE (547)..(547): Xaa at position 547 is Val, Ala, Gly, Leu, or Ile
  SITE (548)..(548): Xaa at position 548 is Ala, Gly, or Pro
  SITE (555)..(555): Xaa at position 555 is Val, Ala, Gly, Leu, or Ile
  SITE (585)..(585): Xaa at position 585 is Ile, Ala, Val, Leu, or Gly
  SITE (591)..(591): Xaa at position 591 is Ala, Gly, or Pro
  SITE (593)..(593): Xaa at position 593 is Val, Ala, Gly, Leu, or Ile
  SITE (596)..(596): Xaa at position 596 is Val, Ala, Gly, Leu, or Ile
  SITE (597)..(597): Xaa at position 597 is Ala, Gly, or Pro
  SITE (602)..(602): Xaa at position 602 is Val, Ala, Gly, Leu, or Ile
  SITE (616)..(616): Xaa at position 616 is Ile, Ala, Val, Leu, or Gly
  SITE (617)..(617): Xaa at position 617 is Trp, Tyr, Phe, Met, His, Ile, Leu Val, Ala, or Gly
  SITE (620)..(620): Xaa at position 620 is Val, Ala, Gly, Leu, or Ile
  SITE (638)..(638): Xaa at position 638 is Val, Ala, Gly, Leu, or Ile
  SITE (639)..(639): Xaa at position 639 is Phe, Tyr, Met, His, Ile, Leu, Val Ala, or Gly
  SITE (642)..(642): Xaa at position 642 is Ala, Gly, or Pro
  SITE (644)..(644): Xaa at position 644 is Leu, Ala, Val, Gly, or Ile
  SITE (646)..(646): Xaa at position 646 is Phe, Tyr, Met, His, Ile, Leu, Val Ala, or Gly
  SITE (693)..(693): Xaa at position 693 is Cys, Ala, Val, Gly, Ser, or Thr
  SITE (694)..(694): Xaa at position 694 is Cys, Ala, Val, Gly, Ser, or Thr
  SITE (698)..(698): Xaa at position 698 is Met, Ile, Leu, Val, Ala, or Gly
  SITE (703)..(703): Xaa at position 703 is Met, Ile, Leu, Val, Ala, or Gly
  SITE (723)..(723): Xaa at position 723 is Val, Ala, Gly, Leu, or Ile
  SITE (724)..(724): Xaa at position 724 is Phe, Tyr, Met, His, Ile, Leu, Val Ala, or Gly
  SITE (727)..(727): Xaa at position 727 is Cys, Ala, Val, Gly, Ser, or Thr
  SITE (728)..(728): Xaa at position 728 is Cys, Ala, Val, Gly, Ser, or Thr
  SITE (731)..(731): Xaa at position 731 is Ile, Ala, Val, Leu, or Gly
  SITE (802)..(802): Xaa at position 802 is Trp, Tyr, Phe, Met, His, Ile, Leu Val, Ala, or Gly
  SITE (806)..(806): Xaa at position 806 is Ala, Gly, or Pro
  SITE (825)..(825): Xaa at position 825 is Val, Ala, Gly, Leu, or Ile
  SITE (829)..(829): Xaa at position 829 is Phe, Tyr, Met, His, Ile, Leu, Val Ala, or Gly
  SITE (833)..(833): Xaa at position 833 is Leu, Ala, Val, Gly, or Ile
  SITE (839)..(839): Xaa at position 839 is Val, Ala, Gly, Leu, or Ile
  SITE (840)..(840): Xaa at position 840 is Val, Ala, Gly, Leu, or Ile
  SITE (845)..(845): Xaa at position 845 is Val, Ala, Gly, Leu, or Ile
  SITE (847)..(847): Xaa at position 847 is Ile, Ala, Val, Leu, or Gly
  SITE (849)..(849): Xaa at position 849 is Ala, Gly, or Pro
  SITE (851)..(851): Xaa at position 851 is Leu, Ala, Val, Gly, or Ile
  SITE (860)..(860): Xaa at position 860 is Leu, Ala, Val, Gly, or Ile
  SITE (862)..(862): Xaa at position 862 is Val, Ala, Gly, Leu, or Ile
  SITE (864)..(864): Xaa at position 864 is Val, Ala, Gly, Leu, or Ile
  SITE (866)..(866): Xaa at position 866 is Leu, Ala, Val, Gly, or Ile
  SITE (871)..(871): Xaa at position 871 is Ala, Gly, or Pro
  SITE (873)..(873): Xaa at position 873 is Cys, Ala, Val, Gly, Ser, or Thr
  SITE (876)..(876): Xaa at position 876 is Ala, Gly, or Pro
  SITE (888)..(888): Xaa at position 888 is Ile, Ala, Val, Leu, or Gly
  SITE (896)..(896): Xaa at position 896 is Val, Ala, Gly, Leu, or Ile
  SITE (898)..(898): Xaa at position 898 is Tyr, Phe, Met, His, Ile, Leu, Val Ala, or Gly
  SITE (899)..(899): Xaa at position 899 is Val, Ala, Gly, Leu, or Ile
  SITE (900)..(900): Xaa at position 900 is Ile, Ala, Val, Leu, or Gly
  SITE (901)..(901): Xaa at position 901 is Val, Ala, Gly, Leu, or Ile
  SITE (910)..(910): Xaa at position 910 is Val, Ala, Gly, Leu, or Ile
  SITE (912)..(912): Xaa at position 912 is Val, Ala, Gly, Leu, or Ile
  SITE (914)..(914): Xaa at position 914 is Ala, Gly, or Pro
  SITE (915)..(915): Xaa at position 915 is Ala, Gly, or Pro
  SITE (916)..(916): Xaa at position 916 is Val, Ala, Gly, Leu, or Ile
  SITE (925)..(925): Xaa at position 925 is Val, Ala, Gly, Leu, or Ile
  SITE (929)..(929): Xaa at position 929 is Leu, Ala, Val, Gly, or Ile
  SITE (931)..(931): Xaa at position 931 is Val, Ala, Gly, Leu, or Ile
  SITE (947)..(947): Xaa at position 947 is Leu, Ala, Val, Gly, or Ile
  SITE (962)..(962): Xaa at position 962 is Ile, Ala, Val, Leu, or Gly
  SITE (971)..(971): Xaa at position 971 is Val, Ala, Gly, Leu, or Ile
  SITE (980)..(980): Xaa at position 980 is Ile, Ala, Val, Leu, or Gly
  SITE (982)..(982): Xaa at position 982 is Leu, Ala, Val, Gly, or Ile
  SITE (987)..(987): Xaa at position 987 is Val, Ala, Gly, Leu, or Ile
  SITE (990)..(990): Xaa at position 990 is Met, Ile, Leu, Val, Ala, or Gly
  SITE (994)..(994): Xaa at position 994 is Ala, Gly, or Pro
  SITE (995)..(995): Xaa at position 995 is Val, Ala, Gly, Leu, or Ile
  SITE (997)..(997): Xaa at position 997 is Ala, Gly, or Pro
  SITE (1000)..(1000): Xaa at position 1000 is Leu, Ala, Val, Gly, or Ile
  SITE (1003)..(1003): Xaa at position 1003 is Leu, Ala, Val, Gly, or Ile
  SITE (1010)..(1010): Xaa at position 1010 is Cys, Ala, Val, Gly, Ser, or Thr
  SITE (1015)..(1015): Xaa at position 1015 is Met, Ile, Leu, Val, Ala, or Gly
  SITE (1016)..(1016): Xaa at position 1016 is Ile, Ala, Val, Leu, or Gly
  SITE (1018)..(1018): Xaa at position 1018 is Met, Ile, Leu, Val, Ala, or Gly
  SITE (1022)..(1022): Xaa at position 1022 is Val, Ala, Gly, Leu, or Ile
  SITE (1023)..(1023): Xaa at position 1023 is Ile, Ala, Val, Leu, or Gly
  SITE (1024)..(1024): Xaa at position 1024 is Ala, Gly, or Pro
  SITE (1025)..(1025): Xaa at position 1025 is Val, Ala, Gly, Leu, or Ile
  SITE (1027)..(1027): Xaa at position 1027 is Tyr, Phe, Met, His, Ile, Leu Val, Ala, or Gly
  SITE (1028)..(1028): Xaa at position 1028 is Leu, Ala, Val, Gly, or Ile
  SITE (1045)..(1045): Xaa at position 1045 is Ala, Gly, or Pro
  SITE (1049)..(1049): Xaa at position 1049 is Ile, Ala, Val, Leu, or Gly
  SITE (1057)..(1057): Xaa at position 1057 is Leu, Ala, Val, Gly, or Ile
  SITE (1058)..(1058): Xaa at position 1058 is Ala, Gly, or Pro
  SITE (1059)..(1059): Xaa at position 1059 is Phe, Tyr, Met, His, Ile, Leu Val, Ala, or Gly
  SITE (1065)..(1065): Xaa at position 1065 is Ala, Gly, or Pro
  SITE (1066)..(1066): Xaa at position 1066 is Phe, Tyr, Met, His, Ile, Leu Val, Ala, or Gly
  SITE (1067)..(1067): Xaa at position 1067 is Ala, Gly, or Pro
  SITE (1068)..(1068): Xaa at position 1068 is Ala, Gly, or Pro
  SITE (1069)..(1069): Xaa at position 1069 is Phe, Tyr, Met, His, Ile, Leu Val, Ala, or Gly
  SITE (1073)..(1073): Xaa at position 1073 is Ala, Gly, or Pro
  SITE (1078)..(1078): Xaa at position 1078 is Leu, Ala, Val, Gly, or Ile
  SITE (1080)..(1080): Xaa at position 1080 is Ala, Gly, or Pro
  SITE (1081)..(1081): Xaa at position 1081 is Tyr, Phe, Met, His, Ile, Leu Val, Ala, or Gly
  SITE (1082)..(1082): Xaa at position 1082 is Val, Ala, Gly, Leu, or Ile
  SITE (1083)..(1083): Xaa at position 1083 is Val, Ala, Gly, Leu, or Ile
  SITE (1085)..(1085): Xaa at position 1085 is Val, Ala, Gly, Leu, or Ile
  SITE (1086)..(1086): Xaa at position 1086 is Phe, Tyr, Met, His, Ile, Leu Val, Ala, or Gly
  SITE (1088)..(1088): Xaa at position 1088 is Leu, Ala, Val, Gly, or Ile
  SITE (1089)..(1089): Xaa at position 1089 is Ala, Gly, or Pro
  SITE (1090)..(1090): Xaa at position 1090 is Val, Ala, Gly, Leu, or Ile
  SITE (1100)..(1100): Xaa at position 1100 is Leu, Ala, Val, Gly, or Ile
  SITE (1101)..(1101): Xaa at position 1101 is Cys, Ala, Val, Gly, Ser, or Thr
  SITE (1103)..(1103): Xaa at position 1103 is Ala, Gly, or Pro
  SITE (1104)..(1104): Xaa at position 1104 is Val, Ala, Gly, Leu, or Ile
  SITE (1107)..(1107): Xaa at position 1107 is Leu, Ala, Val, Gly, or Ile
  SITE (1117)..(1117): Xaa at position 1117 is Val, Ala, Gly, Leu, or Ile
  SITE (1118)..(1118): Xaa at position 1118 is Phe, Tyr, Met, His, Ile, Leu Val, Ala, or Gly
  SITE (1124)..(1124): Xaa at position 1124 is Val, Ala, Gly, Leu, or Ile
  SITE (1126)..(1126): Xaa at position 1126 is His, Phe, Tyr, Lys, Arg, Gly Ser, Thr, Ala, Val, Leu, Ile, Asn, Met, or Gln
  SITE (1129)..(1129): Xaa at position 1129 is Met, Ile, Leu, Val, Ala, or Gly
  SITE (1141)..(1141): Xaa at position 1141 is Met, Ile, Leu, Val, Ala, or Gly
  SITE (1142)..(1142): Xaa at position 1142 is Ala, Gly, or Pro
  SITE (1145)..(1145): Xaa at position 1145 is Ala, Gly, or Pro
  SITE (1146)..(1146): Xaa at position 1146 is Phe, Tyr, Met, His, Ile, Leu Val, Ala, or Gly
  SITE (1147)..(1147): Xaa at position 1147 is Val, Ala, Gly, Leu, or Ile
  SITE (1148)..(1148): Xaa at position 1148 is Leu, Ala, Val, Gly, or Ile
  SITE (1149)..(1149): Xaa at position 1149 is Ile, Ala, Val, Leu, or Gly
  SITE (1151)..(1151): Xaa at position 1151 is Leu, Ala, Val, Gly, or Ile
  SITE (1154)..(1154): Xaa at position 1154 is Ala, Gly, or Pro
  SITE (1158)..(1158): Xaa at position 1158 is Cys, Ala, Val, Gly, Ser, or Thr
  SITE (1162)..(1162): Xaa at position 1162 is Val, Ala, Gly, Leu, or Ile
  SITE (1165)..(1165): Xaa at position 1165 is Leu, Ala, Val, Gly, or Ile
  SITE (1172)..(1172): Xaa at position 1172 is Ala, Gly, or Pro
  SITE (1176)..(1176): Xaa at position 1176 is Leu, Ala, Val, Gly, or Ile
  SITE (1180)..(1180): Xaa at position 1180 is Tyr, Phe, Met, His, Ile, Leu Val, Ala, or Gly
  SITE (1183)..(1183): Xaa at position 1183 is Leu, Ala, Val, Gly, or Ile
  SITE (1187)..(1187): Xaa at position 1187 is Tyr, Phe, Met, His, Ile, Leu Val, Ala, or Gly
  SITE (1189)..(1189): Xaa at position 1189 is Val, Ala, Gly, Leu, or Ile
  SITE (1190)..(1190): Xaa at position 1190 is Ala, Gly, or Pro
  SITE (1191)..(1191): Xaa at position 1191 is Ile, Ala, Val, Leu, or Gly
  SITE (1192)..(1192): Xaa at position 1192 is Ala, Gly, or Pro
  SITE (1195)..(1195): Xaa at position 1195 is Ala, Gly, or Pro
  SITE (1196)..(1196): Xaa at position 1196 is Leu, Ala, Val, Gly, or Ile
  SITE (1197)..(1197): Xaa at position 1197 is Ala, Gly, or Pro
  SITE (1202)..(1202): Xaa at position 1202 is Leu, Ala, Val, Gly, or Ile
  SITE (1210)..(1210): Xaa at position 1210 is Phe, Tyr, Met, His, Ile, Leu Val, Ala, or Gly
  SITE (1220)..(1220): Xaa at position 1220 is Trp, Tyr, Phe, Met, His, Ile Leu, Val, Ala, or Gly
  SITE (1227)..(1227): Xaa at position 1227 is Leu, Ala, Val, Gly, or Ile
  SITE (1228)..(1228): Xaa at position 1228 is Tyr, Phe, Met, His, Ile, Leu Val, Ala, or Gly
  SITE (1230)..(1230): Xaa at position 1230 is Val, Ala, Gly, Leu, or Ile
  SITE (1232)..(1232): Xaa at position 1232 is Ala, Gly, or Pro
  SITE (1235)..(1235): Xaa at position 1235 is Tyr, Phe, Met, His, Ile, Leu Val, Ala, or Gly
  SITE (1236)..(1236): Xaa at position 1236 is Ala, Gly, or Pro
  SITE (1237)..(1237): Xaa at position 1237 is Leu, Ala, Val, Gly, or Ile
  SITE (1238)..(1238): Xaa at position 1238 is Leu, Ala, Val, Gly, or Ile
  SITE (1239)..(1239): Xaa at position 1239 is Ala, Gly, or Pro
  SITE (1240)..(1240): Xaa at position 1240 is Leu, Ala, Val, Gly, or Ile
  SITE (1241)..(1241): Xaa at position 1241 is Leu, Ala, Val, Gly, or Ile
  SITE (1249)..(1249): Xaa at position 1249 is Val, Ala, Gly, Leu, or Ile
  SITE (1252)..(1252): Xaa at position 1252 is Val, Ala, Gly, Leu, or Ile
  SITE (1253)..(1253): Xaa at position 1253 is Val, Ala, Gly, Leu, or Ile
  SITE (1256)..(1256): Xaa at position 1256 is Leu, Ala, Val, Gly, or Ile
  SITE (1266)..(1266): Xaa at position 1266 is Tyr, Phe, Met, His, Ile, Leu Val, Ala, or Gly
  SITE (1271)..(1271): Xaa at position 1271 is Ala, Gly, or Pro
  SITE (1273)..(1273): Xaa at position 1273 is Phe, Tyr, Met, His, Ile, Leu Val, Ala, or Gly
  SITE (1274)..(1274): Xaa at position 1274 is Met, Ile, Leu, Val, Ala, or Gly
  SITE (1275)..(1275): Xaa at position 1275 is Val, Ala, Gly, Leu, or Ile
  SITE (1276)..(1276): Xaa at position 1276 is Phe, Tyr, Met, His, Ile, Leu Val, Ala, or Gly
  SITE (1278)..(1278): Xaa at position 1278 is Ala, Gly, or Pro
  SITE (1279)..(1279): Xaa at position 1279 is Leu, Ala, Val, Gly, or Ile
  SITE (1280)..(1280): Xaa at position 1280 is Ala, Gly, or Pro
  SITE (1282)..(1282): Xaa at position 1282 is Tyr, Phe, Met, His, Ile, Leu Val, Ala, or Gly
  SITE (1292)..(1292): Xaa at position 1292 is Leu, Ala, Val, Gly, or Ile
  SITE (1294)..(1294): Xaa at position 1294 is Leu, Ala, Val, Gly, or Ile
  SITE (1296)..(1296): Xaa at position 1296 is Val, Ala, Gly, Leu, or Ile
  SITE (1298)..(1298): Xaa at position 1298 is Leu, Ala, Val, Gly, or Ile
  SITE (1311)..(1311): Xaa at position 1311 is Ile, Ala, Val, Leu, or Gly
  SITE (1330)..(1330): Xaa at position 1330 is Phe, Tyr, Met, His, Ile, Leu Val, Ala, or Gly
  SITE (1332)..(1332): Xaa at position 1332 is Val, Ala, Gly, Leu, or Ile
  SITE (1334)..(1334): Xaa at position 1334 is Ala, Gly, or Pro
  SITE (1342)..(1342): Xaa at position 1342 is Leu, Ala, Val, Gly, or Ile
  SITE (1344)..(1344): Xaa at position 1344 is Val, Ala, Gly, Leu, or Ile
  SITE (1348)..(1348): Xaa at position 1348 is Tyr, Phe, Met, His, Ile, Leu Val, Ala, or Gly
  SITE (1350)..(1350): Xaa at position 1350 is Ala, Gly, or Pro
  SITE (1361)..(1361): Xaa at position 1361 is Phe, Tyr, Met, His, Ile, Leu Val, Ala, or Gly
  SITE (1386)..(1386): Xaa at position 1386 is Leu, Ala, Val, Gly, or Ile
  SITE (1388)..(1388): Xaa at position 1388 is Ile, Ala, Val, Leu, or Gly
  SITE (1389)..(1389): Xaa at position 1389 is Cys, Ala, Val, Gly, Ser, or Thr
  SITE (1402)..(1402): Xaa at position 1402 is Ile, Ala, Val, Leu, or Gly
  SITE (1403)..(1403): Xaa at position 1403 is Leu, Ala, Val, Gly, or Ile
  SITE (1405)..(1405): Xaa at position 1405 is Ile, Ala, Val, Leu, or Gly
  SITE (1407)..(1407): Xaa at position 1407 is Met, Ile, Leu, Val, Ala, or Gly
  SITE (1408)..(1408): Xaa at position 1408 is Met, Ile, Leu, Val, Ala, or Gly
  SITE (1411)..(1411): Xaa at position 1411 is Phe, Tyr, Met, His, Ile, Leu Val, Ala, or Gly
  SITE (1412)..(1412): Xaa at position 1412 is Ala, Gly, or Pro
  SITE (1418)..(1418): Xaa at position 1418 is Leu, Ala, Val, Gly, or Ile
  SITE (1421)..(1421): Xaa at position 1421 is Leu, Ala, Val, Gly, or Ile
  SITE (1429)..(1429): Xaa at position 1429 is Ile, Ala, Val, Leu, or Gly
  SITE (1444)..(1444): Xaa at position 1444 is Leu, Ala, Val, Gly, or Ile
  SITE (1446)..(1446): Xaa at position 1446 is Ile, Ala, Val, Leu, or Gly
  SITE (1447)..(1447): Xaa at position 1447 is Tyr, Phe, Met, His, Ile, Leu Val, Ala, or Gly
  SITE (1451)..(1451): Xaa at position 1451 is Val, Ala, Gly, Leu, or Ile
  SITE (1460)..(1460): Xaa at position 1460 is Ala, Gly, or Pro
  SITE (1461)..(1461): Xaa at position 1461 is Phe, Tyr, Met, His, Ile, Leu Val, Ala, or Gly
  SITE (1463)..(1463): Xaa at position 1463 is Val, Ala, Gly, Leu, or Ile
  SITE (1471)..(1471): Xaa at position 1471 is Leu, Ala, Val, Gly, or Ile
  SITE (1476)..(1476): Xaa at position 1476 is Ala, Gly, or Pro
  SITE (1477)..(1477): Xaa at position 1477 is Val, Ala, Gly, Leu, or Ile
  SITE (1479)..(1479): Xaa at position 1479 is Val, Ala, Gly, Leu, or Ile
  SITE (1481)..(1481): Xaa at position 1481 is Ala, Gly, or Pro
  SITE (1482)..(1482): Xaa at position 1482 is Tyr, Phe, Met, His, Ile, Leu Val, Ala, or Gly
  SITE (1483)..(1483): Xaa at position 1483 is Tyr, Phe, Met, His, Ile, Leu Val, Ala, or Gly
  SITE (1489)..(1489): Xaa at position 1489 is Cys, Ala, Val, Gly, Ser, or Thr
  SITE (1493)..(1493): Xaa at position 1493 is Tyr, Phe, Met, His, Ile, Leu Val, Ala, or Gly
  SITE (1518)..(1518): Xaa at position 1518 is Cys, Ala, Val, Gly, Ser, or Thr
  SITE (1536)..(1536): Xaa at position 1536 is Ala, Gly, or Pro
  SITE (1543)..(1543): Xaa at position 1543 is Tyr, Phe, Met, His, Ile, Leu Val, Ala, or Gly
  SITE (1544)..(1544): Xaa at position 1544 is Val, Ala, Gly, Leu, or Ile
  SITE (1545)..(1545): Xaa at position 1545 is Tyr, Phe, Met, His, Ile, Leu Val, Ala, or Gly
  SITE (1549)..(1549): Xaa at position 1549 is Leu, Ala, Val, Gly, or Ile
  SITE (1558)..(1558): Xaa at position 1558 is Phe, Tyr, Met, His, Ile, Leu Val, Ala, or Gly
  SITE (1561)..(1561): Xaa at position 1561 is Tyr, Phe, Met, His, Ile, Leu Val, Ala, or Gly
  SITE (1563)..(1563): Xaa at position 1563 is Met, Ile, Leu, Val, Ala, or Gly
  SITE (1565)..(1565): Xaa at position 1565 is Ile, Ala, Val, Leu, or Gly
  SITE (1584)..(1584): Xaa at position 1584 is Phe, Tyr, Met, His, Ile, Leu Val, Ala, or Gly
  SITE (1590)..(1590): Xaa at position 1590 is Cys, Ala, Val, Gly, Ser, or Thr
  SITE (1602)..(1602): Xaa at position 1602 is Tyr, Phe, Met, His, Ile, Leu Val, Ala, or Gly
  SITE (1603)..(1603): Xaa at position 1603 is Leu, Ala, Val, Gly, or Ile
  SITE (1604)..(1604): Xaa at position 1604 is Met, Ile, Leu, Val, Ala, or Gly
  SITE (1605)..(1605): Xaa at position 1605 is Trp, Tyr, Phe, Met, His, Ile Leu, Val, Ala, or Gly
  SITE (1620)..(1620): Xaa at position 1620 is Tyr, Phe, Met, His, Ile, Leu Val, Ala, or Gly
  SITE (1649)..(1649): Xaa at position 1649 is Leu, Ala, Val, Gly, or Ile
  SITE (1652)..(1652): Xaa at position 1652 is Phe, Tyr, Met, His, Ile, Leu Val, Ala, or Gly
MGPTSGPSLLLLLLTHLPLALGSPXYSXXTPNIXRLESEETXVXEXXDAQGDVPXTXTXHDFPGKKLVLSSEKTVXTPATNHMGNXTXTXPANREFKSEKGRNKFXTXQXTXGTQVXEKVXXXSLQSGXLFIQTDKTXXTPGSTXLXRXXTXNHKLLPVGRTXMXNXENPEGIPVKQDSLSSQNQLGXXPLSWDIPELVNMGQXKXRXYXENSPQQVFSTEXEXKEYVLPSXEVIVEPTEKFXYXYNEKGXEXTXTXRFLYGKKXEGTXFXIXGXQDGEQRISXPESLKRIPXEDGSGEXVXSRKVLLDGVQNPRAEDXVGKSXYXSXTXILHSGSDMVQAERSGXPXVTSPYQXHFTKTPKYXKPGXPXDXMXFXTNPDGSPXYRXPXAVQGEDTVQSXTQGDGVXKXSINTHPSQKPLSXTXRTKKQELSEAEQATRTMQXLPXSTVGNSNNXXHLSVLRTEXRPGETLNXNXLLRMDRAHEAKXRYXTYXXMNKGRLLKAGRQVREPGQDLVVLPLSXTTDFXPSXRXXXXXTXIGASGQREXXXDSVWVDXKDSCVGSLVVKSGQSEDRQPVPGQQMTLKXEGDHGXRXVLXXVDKGXFVLNKKNKLTQSKXXDVXEKADIGCTPGSGKDYAGXXSDXGXTXTSSSGQQTAQRAELQCPQPAARRRRSVQLTEKRMDKVGKYPKELRKXXEDGXRENPXRFSCQRRTRFISLGEACKKXXLDXXNYXTELRRQHARASHLGLARSNLDEDIIAEENIVSRSEFPESWLWNVEDLKEPPKNGISTKLMNIFLKDSITTXEILXVSMSDKKGICVADPFEVTXMQDXFIDXRLPYSXXRNEQXEXRXVXYNYRQNQEXKXRXEXLHNPXFXSLXTTKRRHQQTVTXPPKSSLSXPXXXXPLKTGLQEXEXKXXXYHHFISDGXRKSXKXVPEGIRMNKTVAVRTXDPERLGREGVQKEDXPPADLSDQXPDTESETRXLXQGTPXAQXTEDXXDXERXKHXIVTPSGXGEQNXXGXTPTXXXXHXXDETEQWEKFGLEKRQGXLELXKKGYTQQXXXRQPSSXXXXXVKRXPSTWXTXXXXKXXSXXXNLIAIDSQVXXGXXKWXILEKQKPDGXXQEDAPXIXQEXIGGLRNNNEKDXXLTXXXXXSXQEXKDIXEEQXNSXPGSITKXGDFXEANXMNXQRSXTXXXXGYXXXQMGRXKGPLLNKXLTTAKDKNRXEDPGKQXXNXEXTSXXXXXXXQLKDFDFXPPXXRWXNEQRYYGGGXGSTQXTXXXXQXXXQXQKDAPDHQEXNXDXSXQLPSRSSKITHRXHWESASLLRSEETKENEGXTXTXEGKGQGTXSXVTMXHXKAKDQLTCNKXDLKVTIKPAPETEKRPQDAKNTMIXEXXTRYRGDQDATMSXXDXSXXTGXXPDTDDXKQXANGVDRYXSKYELDKAFSDRNTXIXXLDKXSHSEDDCLXXKXHQYFNVEXIQPGXXKXYXXXNLEESXTRFXHPEKEDGKLNKLCRDELCRCAEENXFIQKSDDKVTLEERLDKXCEPGVDXXXKTRXVKVQLSNDXDEXIXAXEQTIKSGSDEVQVGQQRTXISPIKXREALKLEEKKHXXXXGLSSDFWGEKPNLSXIIGKDTWVEHWPEEDECQDEENQKQCQDXGAXTESMVVFGCPN

SEQ ID NO: 111 - protein, 1676 aa, Homo sapiens
  SITE (24)..(24): Xaa at position 24 is Val, Ala, Gly, Leu, or Ile
  SITE (25)..(25): Xaa at position 25 is Ile, Ala, Val, Leu, or Gly
  SITE (27)..(27): Xaa at position 27 is Ala, Gly, or Pro
  SITE (31)..(31): Xaa at position 31 is Phe, Tyr, Met, His, Ile, Leu, Val Ala, or Gly
  SITE (33)..(33): Xaa at position 33 is Val, Ala, Gly, Leu, or Ile
  SITE (35)..(35): Xaa at position 35 is Ala, Gly, or Pro
  SITE (39)..(39): Xaa at position 39 is Ile, Ala, Val, Leu, or Gly
  SITE (40)..(40): Xaa at position 40 is Val, Ala, Gly, Leu, or Ile
  SITE (41)..(41): Xaa at position 41 is Ile, Ala, Val, Leu, or Gly
  SITE (50)..(50): Xaa at position 50 is Phe, Tyr, Met, His, Ile, Leu, Val Ala, or Gly
  SITE (52)..(52): Xaa at position 52 is Ala, Gly, or Pro
  SITE (54)..(54): Xaa at position 54 is Ile, Ala, Val, Leu, or Gly
  SITE (56)..(56): Xaa at position 56 is Ile, Ala, Val, Leu, or Gly
  SITE (71)..(71): Xaa at position 71 is Val, Ala, Gly, Leu, or Ile
  SITE (73)..(73): Xaa at position 73 is Leu, Ala, Val, Gly, or Ile
  SITE (85)..(85): Xaa at position 85 is Leu, Ala, Val, Gly, or Ile
  SITE (87)..(87): Xaa at position 87 is Ile, Ala, Val, Leu, or Gly
  SITE (102)..(102): Xaa at position 102 is Val, Ala, Gly, Leu, or Ile
  SITE (106)..(106): Xaa at position 106 is Val, Ala, Gly, Leu, or Ile
  SITE (117)..(117): Xaa at position 117 is Met, Ile, Leu, Val, Ala, or Gly
  SITE (126)..(126): Xaa at position 126 is Leu, Ala, Val, Gly, or Ile
  SITE (135)..(135): Xaa at position 135 is Tyr, Phe, Met, His, Ile, Leu, Val Ala, or Gly
  SITE (141)..(141): Xaa at position 141 is Val, Ala, Gly, Leu, or Ile
  SITE (143)..(143): Xaa at position 143 is Val, Ala, Gly, Leu, or Ile
  SITE (145)..(145): Xaa at position 145 is Val, Ala, Gly, Leu, or Ile
  SITE (146)..(146): Xaa at position 146 is Tyr, Phe, Met, His, Ile, Leu, Val Ala, or Gly
  SITE (148)..(148): Xaa at position 148 is Leu, Ala, Val, Gly, or Ile
  SITE (161)..(161): Xaa at position 161 is Leu, Ala, Val, Gly, or Ile
  SITE (163)..(163): Xaa at position 163 is Phe, Tyr, Met, His, Ile, Leu, Val Ala, or Gly
  SITE (183)..(183): Xaa at position 183 is Ile, Ala, Val, Leu, or Gly
  SITE (190)..(190): Xaa at position 190 is Ile, Ala, Val, Leu, or Gly
  SITE (199)..(199): Xaa at position 199 is Trp, Tyr, Phe, Met, His, Ile, Leu Val, Ala, or Gly
  SITE (201)..(201): Xaa at position 201 is Ile, Ala, Val, Leu, or Gly
  SITE (203)..(203): Xaa at position 203 is Ala, Gly, or Pro
  SITE (205)..(205): Xaa at position 205 is Tyr, Phe, Met, His, Ile, Leu, Val Ala, or Gly
  SITE (217)..(217): Xaa at position 217 is Phe, Tyr, Met, His, Ile, Leu, Val Ala, or Gly
  SITE (219)..(219): Xaa at position 219 is Val, Ala, Gly, Leu, or Ile
  SITE (238)..(238): Xaa at position 238 is Ile, Ala, Val, Leu, or Gly
  SITE (246)..(246): Xaa at position 246 is Phe, Tyr, Met, His, Ile, Leu, Val Ala, or Gly
  SITE (248)..(248): Xaa at position 248 is Ile, Ala, Val, Leu, or Gly
  SITE (250)..(250): Xaa at position 250 is Ile, Ala, Val, Leu, or Gly
  SITE (252)..(252): Xaa at position 252 is Ala, Gly, or Pro
  SITE (260)..(260): Xaa at position 260 is Val, Ala, Gly, Leu, or Ile
  SITE (263)..(263): Xaa at position 263 is Ala, Gly, or Pro
  SITE (265)..(265): Xaa at position 265 is Val, Ala, Gly, Leu, or Ile
  SITE (267)..(267): Xaa at position 267 is Ile, Ala, Val, Leu, or Gly
  SITE (269)..(269): Xaa at position 269 is Phe, Tyr, Met, His, Ile, Leu, Val Ala, or Gly
  SITE (271)..(271): Xaa at position 271 is Ile, Ala, Val, Leu, or Gly
  SITE (283)..(283): Xaa at position 283 is Met, Ile, Leu, Val, Ala, or Gly
  SITE (292)..(292): Xaa at position 292 is Leu, Ala, Val, Gly, or Ile
  SITE (301)..(301): Xaa at position 301 is Phe, Tyr, Met, His, Ile, Leu, Val Ala, or Gly
  SITE (307)..(307): Xaa at position 307 is Val, Ala, Gly, Leu, or Ile
  SITE (310)..(310): Xaa at position 310 is Leu, Ala, Val, Gly, or Ile
  SITE (323)..(323): Xaa at position 323 is Leu, Ala, Val, Gly, or Ile
  SITE (325)..(325): Xaa at position 325 is Ile, Ala, Val, Leu, or Gly
  SITE (327)..(327): Xaa at position 327 is Val, Ala, Gly, Leu, or Ile
  SITE (329)..(329): Xaa at position 329 is Val, Ala, Gly, Leu, or Ile
  SITE (347)..(347): Xaa at position 347 is Tyr, Phe, Met, His, Ile, Leu, Val Ala, or Gly
  SITE (363)..(363): Xaa at position 363 is Leu, Ala, Val, Gly, or Ile
  SITE (371)..(371): Xaa at position 371 is Ile, Ala, Val, Leu, or Gly
  SITE (373)..(373): Xaa at position 373 is Val, Ala, Gly, Leu, or Ile
  SITE (375)..(375): Xaa at position 375 is Val, Ala, Gly, Leu, or Ile
  SITE (388)..(388): Xaa at position 388 is Val, Ala, Gly, Leu, or Ile
  SITE (390)..(390): Xaa at position 390 is Leu, Ala, Val, Gly, or Ile
  SITE (418)..(418): Xaa at position 418 is Ala, Gly, or Pro
  SITE (428)..(428): Xaa at position 428 is Val, Ala, Gly, Leu, or Ile
  SITE (431)..(431): Xaa at position 431 is Leu, Ala, Val, Gly, or Ile
  SITE (433)..(433): Xaa at position 433 is Phe, Tyr, Met, His, Ile, Leu, Val Ala, or Gly
  SITE (435)..(435): Xaa at position 435 is Val, Ala, Gly, Leu, or Ile
  SITE (448)..(448): Xaa at position 448 is Ala, Gly, or Pro
  SITE (454)..(454): Xaa at position 454 is Ala, Gly, or Pro
  SITE (457)..(457): Xaa at position 457 is Tyr, Phe, Met, His, Ile, Leu, Val Ala, or Gly
  SITE (465)..(465): Xaa at position 465 is Leu, Ala, Val, Gly, or Ile
  SITE (484)..(484): Xaa at position 484 is Ile, Ala, Val, Leu, or Gly
  SITE (486)..(486): Xaa at position 486 is Val, Ala, Gly, Leu, or Ile
  SITE (499)..(499): Xaa at position 499 is Tyr, Phe, Met, His, Ile, Leu, Val Ala, or Gly
  SITE (502)..(502): Xaa at position 502 is Leu, Ala, Val, Gly, or Ile
  SITE (503)..(503): Xaa at position 503 is Ile, Ala, Val, Leu, or Gly
  SITE (526)..(526): Xaa at position 526 is Ile, Ala, Val, Leu, or Gly
  SITE (534)..(534): Xaa at position 534 is Met, Ile, Leu, Val, Ala, or Gly
  SITE (540)..(540): Xaa at position 540 is Leu, Ala, Val, Gly, or Ile
  SITE (541)..(541): Xaa at position 541 is Leu, Ala, Val, Gly, or Ile
  SITE (542)..(542): Xaa at position 542 is Val, Ala, Gly, Leu, or Ile
  SITE (543)..(543): Xaa at position 543 is Tyr, Phe, Met, His, Ile, Leu, Val Ala, or Gly
  SITE (544)..(544): Xaa at position 544 is Tyr, Phe, Met, His, Ile, Leu, Val Ala, or Gly
  SITE (554)..(554): Xaa at position 554 is Leu, Ala, Val, Gly, or Ile
  SITE (555)..(555): Xaa at position 555 is Val, Ala, Gly, Leu, or Ile
  SITE (561)..(561): Xaa at position 561 is Leu, Ala, Val, Gly, or Ile
  SITE (563)..(563): Xaa at position 563 is Ile, Ala, Val, Leu, or Gly
  SITE (573)..(573): Xaa at position 573 is Val, Ala, Gly, Leu, or Ile
  SITE (588)..(588): Xaa at position 588 is Val, Ala, Gly, Leu, or Ile
  SITE (590)..(590): Xaa at position 590 is Leu, Ala, Val, Gly, or Ile
  SITE (592)..(592): Xaa at position 592 is Met, Ile, Leu, Val, Ala, or Gly
  SITE (600)..(600): Xaa at position 600 is Val, Ala, Gly, Leu, or Ile
  SITE (601)..(601): Xaa at position 601 is Ala, Gly, or Pro
  SITE (602)..(602): Xaa at position 602 is Leu, Ala, Val, Gly, or Ile
  SITE (603)..(603): Xaa at position 603 is Ala, Gly, or Pro
  SITE (604)..(604): Xaa at position 604 is Ala, Gly, or Pro
  SITE (605)..(605): Xaa at position 605 is Val, Ala, Gly, Leu, or Ile
  SITE (608)..(608): Xaa at position 608 is Ala, Gly, or Pro
  SITE (609)..(609): Xaa at position 609 is Val, Ala, Gly, Leu, or Ile
  SITE (620)..(620): Xaa at position 620 is Leu, Ala, Val, Gly, or Ile
  SITE (643)..(643): Xaa at position 643 is Ala, Gly, or Pro
  SITE (645)..(645): Xaa at position 645 is Val, Ala, Gly, Leu, or Ile
  SITE (646)..(646): Xaa at position 646 is Phe, Tyr, Met, His, Ile, Leu, Val Ala, or Gly
  SITE (649)..(649): Xaa at position 649 is Ala, Gly, or Pro
  SITE (651)..(651): Xaa at position 651 is Leu, Ala, Val, Gly, or Ile
  SITE (653)..(653): Xaa at position 653 is Phe, Tyr, Met, His, Ile, Leu, Val Ala, or Gly
  SITE (683)..(683): Xaa at position 683 is Ile, Ala, Val, Leu, or Gly
  SITE (687)..(687): Xaa at position 687 is Ala, Gly, or Pro
  SITE (695)..(695): Xaa at position 695 is Val, Ala, Gly, Leu, or Ile
  SITE (698)..(698): Xaa at position 698 is Cys, Ala, Val, Gly, Ser, or Thr
  SITE (699)..(699): Xaa at position 699 is Cys, Ala, Val, Gly, Ser, or Thr
  SITE (711)..(711): Xaa at position 711 is Cys, Ala, Val, Gly, Ser, or Thr
  SITE (724)..(724): Xaa at position 724 is Cys, Ala, Val, Gly, Ser, or Thr
  SITE (725)..(725): Xaa at position 725 is Ile, Ala, Val, Leu, or Gly
  SITE (727)..(727): Xaa at position 727 is Ala, Gly, or Pro
  SITE (728)..(728): Xaa at position 728 is Phe, Tyr, Met, His, Ile, Leu, Val Ala, or Gly
  SITE (731)..(731): Xaa at position 731 is Cys, Ala, Val, Gly, Ser, or Thr
  SITE (732)..(732): Xaa at position 732 is Cys, Ala, Val, Gly, Ser, or Thr
  SITE (734)..(734): Xaa at position 734 is Val, Ala, Gly, Leu, or Ile
  SITE (735)..(735): Xaa at position 735 is Ala, Gly, or Pro
  SITE (780)..(780): Xaa at position 780 is Val, Ala, Gly, Leu, or Ile
  SITE (797)..(797): Xaa at position 797 is Trp, Tyr, Phe, Met, His, Ile, Leu Val, Ala, or Gly
  SITE (799)..(799): Xaa at position 799 is Ile, Ala, Val, Leu, or Gly
  SITE (802)..(802): Xaa at position 802 is Val, Ala, Gly, Leu, or Ile
  SITE (804)..(804): Xaa at position 804 is Ile, Ala, Val, Leu, or Gly
  SITE (810)..(810): Xaa at position 810 is Cys, Ala, Val, Gly, Ser, or Thr
  SITE (819)..(819): Xaa at position 819 is Val, Ala, Gly, Leu, or Ile
  SITE (823)..(823): Xaa at position 823 is Val, Ala, Gly, Leu, or Ile
  SITE (833)..(833): Xaa at position 833 is Val, Ala, Gly, Leu, or Ile
  SITE (839)..(839): Xaa at position 839 is Ile, Ala, Val, Leu, or Gly
  SITE (841)..(841): Xaa at position 841 is Leu, Ala, Val, Gly, or Ile
  SITE (845)..(845): Xaa at position 845 is Val, Ala, Gly, Leu, or Ile
  SITE (846)..(846): Xaa at position 846 is Tyr, Phe, Met, His, Ile, Leu, Val Ala, or Gly
  SITE (856)..(856): Xaa at position 856 is Cys, Ala, Val, Gly, Ser, or Thr
  SITE (888)..(888): Xaa at position 888 is Val, Ala, Gly, Leu, or Ile
  SITE (896)..(896): Xaa at position 896 is Val, Ala, Gly, Leu, or Ile
  SITE (900)..(900): Xaa at position 900 is Val, Ala, Gly, Leu, or Ile
  SITE (901)..(901): Xaa at position 901 is Leu, Ala, Val, Gly, or Ile
  SITE (910)..(910): Xaa at position 910 is Ile, Ala, Val, Leu, or Gly
  SITE (912)..(912): Xaa at position 912 is Phe, Tyr, Met, His, Ile, Leu, Val Ala, or Gly
  SITE (914)..(914): Xaa at position 914 is Leu, Ala, Val, Gly, or Ile
  SITE (927)..(927): Xaa at position 927 is Leu, Ala, Val, Gly, or Ile
  SITE (944)..(944): Xaa at position 944 is Leu, Ala, Val, Gly, or Ile
  SITE (968)..(968): Xaa at position 968 is Val, Ala, Gly, Leu, or Ile
  SITE (977)..(977): Xaa at position 977 is Leu, Ala, Val, Gly, or Ile
  SITE (979)..(979): Xaa at position 979 is Val, Ala, Gly, Leu, or Ile
  SITE (984)..(984): Xaa at position 984 is Val, Ala, Gly, Leu, or Ile
  SITE (987)..(987): Xaa at position 987 is Ile, Ala, Val, Leu, or Gly
  SITE (988)..(988): Xaa at position 988 is Leu, Ala, Val, Gly, or Ile
  SITE (1008)..(1008): Xaa at position 1008 is Ala, Gly, or Pro
  SITE (1010)..(1010): Xaa at position 1010 is Ala, Gly, or Pro
  SITE (1012)..(1012): Xaa at position 1012 is Leu, Ala, Val, Gly, or Ile
  SITE (1015)..(1015): Xaa at position 1015 is Val, Ala, Gly, Leu, or Ile
  SITE (1019)..(1019): Xaa at position 1019 is Phe, Tyr, Met, His, Ile, Leu Val, Ala, or Gly
  SITE (1020)..(1020): Xaa at position 1020 is Tyr, Phe, Met, His, Ile, Leu Val, Ala, or Gly
  SITE (1021)..(1021): Xaa at position 1021 is Val, Ala, Gly, Leu, or Ile
  SITE (1024)..(1024): Xaa at position 1024 is Tyr, Phe, Met, His, Ile, Leu Val, Ala, or Gly
  SITE (1025)..(1025): Xaa at position 1025 is Leu, Ala, Val, Gly, or Ile
  SITE (1049)..(1049): Xaa at position 1049 is Leu, Ala, Val, Gly, or Ile
  SITE (1068)..(1068): Xaa at position 1068 is Val, Ala, Gly, Leu, or Ile
  SITE (1077)..(1077): Xaa at position 1077 is Trp, Tyr, Phe, Met, His, Ile Leu, Val, Ala, or Gly
  SITE (1078)..(1078): Xaa at position 1078 is Leu, Ala, Val, Gly, or Ile
  SITE (1080)..(1080): Xaa at position 1080 is Ala, Gly, or Pro
  SITE (1081)..(1081): Xaa at position 1081 is Phe, Tyr, Met, His, Ile, Leu Val, Ala, or Gly
  SITE (1082)..(1082): Xaa at position 1082 is Ala, Gly, or Pro
  SITE (1083)..(1083): Xaa at position 1083 is Leu, Ala, Val, Gly, or Ile
  SITE (1089)..(1089): Xaa at position 1089 is Val, Ala, Gly, Leu, or Ile
  SITE (1104)..(1104): Xaa at position 1104 is Leu, Ala, Val, Gly, or Ile
  SITE (1107)..(1107): Xaa at position 1107 is Leu, Ala, Val, Gly, or Ile
  SITE (1127)..(1127): Xaa at position 1127 is Ile, Ala, Val, Leu, or Gly
  SITE (1142)..(1142): Xaa at position 1142 is Leu, Ala, Val, Gly, or Ile
  SITE (1143)..(1143): Xaa at position 1143 is Tyr, Phe, Met, His, Ile, Leu Val, Ala, or Gly
  SITE (1146)..(1146): Xaa at position 1146 is Ala, Gly, or Pro
  SITE (1147)..(1147): Xaa at position 1147 is Phe, Tyr, Met, His, Ile, Leu Val, Ala, or Gly
  SITE (1149)..(1149): Xaa at position 1149 is Val, Ala, Gly, Leu, or Ile
  SITE (1150)..(1150): Xaa at position 1150 is Ile, Ala, Val, Leu, or Gly
  SITE (1152)..(1152): Xaa at position 1152 is Ile, Ala, Val, Leu, or Gly
  SITE (1155)..(1155): Xaa at position 1155 is Ala, Gly, or Pro
  SITE (1159)..(1159): Xaa at position 1159 is Cys, Ala, Val, Gly, Ser, or Thr
  SITE (1164)..(1164): Xaa at position 1164 is Ile, Ala, Val, Leu, or Gly
  SITE (1167)..(1167): Xaa at position 1167 is Ala, Gly, or Pro
  SITE (1168)..(1168): Xaa at position 1168 is Leu, Ala, Val, Gly, or Ile
  SITE (1171)..(1171): Xaa at position 1171 is Ala, Gly, or Pro
  SITE (1175)..(1175): Xaa at position 1175 is Leu, Ala, Val, Gly, or Ile
  SITE (1186)..(1186): Xaa at position 1186 is Phe, Tyr, Met, His, Ile, Leu Val, Ala, or Gly
  SITE (1188)..(1188): Xaa at position 1188 is Leu, Ala, Val, Gly, or Ile
  SITE (1189)..(1189): Xaa at position 1189 is Ala, Gly, or Pro
  SITE (1190)..(1190): Xaa at position 1190 is Ile, Ala, Val, Leu, or Gly
  SITE (1192)..(1192): Xaa at position 1192 is Ala, Gly, or Pro
  SITE (1193)..(1193): Xaa at position 1193 is Tyr, Phe, Met, His, Ile, Leu Val, Ala, or Gly
  SITE (1194)..(1194): Xaa at position 1194 is Ala, Gly, or Pro
  SITE (1205)..(1205): Xaa at position 1205 is Phe, Tyr, Met, His, Ile, Leu Val, Ala, or Gly
  SITE (1208)..(1208): Xaa at position 1208 is Ile, Ala, Val, Leu, or Gly
  SITE (1227)..(1227): Xaa at position 1227 is Phe, Tyr, Met, His, Ile, Leu Val, Ala, or Gly
  SITE (1228)..(1228): Xaa at position 1228 is Trp, Tyr, Phe, Met, His, Ile Leu, Val, Ala, or Gly
  SITE (1245)..(1245): Xaa at position 1245 is Ala, Gly, or Pro
  SITE (1248)..(1248): Xaa at position 1248 is Val, Ala, Gly, Leu, or Ile
  SITE (1252)..(1252): Xaa at position 1252 is Ala, Gly, or Pro
  SITE (1253)..(1253): Xaa at position 1253 is Tyr, Phe, Met, His, Ile, Leu Val, Ala, or Gly
  SITE (1254)..(1254): Xaa at position 1254 is Ala, Gly, or Pro
  SITE (1255)..(1255): Xaa at position 1255 is Leu, Ala, Val, Gly, or Ile
  SITE (1256)..(1256): Xaa at position 1256 is Leu, Ala, Val, Gly, or Ile
  SITE (1259)..(1259): Xaa at position 1259 is Leu, Ala, Val, Gly, or Ile
  SITE (1267)..(1267): Xaa at position 1267 is Val, Ala, Gly, Leu, or Ile
  SITE (1270)..(1270): Xaa at position 1270 is Val, Ala, Gly, Leu, or Ile
  SITE (1271)..(1271): Xaa at position 1271 is Ile, Ala, Val, Leu, or Gly
  SITE (1273)..(1273): Xaa at position 1273 is Trp, Tyr, Phe, Met, His, Ile Leu, Val, Ala, or Gly
  SITE (1274)..(1274): Xaa at position 1274 is Leu, Ala, Val, Gly, or Ile
  SITE (1284)..(1284): Xaa at position 1284 is Phe, Tyr, Met, His, Ile, Leu Val, Ala, or Gly
  SITE (1291)..(1291): Xaa at position 1291 is Ile, Ala, Val, Leu, or Gly
  SITE (1293)..(1293): Xaa at position 1293 is Ala, Gly, or Pro
  SITE (1294)..(1294): Xaa at position 1294 is Ile, Ala, Val, Leu, or Gly
  SITE (1297)..(1297): Xaa at position 1297 is Leu, Ala, Val, Gly, or Ile
  SITE (1303)..(1303): Xaa at position 1303 is Leu, Ala, Val, Gly, or Ile
  SITE (1309)..(1309): Xaa at position 1309 is Leu, Ala, Val, Gly, or Ile
  SITE (1311)..(1311): Xaa at position 1311 is Met, Ile, Leu, Val, Ala, or Gly
  SITE (1313)..(1313): Xaa at position 1313 is Ile, Ala, Val, Leu, or Gly
  SITE (1315)..(1315): Xaa at position 1315 is Val, Ala, Gly, Leu, or Ile
  SITE (1328)..(1328): Xaa at position 1328 is Met, Ile, Leu, Val, Ala, or Gly
  SITE (1333)..(1333): Xaa at position 1333 is Phe, Tyr, Met, His, Ile, Leu Val, Ala, or Gly
  SITE (1340)..(1340): Xaa at position 1340 is Val, Ala, Gly, Leu, or Ile
  SITE (1346)..(1346): Xaa at position 1346 is Leu, Ala, Val, Gly, or Ile
  SITE (1348)..(1348): Xaa at position 1348 is Val, Ala, Gly, Leu, or Ile
  SITE (1357)..(1357): Xaa at position 1357 is Ala, Gly, or Pro
  SITE (1359)..(1359): Xaa at position 1359 is Val, Ala, Gly, Leu, or Ile
  SITE (1361)..(1361): Xaa at position 1361 is Val, Ala, Gly, Leu, or Ile
  SITE (1365)..(1365): Xaa at position 1365 is Val, Ala, Gly, Leu, or Ile
  SITE (1402)..(1402): Xaa at position 1402 is Ile, Ala, Val, Leu, or Gly
  SITE (1404)..(1404): Xaa at position 1404 is Ala, Gly, or Pro
  SITE (1406)..(1406): Xaa at position 1406 is Ala, Gly, or Pro
  SITE (1408)..(1408): Xaa at position 1408 is Tyr, Phe, Met, His, Ile, Leu Val, Ala, or Gly
  SITE (1421)..(1421): Xaa at position 1421 is His, Phe, Tyr, Lys, Arg, Gly Ser, Thr, Ala, Val, Leu, Ile, Asn, Met, or Gln
  SITE (1422)..(1422): Xaa at position 1422 is Ala, Gly, or Pro
  SITE (1423)..(1423): Xaa at position 1423 is Val, Ala, Gly, Leu, or Ile
  SITE (1424)..(1424): Xaa at position 1424 is Met, Ile, Leu, Val, Ala, or Gly
  SITE (1426)..(1426): Xaa at position 1426 is Ile, Ala, Val, Leu, or Gly
  SITE (1439)..(1439): Xaa at position 1439 is Leu, Ala, Val, Gly, or Ile
  SITE (1442)..(1442): Xaa at position 1442 is Leu, Ala, Val, Gly, or Ile
  SITE (1450)..(1450): Xaa at position 1450 is Phe, Tyr, Met, His, Ile, Leu Val, Ala, or Gly
  SITE (1460)..(1460): Xaa at position 1460 is Val, Ala, Gly, Leu, or Ile
  SITE (1462)..(1462): Xaa at position 1462 is Leu, Ala, Val, Gly, or Ile
  SITE (1467)..(1467): Xaa at position 1467 is Ile, Ala, Val, Leu, or Gly
  SITE (1475)..(1475): Xaa at position 1475 is Val, Ala, Gly, Leu, or Ile
  SITE (1477)..(1477): Xaa at position 1477 is Phe, Tyr, Met, His, Ile, Leu Val, Ala, or Gly
  SITE (1479)..(1479): Xaa at position 1479 is Ile, Ala, Val, Leu, or Gly
  SITE (1491)..(1491): Xaa at position 1491 is Ala, Gly, or Pro
  SITE (1493)..(1493): Xaa at position 1493 is Phe, Tyr, Met, His, Ile, Leu Val, Ala, or Gly
  SITE (1495)..(1495): Xaa at position 1495 is Val, Ala, Gly, Leu, or Ile
  SITE (1498)..(1498): Xaa at position 1498 is Tyr, Phe, Met, His, Ile, Leu Val, Ala, or Gly
  SITE (1499)..(1499): Xaa at position 1499 is His, Phe, Tyr, Lys, Arg, Gly Ser, Thr, Ala, Val, Leu, Ile, Asn, Met, or Gln
  SITE (1505)..(1505): Xaa at position 1505 is Cys, Ala, Val, Gly, Ser, or Thr
  SITE (1519)..(1519): Xaa at position 1519 is Val, Ala, Gly, Leu, or Ile
  SITE (1545)..(1545): Xaa at position 1545 is Ala, Gly, or Pro
  SITE (1552)..(1552): Xaa at position 1552 is Ala, Gly, or Pro
  SITE (1557)..(1557): Xaa at position 1557 is Ile, Ala, Val, Leu, or Gly
  SITE (1559)..(1559): Xaa at position 1559 is Tyr, Phe, Met, His, Ile, Leu Val, Ala, or Gly
  SITE (1560)..(1560): Xaa at position 1560 is Ala, Gly, or Pro
  SITE (1561)..(1561): Xaa at position 1561 is Tyr, Phe, Met, His, Ile, Leu Val, Ala, or Gly
  SITE (1563)..(1563): Xaa at position 1563 is Val, Ala, Gly, Leu, or Ile
  SITE (1577)..(1577): Xaa at position 1577 is Tyr, Phe, Met, His, Ile, Leu Val, Ala, or Gly
  SITE (1579)..(1579): Xaa at position 1579 is Ala, Gly, or Pro
  SITE (1581)..(1581): Xaa at position 1581 is Leu, Ala, Val, Gly, or Ile
  SITE (1590)..(1590): Xaa at position 1590 is Ala, Gly, or Pro
  SITE (1598)..(1598): Xaa at position 1598 is Ile, Ala, Val, Leu, or Gly
  SITE (1600)..(1600): Xaa at position 1600 is Phe, Tyr, Met, His, Ile, Leu Val, Ala, or Gly
  SITE (1609)..(1609): Xaa at position 1609 is Ala, Gly, or Pro
  SITE (1617)..(1617): Xaa at position 1617 is Tyr, Phe, Met, His, Ile, Leu Val, Ala, or Gly
  SITE (1618)..(1618): Xaa at position 1618 is Leu, Ala, Val, Gly, or Ile
  SITE (1619)..(1619): Xaa at position 1619 is Ile, Ala, Val, Leu, or Gly
  SITE (1620)..(1620): Xaa at position 1620 is Met, Ile, Leu, Val, Ala, or Gly
  SITE (1624)..(1624): Xaa at position 1624 is Ala, Gly, or Pro
  SITE (1637)..(1637): Xaa at position 1637 is Tyr, Phe, Met, His, Ile, Leu Val, Ala, or Gly
  SITE (1645)..(1645): Xaa at position 1645 is Ile, Ala, Val, Leu, or Gly
  SITE (1657)..(1657): Xaa at position 1657 is Cys, Ala, Val, Gly, Ser, or Thr
  SITE (1660)..(1660): Xaa at position 1660 is Phe, Tyr, Met, His, Ile, Leu Val, Ala, or Gly
  SITE (1664)..(1664): Xaa at position 1664 is Leu, Ala, Val, Gly, or Ile
  SITE (1667)..(1667): Xaa at position 1667 is Phe, Tyr, Met, His, Ile, Leu Val, Ala, or Gly
MGLLGILCFLIFLGKTWGQEQTYXXSXPKIXRXGXSENXXXQVYGYTEAXDXTXSXKSYPDKKFSYSSGHXHXSSENKFQNSAIXTXQPKQLPGGQNPVSYXYLEXVSKHFSKSKRXPITYDNGFXFIHTDKPVXTPDQSXKXRXXSXNDDLKPAKRETVXTXIDPEGSEVDMVEEIDHIGIXSFPDFKXPSNPRYGMXTXKXKXKEDFSTTGTAYXEXKEYVLPHFSVSIEPEYNFXGYKNFKNXEXTXKXRYFYNKVXTEXDXYXTXGXREDLKDDQKEMXQTAMQNTMXINGIAQVTXDSETAXKEXSYYSLEDLNNKYXYXAXTXIESTGGFSEEAEIPGIKXVLSPYKLNLVATPLFXKPGIPYPXKXQXKDSLDQLVGGVPXTXNAQTIDVNQETSDLDPSKSVTRVDDGVXSFVLNLPSGXTVXEXNXKTDAPDLPEENQXREGYRXIAXSSLSQSYXYIDWTDNHKALLVGEHLNXIXTPKSPYIDKITHXNYXXLSKGKIIHFGTREKFSDASYQSXNIPVTQNXVPSSRXXXXXIVTGEQTAEXXSDSVWXNXEEKCGNQLQXHLSPDADAYSPGQTXSXNXATGMDSWXXXXXXDSXXYGVQRGAKKPXERVFQFLEKSDLGCGAGGGLNNXNXXHLXGXTXLTNANADDSQENDEPCKEILRPRRTLQKKXEEIXAKYKHSVXKKXXYDGACVNNDETXEQRAARISLGPRXXKXXTEXXVXXSQLRANISHKDMQLGRLHMKTLLPVSKPEIRSYFPESWLWEVHLXPRRKQLQFALPDSLTTXEXQGXGXSNTGIXVADTVKAKXFKDXFLEMNIPYSXVRGEQXQXKGTXXNYRTSGMQFXVKMSAVEGICTSESPVIDHQGTKSSKCVRQKXEGSSSHLXTFTXXPLEIGLHNXNXSXETWFGKEILVKTXRVVPEGVKRESYSGVTXDPRGIYGTISRRKEFPYRIPLDLXPKTEIKRIXSXKGLLXGEXXSAVLSQEGINILTHLPKGSXEXEXMSXVPVXXXFHXXETGNHWNIFHSDPLIEKQKLKKKXKEGMLSIMSYRNADYSYSXWKGGSASTXXTXXXXRVLGQXNKYVEQNQNSICNSXLWXVENYQLDNGSFKENSQYQPXKLQGTLPVEARENSXXLTXXTXXGXRKXFDIXPLVKXDTXXIKXDNFXLENTLPAQSTXTXXXSXXXLSLGDKTHPQXRSXVSALKREALVKGNPPIYRXXKDNLQHKDSSVPNTGTXRMXETTXXXXXTSXNLKDINYXNPXXKXXSEEQRYGGGXYSTQDTXNXXEGXTEYSLXVKQLRXSXDXDXSYKHKGALHNYKXTDKNXLGRPVEXLLNDDXIXSTGFGSGLXTXHXTTVXHKTSTSEEVCSFYLKIDTQDIEASHYRGYGNSDYKRXVXCXSXKPSREESSSGSSXXXXDXSLPTGISANEEDXKAXVEGVDQLXTDYQIKDGHXIXQLNSXPSSDFLCXRXRXFELFEVGFLSPXTXTXYEXXRPDKQXTMFYSTSNIKIQKXCEGAACKCVEADCGQMQEELDLTISXETRKQTXCKPEXAXXXKXSITSITVENVFVKXKXTXLDIYKTGEXVAEKDSEXTXIKKVTCTNXELVKGRQXXXXGKEXLQIKYNFSFRYIXPLDSLTWXEYWPRDTTCSSXQAXLANXDEXAEDIFLNGC

SEQ ID NO: 112 - protein, 74 aa, Sus scrofa
  SITE (22)..(22): Xaa at position 22 is Cys, Ala, Val, Gly, Ser, or Thr
  SITE (47)..(47): Xaa at position 47 is Cys, Ala, Val, Gly, Ser, or Thr
  SITE (50)..(50): Xaa at position 50 is Ala, Gly, or Pro
  SITE (55)..(55): Xaa at position 55 is Cys, Ala, Val, Gly, Ser, or Thr
MLQKKIEEEAAKYKYAMLKKCXYDGAYRNDDETCEERAARIKIGPKXVKXFKDCXYIANQVRAEQSHKNIQLGR

SEQ ID NO: 113 - protein, 146 aa, Homo sapiens
  SITE (49)..(49): Xaa at position 49 is Val, Ala, Gly, Leu, or Ile
  SITE (52)..(52): Xaa at position 52 is Ala, Gly, or Pro
  SITE (56)..(56): Xaa at position 56 is Ala, Gly, or Pro
  SITE (90)..(90): Xaa at position 90 is Leu, Ala, Val, Gly, or Ile
  SITE (92)..(92): Xaa at position 92 is Val, Ala, Gly, Leu, or Ile
  SITE (94)..(94): Xaa at position 94 is Leu, Ala, Val, Gly, or Ile
  SITE (95)..(95): Xaa at position 95 is Gly, Ala, or Pro
  SITE (109)..(109): Xaa at position 109 is Cys, Ala, Val, Gly, Ser, or Thr
  SITE (123)..(123): Xaa at position 123 is Cys, Ala, Val, Gly, Ser, or Thr
  SITE (125)..(125): Xaa at position 125 is Phe, Tyr, Met, His, Ile, Leu, Val Ala, or Gly
  SITE (127)..(127): Xaa at position 127 is Ile, Ala, Val, Leu, or Gly
MAGPLRAPLLLLAILAVALAVSPAAGSSPGKPPRLVGGPMDASVEEEGXRRXLDFXVGEYNKASNDMYHSRALQVVRARKQIVAGVNYFXDXEXXRTTCTKTQPNLDNXPFHDQPHLKRKAFXSXQXYAVPWQGTMTLSKSTCQDA

SEQ ID NO: 114 - protein, 189 aa, Homo sapiens
  SITE (4)..(4): Xaa at position 4 is Tyr, Phe, Met, His, Ile, Leu, Val Ala, or Gly
  SITE (6)..(6): Xaa at position 6 is Leu, Ala, Val, Gly, or Ile
  SITE (7)..(7): Xaa at position 7 is Val, Ala, Gly, Leu, or Ile
  SITE (8)..(8): Xaa at position 8 is Val, Ala, Gly, Leu, or Ile
  SITE (9)..(9): Xaa at position 9 is Val, Ala, Gly, Leu, or Ile
  SITE (11)..(11): Xaa at position 11 is Ala, Gly, or Pro
  SITE (14)..(14): Xaa at position 14 is Val, Ala, Gly, Leu, or Ile
  SITE (19)..(19): Xaa at position 19 is Leu, Ala, Val, Gly, or Ile
  SITE (23)..(23): Xaa at position 23 is Leu, Ala, Val, Gly, or Ile
  SITE (29)..(29): Xaa at position 29 is Val, Ala, Gly, Leu, or Ile
  SITE (44)..(44): Xaa at position 44 is Val, Ala, Gly, Leu, or Ile
  SITE (46)..(46): Xaa at position 46 is Ile, Ala, Val, Leu, or Gly
  SITE (51)..(51): Xaa at position 51 is Cys, Ala, Val, Gly, Ser, or Thr
  SITE (52)..(52): Xaa at position 52 is Leu, Ala, Val, Gly, or Ile
  SITE (53)..(53): Xaa at position 53 is Leu, Ala, Val, Gly, or Ile
  SITE (55)..(55): Xaa at position 55 is Ile, Ala, Val, Leu, or Gly
  SITE (56)..(56): Xaa at position 56 is Leu, Ala, Val, Gly, or Ile
  SITE (59)..(59): Xaa at position 59 is Ala, Gly, or Pro
  SITE (67)..(67): Xaa at position 67 is Met, Ile, Leu, Val, Ala, or Gly
  SITE (72)..(72): Xaa at position 72 is Met, Ile, Leu, Val, Ala, or Gly
  SITE (78)..(78): Xaa at position 78 is Phe, Tyr, Met, His, Ile, Leu, Val Ala, or Gly
  SITE (79)..(79): Xaa at position 79 is Leu, Ala, Val, Gly, or Ile
  SITE (80)..(80): Xaa at position 80 is Cys, Ala, Val, Gly, Ser, or Thr
  SITE (81)..(81): Xaa at position 81 is Val, Ala, Gly, Leu, or Ile
  SITE (82)..(82): Xaa at position 82 is Phe, Tyr, Met, His, Ile, Leu, Val Ala, or Gly
  SITE (83)..(83): Xaa at position 83 is Ala, Gly, or Pro
  SITE (84)..(84): Xaa at position 84 is Ile, Ala, Val, Leu, or Gly
  SITE (90)..(90): Xaa at position 90 is Phe, Tyr, Met, His, Ile, Leu, Val Ala, or Gly
  SITE (93)..(93): Xaa at position 93 is Ile, Ala, Val, Leu, or Gly
  SITE (95)..(95): Xaa at position 95 is Leu, Ala, Val, Gly, or Ile
  SITE (96)..(96): Xaa at position 96 is Tyr, Phe, Met, His, Ile, Leu, Val Ala, or Gly
  SITE (100)..(100): Xaa at position 100 is Ile, Ala, Val, Leu, or Gly
  SITE (103)..(103): Xaa at position 103 is Val, Ala, Gly, Leu, or Ile
  SITE (109)..(109): Xaa at position 109 is Val, Ala, Gly, Leu, or Ile
  SITE (111)..(111): Xaa at position 111 is Met, Ile, Leu, Val, Ala, or Gly
  SITE (112)..(112): Xaa at position 112 is Val, Ala, Gly, Leu, or Ile
  SITE (113)..(113): Xaa at position 113 is Leu, Ala, Val, Gly, or Ile
  SITE (114)..(114): Xaa at position 114 is Val, Ala, Gly, Leu, or Ile
  SITE (120)..(120): Xaa at position 120 is Leu, Ala, Val, Gly, or Ile
  SITE (125)..(125): Xaa at position 125 is Val, Ala, Gly, Leu, or Ile
  SITE (130)..(130): Xaa at position 130 is Ala, Gly, or Pro
  SITE (134)..(134): Xaa at position 134 is Ala, Gly, or Pro
  SITE (146)..(146): Xaa at position 146 is Ala, Gly, or Pro
  SITE (152)..(152): Xaa at position 152 is Val, Ala, Gly, Leu, or Ile
  SITE (155)..(155): Xaa at position 155 is Ala, Gly, or Pro
  SITE (156)..(156): Xaa at position 156 is Phe, Tyr, Met, His, Ile, Leu, Val Ala, or Gly
  SITE (159)..(159): Xaa at position 159 is Leu, Ala, Val, Gly, or Ile
  SITE (160)..(160): Xaa at position 160 is Val, Ala, Gly, Leu, or Ile
  SITE (163)..(163): Xaa at position 163 is Ile, Ala, Val, Leu, or Gly
  SITE (168)..(168): Xaa at position 168 is Met, Ile, Leu, Val, Ala, or Gly
MTEXKXXXXGXGGXGKSAXTIQXIQNHFXDEYDPTIEDSYRKQXVXDGETXXXDXXDTXGQEEYSAXRDQYXRTGEGXXXXXXXNNSKSXADXNXXREQXKRXKDSDDXPXXXXGNKCDXPTRTXDTKQXHELXKSYGIPFIETSXKTRQGXEDXXYTXXREXRQYRXKKLNSSDDGTQGCMGLPCVVM

SEQ ID NO: 115 - protein, 241 aa, Homo sapiens
  SITE (127)..(127): Xaa at position 127 is Val, Ala, Gly, Leu, or Ile
  SITE (153)..(153): Xaa at position 153 is Val, Ala, Gly, Leu, or Ile
  SITE (170)..(170): Xaa at position 170 is Val, Ala, Gly, Leu, or Ile
  SITE (172)..(172): Xaa at position 172 is Leu, Ala, Val, Gly, or Ile
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEXQRCSGCCNNRNVQCRPTQVQLRPVQXRKIEIVRKKPIFKKATXTXEDHLACKCETVAAARPVTRSPGGSQEQRAKTPQTRVTIRTVRVRRPPKGKHRKFKHTHDKTALKETLGA

SEQ ID NO: 116 - protein, 860 aa, Homo sapiens
  SITE (40)..(40): Xaa at position 40 is Ile, Ala, Val, Leu, or Gly
  SITE (45)..(45): Xaa at position 45 is Val, Ala, Gly, Leu, or Ile
  SITE (52)..(52): Xaa at position 52 is Cys, Ala, Val, Gly, Ser, or Thr
  SITE (83)..(83): Xaa at position 83 is Ile, Ala, Val, Leu, or Gly
  SITE (95)..(95): Xaa at position 95 is Cys, Ala, Val, Gly, Ser, or Thr
  SITE (116)..(116): Xaa at position 116 is Cys, Ala, Val, Gly, Ser, or Thr
  SITE (122)..(122): Xaa at position 122 is Ile, Ala, Val, Leu, or Gly
  SITE (134)..(134): Xaa at position 134 is Cys, Ala, Val, Gly, Ser, or Thr
  SITE (155)..(155): Xaa at position 155 is Cys, Ala, Val, Gly, Ser, or Thr
  SITE (161)..(161): Xaa at position 161 is Ile, Ala, Val, Leu, or Gly
  SITE (166)..(166): Xaa at position 166 is Ala, Gly, or Pro
  SITE (173)..(173): Xaa at position 173 is Cys, Ala, Val, Gly, Ser, or Thr
  SITE (204)..(204): Xaa at position 204 is Cys, Ala, Val, Gly, Ser, or Thr
  SITE (222)..(222): Xaa at position 222 is Cys, Ala, Val, Gly, Ser, or Thr
  SITE (318)..(318): Xaa at position 318 is Cys, Ala, Val, Gly, Ser, or Thr
  SITE (338)..(338): Xaa at position 338 is Cys, Ala, Val, Gly, Ser, or Thr
  SITE (352)..(352): Xaa at position 352 is Cys, Ala, Val, Gly, Ser, or Thr
  SITE (377)..(377): Xaa at position 377 is Cys, Ala, Val, Gly, Ser, or Thr
  SITE (400)..(400): Xaa at position 400 is Tyr, Phe, Met, His, Ile, Leu, Val Ala, or Gly
  SITE (401)..(401): Xaa at position 401 is Leu, Ala, Val, Gly, or Ile
  SITE (402)..(402): Xaa at position 402 is Phe, Tyr, Met, His, Ile, Leu, Val Ala, or Gly
  SITE (403)..(403): Xaa at position 403 is Phe, Tyr, Met, His, Ile, Leu, Val Ala, or Gly
  SITE (409)..(409): Xaa at position 409 is Val, Ala, Gly, Leu, or Ile
  SITE (412)..(412): Xaa at position 412 is Met, Ile, Leu, Val, Ala, or Gly
  SITE (414)..(414): Xaa at position 414 is Leu, Ala, Val, Gly, or Ile
  SITE (423)..(423): Xaa at position 423 is Ile, Ala, Val, Leu, or Gly
  SITE (431)..(431): Xaa at position 431 is Ala, Gly, or Pro
  SITE (432)..(432): Xaa at position 432 is Leu, Ala, Val, Gly, or Ile
  SITE (436)..(436): Xaa at position 436 is Val, Ala, Gly, Leu, or Ile
  SITE (441)..(441): Xaa at position 441 is Ile, Ala, Val, Leu, or Gly
  SITE (443)..(443): Xaa at position 443 is Trp, Tyr, Phe, Met, His, Ile, Leu Val, Ala, or Gly
  SITE (451)..(451): Xaa at position 451 is Ile, Ala, Val, Leu, or Gly
  SITE (480)..(480): Xaa at position 480 is Ala, Gly, or Pro
  SITE (481)..(481): Xaa at position 481 is Val, Ala, Gly, Leu, or Ile
  SITE (488)..(488): Xaa at position 488 is Ile, Ala, Val, Leu, or Gly
  SITE (489)..(489): Xaa at position 489 is Tyr, Phe, Met, His, Ile, Leu, Val Ala, or Gly
  SITE (490)..(490): Xaa at position 490 is Trp, Tyr, Phe, Met, His, Ile, Leu Val, Ala, or Gly
  SITE (498)..(498): Xaa at position 498 is Val, Ala, Gly, Leu, or Ile
  SITE (500)..(500): Xaa at position 500 is Val, Ala, Gly, Leu, or Ile
  SITE (501)..(501): Xaa at position 501 is Ala, Gly, or Pro
  SITE (531)..(531): Xaa at position 531 is Met, Ile, Leu, Val, Ala, or Gly
  SITE (532)..(532): Xaa at position 532 is Tyr, Phe, Met, His, Ile, Leu, Val Ala, or Gly
  SITE (533)..(533): Xaa at position 533 is Trp, Tyr, Phe, Met, His, Ile, Leu Val, Ala, or Gly
  SITE (542)..(542): Xaa at position 542 is Ile, Ala, Val, Leu, or Gly
  SITE (547)..(547): Xaa at position 547 is Leu, Ala, Val, Gly, or Ile
  SITE (556)..(556): Xaa at position 556 is Val, Ala, Gly, Leu, or Ile
  SITE (575)..(575): Xaa at position 575 is Leu, Ala, Val, Gly, or Ile
  SITE (577)..(577): Xaa at position 577 is Trp, Tyr, Phe, Met, His, Ile, Leu Val, Ala, or Gly
  SITE (578)..(578): Xaa at position 578 is Val, Ala, Gly, Leu, or Ile
  SITE (585)..(585): Xaa at position 585 is Ile, Ala, Val, Leu, or Gly
  SITE (605)..(605): Xaa at position 605 is Leu, Ala, Val, Gly, or Ile
  SITE (611)..(611): Xaa at position 611 is Leu, Ala, Val, Gly, or Ile
  SITE (612)..(612): Xaa at position 612 is Ala, Gly, or Pro
  SITE (618)..(618): Xaa at position 618 is Val, Ala, Gly, Leu, or Ile
  SITE (619)..(619): Xaa at position 619 is Phe, Tyr, Met, His, Ile, Leu, Val Ala, or Gly
  SITE (620)..(620): Xaa at position 620 is Trp, Tyr, Phe, Met, His, Ile, Leu Val, Ala, or Gly
  SITE (627)..(627): Xaa at position 627 is Ala, Gly, or Pro
  SITE (628)..(628): Xaa at position 628 is Ile, Ala, Val, Leu, or Gly
  SITE (631)..(631): Xaa at position 631 is Ala, Gly, or Pro
  SITE (643)..(643): Xaa at position 643 is Ala, Gly, or Pro
  SITE (646)..(646): Xaa at position 646 is Leu, Ala, Val, Gly, or Ile
  SITE (667)..(667): Xaa at position 667 is Cys, Ala, Val, Gly, Ser, or Thr
  SITE (677)..(677): Xaa at position 677 is Cys, Ala, Val, Gly, Ser, or Thr
  SITE (681)..(681): Xaa at position 681 is Cys, Ala, Val, Gly, Ser, or Thr
  SITE (682)..(682): Xaa at position 682 is Leu, Ala, Val, Gly, or Ile
  SITE (698)..(698): Xaa at position 698 is Cys, Ala, Val, Gly, Ser, or Thr
MGPWGWKLRWTVALLLAAAGTAVGDRCERNEFQCQDGKCXSYKWXCDGSAEXQDGSDESQETCLSVTCKSGDFSCGGRVNRCXPQFWRCDGQVDXDNGSDEQGCPPKTCSQDEFRXHDGKCXSRQFVCDSDRDXLDGSDEASCPVLTCGPASFQXNSSTCXPQLWXCDNDPDXEDGSDEWPQRCRGLYVFQGDSSPCSAFEFHXLSGECIHSSWRCDGGPDXKDKSDEENCAVATCRPDEFQCSDGNCIHGSRQCDREYDCKDMSDEVGCVNVTLCEGPNKFKCHSGECITLDKVCNMARDCRDWSDEPIKECGTNEXLDNNGGCSHVCNDLKIGYEXLCPDGFQLVAQRRXEDIDECQDPDTCSQLCVNLEGGYKXQCEEGFQLDPHTKACKAVGSIAXXXXTNRHEXRKXTXDRSEYTSLXPNLRNVVXXDTEXASNRXYXSDLSQRMXCSTQLDRAHGVSSYDTVISRDIQAPDGLXXDWIHSNXXXTDSVLGTXSXXDTKGVKRKTLFRENGSKPRAIVVDPVHGFXXXTDWGTPAKXKKGGXNGVDIYSLXTENIQWPNGITLDLLSGRXYXXDSKLHSXSSIDVNGGNRKTILEDEKRXAHPFSXXVFEDKXXXTDIINEXXFSXNRLTGSDVNLLXENXLSPEDMVLFHNLTQPRGVNWXERTTLSNGGXQYLXXPAPQINPHSPKFTCAXPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 117 - protein, 390 aa, Homo sapiens
  SITE (258)..(258): Xaa at position 258 is Leu, Ala, Val, Gly, or Ile
  SITE (293)..(293): Xaa at position 293 is Cys, Ala, Val, Gly, Ser, or Thr
  SITE (294)..(294): Xaa at position 294 is Cys, Ala, Val, Gly, Ser, or Thr
  SITE (295)..(295): Xaa at position 295 is Val, Ala, Gly, Leu, or Ile
  SITE (302)..(302): Xaa at position 302 is Phe, Tyr, Met, His, Ile, Leu, Val Ala, or Gly
  SITE (326)..(326): Xaa at position 326 is Cys, Ala, Val, Gly, Ser, or Thr
  SITE (340)..(340): Xaa at position 340 is Leu, Ala, Val, Gly, or Ile
  SITE (341)..(341): Xaa at position 341 is Ala, Gly, or Pro
  SITE (364)..(364): Xaa at position 364 is Leu, Ala, Val, Gly, or Ile
  SITE (366)..(366): Xaa at position 366 is Ile, Ala, Val, Leu, or Gly
  SITE (387)..(387): Xaa at position 387 is Cys, Ala, Val, Gly, Ser, or Thr
  SITE (389)..(389): Xaa at position 389 is Cys, Ala, Val, Gly, Ser, or Thr
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFXLLMATPLERAQHLQSSRHRRALDTNYCFSSTEKNXXXRQLYIDXRKDLGWKWIHEPKGYHANFCLGPXPYIWSLDTQYSKVXXLYNQHNPGASAAPCCVPQALEPXPXVYYVGRKPKVEQLSNMIVRSXKXS

SEQ ID NO: 118 - protein, 241 aa, Homo sapiens
  SITE (136)..(136): Xaa at position 136 is Cys, Ala, Val, Gly, Ser, or Thr
  SITE (157)..(157): Xaa at position 157 is Val, Ala, Gly, Leu, or Ile
  SITE (159)..(159): Xaa at position 159 is Val, Ala, Gly, Leu, or Ile
  SITE (163)..(163): Xaa at position 163 is Val, Ala, Gly, Leu, or Ile
  SITE (189)..(189): Xaa at position 189 is Cys, Ala, Val, Gly, Ser, or Thr
  SITE (210)..(210): Xaa at position 210 is Ala, Gly, or Pro
  SITE (218)..(218): Xaa at position 218 is Ala, Gly, or Pro
  SITE (219)..(219): Xaa at position 219 is Ala, Gly, or Pro
  SITE (223)..(223): Xaa at position 223 is Ile, Ala, Val, Leu, or Gly
  SITE (225)..(225): Xaa at position 225 is Ile, Ala, Val, Leu, or Gly
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVXDSVSVWVGDKTTATDIKGKEXMXLGEXNINNSVFKQYFFETKCRDPNPVDSGXRGIDSKHWNSYCTTTHTFVKXLTMDGKQXXWRFXRXDTACVCVLSRKAVRRA

SEQ ID NO: 119 - protein, 164 aa, Homo sapiens
  SITE (44)..(44): Xaa at position 44 is Cys, Ala, Val, Gly, Ser, or Thr
  SITE (52)..(52): Xaa at position 52 is Cys, Ala, Val, Gly, Ser, or Thr
  SITE (57)..(57): Xaa at position 57 is Ile, Ala, Val, Leu, or Gly
  SITE (58)..(58): Xaa at position 58 is Cys, Ala, Val, Gly, Ser, or Thr
  SITE (59)..(59): Xaa at position 59 is Cys, Ala, Val, Gly, Ser, or Thr
  SITE (65)..(65): Xaa at position 65 is Cys, Ala, Val, Gly, Ser, or Thr
  SITE (72)..(72): Xaa at position 72 is Ala, Gly, or Pro
  SITE (75)..(75): Xaa at position 75 is Cys, Ala, Val, Gly, Ser, or Thr
  SITE (92)..(92): Xaa at position 92 is Cys, Ala, Val, Gly, Ser, or Thr
  SITE (98)..(98): Xaa at position 98 is Cys, Ala, Val, Gly, Ser, or Thr
  SITE (99)..(99): Xaa at position 99 is Ala, Gly, or Pro
  SITE (100)..(100): Xaa at position 100 is Ala, Gly, or Pro
  SITE (104)..(104): Xaa at position 104 is Cys, Ala, Val, Gly, Ser, or Thr
  SITE (105)..(105): Xaa at position 105 is Cys, Ala, Val, Gly, Ser, or Thr
  SITE (110)..(110): Xaa at position 110 is Cys, Ala, Val, Gly, Ser, or Thr
MPDTMLPACFLGLLAFSSACYFQNCPRGGKRAMSDLELRQCLPXGPGGKGRXFGPSXXXADELGXFVGTAEXLRXQEENYLPSPCQSGQKAXGSGGRXXXFGVXXNDESXVTEPECREGFHRRARASDRSNATQLDGPAGALLLRLVQLAGAPEPFEPAQPDAY

SEQ ID NO: 120 - protein, 217 aa, Homo sapiens
  SITE (36)..(36): Xaa at position 36 is Phe, Tyr, Met, His, Ile, Leu, Val Ala, or Gly
  SITE (39)..(39): Xaa at position 39 is Ala, Gly, or Pro
  SITE (43)..(43): Xaa at position 43 is Ala, Gly, or Pro
  SITE (46)..(46): Xaa at position 46 is Leu, Ala, Val, Gly, or Ile
  SITE (49)..(49): Xaa at position 49 is Leu, Ala, Val, Gly, or Ile
  SITE (50)..(50): Xaa at position 50 is Ala, Gly, or Pro
  SITE (54)..(54): Xaa at position 54 is Tyr, Phe, Met, His, Ile, Leu, Val Ala, or Gly
  SITE (70)..(70): Xaa at position 70 is Phe, Tyr, Met, His, Ile, Leu, Val Ala, or Gly
  SITE (79)..(79): Xaa at position 79 is Cys, Ala, Val, Gly, Ser, or Thr
  SITE (84)..(84): Xaa at position 84 is Ile, Ala, Val, Leu, or Gly
  SITE (99)..(99): Xaa at position 99 is Leu, Ala, Val, Gly, or Ile
  SITE (101)..(101): Xaa at position 101 is Leu, Ala, Val, Gly, or Ile
  SITE (102)..(102): Xaa at position 102 is Leu, Ala, Val, Gly, or Ile
  SITE (104)..(104): Xaa at position 104 is Ile, Ala, Val, Leu, or Gly
  SITE (106)..(106): Xaa at position 106 is Leu, Ala, Val, Gly, or Ile
  SITE (107)..(107): Xaa at position 107 is Leu, Ala, Val, Gly, or Ile
  SITE (108)..(108): Xaa at position 108 is Leu, Ala, Val, Gly, or Ile
  SITE (109)..(109): Xaa at position 109 is Ile, Ala, Val, Leu, or Gly
  SITE (112)..(112): Xaa at position 112 is Trp, Tyr, Phe, Met, His, Ile, Leu Val, Ala, or Gly
  SITE (116)..(116): Xaa at position 116 is Val, Ala, Gly, Leu, or Ile
  SITE (119)..(119): Xaa at position 119 is Leu, Ala, Val, Gly, or Ile
  SITE (123)..(123): Xaa at position 123 is Phe, Tyr, Met, His, Ile, Leu, Val Ala, or Gly
  SITE (131)..(131): Xaa at position 131 is Ala, Gly, or Pro
  SITE (136)..(136): Xaa at position 136 is Val, Ala, Gly, Leu, or Ile
  SITE (140)..(140): Xaa at position 140 is Leu, Ala, Val, Gly, or Ile
  SITE (143)..(143): Xaa at position 143 is Leu, Ala, Val, Gly, or Ile
  SITE (147)..(147): Xaa at position 147 is Ile, Ala, Val, Leu, or Gly
  SITE (150)..(150): Xaa at position 150 is Leu, Ala, Val, Gly, or Ile
  SITE (186)..(186): Xaa at position 186 is Tyr, Phe, Met, His, Ile, Leu, Val Ala, or Gly
  SITE (189)..(189): Xaa at position 189 is Leu, Ala, Val, Gly, or Ile
  SITE (192)..(192): Xaa at position 192 is Phe, Tyr, Met, His, Ile, Leu, Val Ala, or Gly
  SITE (196)..(196): Xaa at position 196 is Met, Ile, Leu, Val, Ala, or Gly
  SITE (199)..(199): Xaa at position 199 is Val, Ala, Gly, Leu, or Ile
  SITE (202)..(202): Xaa at position 202 is Phe, Tyr, Met, His, Ile, Leu, Val Ala, or Gly
  SITE (203)..(203): Xaa at position 203 is Leu, Ala, Val, Gly, or Ile
  SITE (206)..(206): Xaa at position 206 is Val, Ala, Gly, Leu, or Ile
MATGSRTSLLLAFGLLCLPWLQEGSAFPTIPLSRLXDNXMLRXHRXHQXXFDTXQEFEEAYIPKEQKYSXLQNPQTSLXFSESXPTPSNREETQQKSNXEXXRXSXXXXQSXLEPXQFXRSVXANSLVYGXSDSNXYDLXKDXEEGXQTXMGRLEDGSPRTGQIFKQTYSKFDTNSHNDDALLKNXGLXYCXRKDXDKXETXXRIXQCRSVEGSCGF

SEQ ID NO: 121 - protein, 110 aa, Homo sapiens
  SITE (35)..(35): Xaa at position 35 is Leu, Ala, Val, Gly, or Ile
  SITE (38)..(38): Xaa at position 38 is Ala, Gly, or Pro
  SITE (39)..(39): Xaa at position 39 is Leu, Ala, Val, Gly, or Ile
  SITE (91)..(91): Xaa at position 91 is Ile, Ala, Val, Leu, or Gly
  SITE (95)..(95): Xaa at position 95 is Cys, Ala, Val, Gly, Ser, or Thr
  SITE (105)..(105): Xaa at position 105 is Leu, Ala, Val, Gly, or Ile
  SITE (109)..(109): Xaa at position 109 is Cys, Ala, Val, Gly, Ser, or Thr
MALWMRLLPLLALLALWGPDPAAAFVNQHLCGSHXVEXXYLVCGERGFFYTPKTRREAEDLQVGQVELGGGPGAGSLQPLALEGSLQKRGXVEQXCTSICSLYQXENYXN

SEQ ID NO: 122 - protein, 180 aa, Homo sapiens
  SITE (37)..(37): Xaa at position 37 is Leu, Ala, Val, Gly, or Ile
  SITE (41)..(41): Xaa at position 41 is Leu, Ala, Val, Gly, or Ile
  SITE (52)..(52): Xaa at position 52 is Phe, Tyr, Met, His, Ile, Leu, Val Ala, or Gly
  SITE (66)..(66): Xaa at position 66 is Ile, Ala, Val, Leu, or Gly
  SITE (70)..(70): Xaa at position 70 is Cys, Ala, Val, Gly, Ser, or Thr
  SITE (75)..(75): Xaa at position 75 is Cys, Ala, Val, Gly, Ser, or Thr
  SITE (80)..(80): Xaa at position 80 is Leu, Ala, Val, Gly, or Ile
  SITE (83)..(83): Xaa at position 83 is Tyr, Phe, Met, His, Ile, Leu, Val Ala, or Gly
  SITE (84)..(84): Xaa at position 84 is Cys, Ala, Val, Gly, Ser, or Thr
  SITE (85)..(85): Xaa at position 85 is Ala, Gly, or Pro
MGIPMGKSMLVLLTFLAFASCCIAAYRPSETLCGGEXVDTXQFVCGDRGFYXSRPASRVSRRSRGXVEEXCFRSXDLALXETXXXTPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 123 - protein, 205 aa, Homo sapiens
  SITE (65)..(65): Xaa at position 65 is Ala, Gly, or Pro
  SITE (67)..(67): Xaa at position 67 is Leu, Ala, Val, Gly, or Ile
  SITE (68)..(68): Xaa at position 68 is Ile, Ala, Val, Leu, or Gly
  SITE (94)..(94): Xaa at position 94 is Leu, Ala, Val, Gly, or Ile
  SITE (99)..(99): Xaa at position 99 is Leu, Ala, Val, Gly, or Ile
  SITE (101)..(101): Xaa at position 101 is Val, Ala, Gly, Leu, or Ile
  SITE (107)..(107): Xaa at position 107 is Tyr, Phe, Met, His, Ile, Leu, Val Ala, or Gly
  SITE (109)..(109): Xaa at position 109 is Val, Ala, Gly, Leu, or Ile
  SITE (113)..(113): Xaa at position 113 is Val, Ala, Gly, Leu, or Ile
  SITE (115)..(115): Xaa at position 115 is Phe, Tyr, Met, His, Ile, Leu, Val Ala, or Gly
  SITE (131)..(131): Xaa at position 131 is Leu, Ala, Val, Gly, or Ile
  SITE (133)..(133): Xaa at position 133 is His, Phe, Tyr, Lys, Arg, Gly, Ser Thr, Ala, Val, Leu, Ile, Asn, Met, or Gln
  SITE (135)..(135): Xaa at position 135 is Val, Ala, Gly, Leu, or Ile
  SITE (181)..(181): Xaa at position 181 is Leu, Ala, Val, Gly, or Ile
  SITE (198)..(198): Xaa at position 198 is Val, Ala, Gly, Leu, or Ile
  SITE (200)..(200): Xaa at position 200 is Phe, Tyr, Met, His, Ile, Leu, Val Ala, or Gly
  SITE (202)..(202): Xaa at position 202 is Ala, Gly, or Pro
MTPPERLFLPRVCGTTLHLLLLGLLLVLLPGAQGLPGVGLTPSAAQTARQHPKMHLAHSTLKPAXHXXGDPSKQNSLLWRANTDRAFLQDGFSXSNNSXLXPTSGIXFXYSQXVXSGKAYSPKATSSPLYXAXEXQLFSSQYPFHVPLLSSQKMVYPGLQEPWLHSMYHGAAFQLTQGDQXSTHTDGIPHLVLSPSTXFXGXFAL

SEQ ID NO: 124 - protein, 233 aa, Homo sapiens
  SITE (90)..(90): Xaa at position 90 is Ala, Gly, or Pro
  SITE (92)..(92): Xaa at position 92 is Val, Ala, Gly, Leu, or Ile
  SITE (94)..(94): Xaa at position 94 is Ala, Gly, or Pro
  SITE (98)..(98): Xaa at position 98 is Ala, Gly, or Pro
  SITE (105)..(105): Xaa at position 105 is Leu, Ala, Val, Gly, or Ile
  SITE (117)..(117): Xaa at position 117 is Val, Ala, Gly, Leu, or Ile
  SITE (124)..(124): Xaa at position 124 is Leu, Ala, Val, Gly, or Ile
  SITE (125)..(125): Xaa at position 125 is Val, Ala, Gly, Leu, or Ile
  SITE (126)..(126): Xaa at position 126 is Val, Ala, Gly, Leu, or Ile
  SITE (131)..(131): Xaa at position 131 is Leu, Ala, Val, Gly, or Ile
  SITE (132)..(132): Xaa at position 132 is Tyr, Phe, Met, His, Ile, Leu, Val Ala, or Gly
  SITE (133)..(133): Xaa at position 133 is Leu, Ala, Val, Gly, or Ile
  SITE (134)..(134): Xaa at position 134 is Ile, Ala, Val, Leu, or Gly
  SITE (138)..(138): Xaa at position 138 is Val, Ala, Gly, Leu, or Ile
  SITE (140)..(140): Xaa at position 140 is Phe, Tyr, Met, His, Ile, Leu, Val Ala, or Gly
  SITE (145)..(145): Xaa at position 145 is Cys, Ala, Val, Gly, Ser, or Thr
  SITE (150)..(150): Xaa at position 150 is Val, Ala, Gly, Leu, or Ile
  SITE (152)..(152): Xaa at position 152 is Leu, Ala, Val, Gly, or Ile
  SITE (154)..(154): Xaa at position 154 is His, Phe, Tyr, Lys, Arg, Gly, Ser Thr, Ala, Val, Leu, Ile, Asn, Met, or Gln
  SITE (156)..(156): Xaa at position 156 is Ile, Ala, Val, Leu, or Gly
  SITE (160)..(160): Xaa at position 160 is Ala, Gly, or Pro
  SITE (202)..(202): Xaa at position 202 is Leu, Ala, Val, Gly, or Ile
  SITE (208)..(208): Xaa at position 208 is Leu, Ala, Val, Gly, or Ile
  SITE (210)..(210): Xaa at position 210 is Ala, Gly, or Pro
  SITE (226)..(226): Xaa at position 226 is Val, Ala, Gly, Leu, or Ile
  SITE (228)..(228): Xaa at position 228 is Phe, Tyr, Met, His, Ile, Leu, Val Ala, or Gly
  SITE (230)..(230): Xaa at position 230 is Ile, Ala, Val, Leu, or Gly
MSTESMIRDVELAEEALPKKTGGPQGSRRCLFLSLFSFLIVAGATTLFCLLHFGVIGPQREEFPRDLSLISPLAQAVRSSSRTPSDKPVXHXVXNPQXEGQLQWXNRRANALLANGXELRDNQXXXPSEGXXXXYSQXLXKGQGXPSTHXLXTXTXSRIXVSYQTKVNLLSAIKSPCQRETPEGAEAKPWYEPIYLGGVFQXEKGDRXSXEINRPDYLDFAESGQXYXGXIAL

SEQ ID NO: 125 - protein, 166 aa, Homo sapiens
  SITE (6)..(6): Xaa at position 6 is Tyr, Phe, Met, His, Ile, Leu, Val Ala, or Gly
  SITE (7)..(7): Xaa at position 7 is Ile, Ala, Val, Leu, or Gly
  SITE (10)..(10): Xaa at position 10 is Phe, Tyr, Met, His, Ile, Leu, Val Ala, or Gly
  SITE (13)..(13): Xaa at position 13 is Cys, Ala, Val, Gly, Ser, or Thr
  SITE (14)..(14): Xaa at position 14 is Ile, Ala, Val, Leu, or Gly
  SITE (31)..(31): Xaa at position 31 is Ala, Gly, or Pro
  SITE (34)..(34): Xaa at position 34 is Leu, Ala, Val, Gly, or Ile
  SITE (40)..(40): Xaa at position 40 is Ala, Gly, or Pro
  SITE (52)..(52): Xaa at position 52 is Phe, Tyr, Met, His, Ile, Leu, Val Ala, or Gly
  SITE (56)..(56): Xaa at position 56 is Leu, Ala, Val, Gly, or Ile
  SITE (67)..(67): Xaa at position 67 is Ile, Ala, Val, Leu, or Gly
  SITE (68)..(68): Xaa at position 68 is Met, Ile, Leu, Val, Ala, or Gly
  SITE (72)..(72): Xaa at position 72 is Ile, Ala, Val, Leu, or Gly
  SITE (73)..(73): Xaa at position 73 is Val, Ala, Gly, Leu, or Ile
  SITE (76)..(76): Xaa at position 76 is Tyr, Phe, Met, His, Ile, Leu, Val Ala, or Gly
  SITE (77)..(77): Xaa at position 77 is Phe, Tyr, Met, His, Ile, Leu, Val Ala, or Gly
  SITE (79)..(79): Xaa at position 79 is Leu, Ala, Val, Gly, or Ile
  SITE (80)..(80): Xaa at position 80 is Phe, Tyr, Met, His, Ile, Leu, Val Ala, or Gly
  SITE (89)..(89): Xaa at position 89 is Ile, Ala, Val, Leu, or Gly
  SITE (93)..(93): Xaa at position 93 is Val, Ala, Gly, Leu, or Ile
  SITE (96)..(96): Xaa at position 96 is Ile, Ala, Val, Leu, or Gly
  SITE (100)..(100): Xaa at position 100 is Met, Ile, Leu, Val, Ala, or Gly
  SITE (104)..(104): Xaa at position 104 is Phe, Tyr, Met, His, Ile, Leu, Val Ala, or Gly
  SITE (105)..(105): Xaa at position 105 is Phe, Tyr, Met, His, Ile, Leu, Val Ala, or Gly
  SITE (115)..(115): Xaa at position 115 is Phe, Tyr, Met, His, Ile, Leu, Val Ala, or Gly
  SITE (132)..(132): Xaa at position 132 is Ala, Gly, or Pro
  SITE (133)..(133): Xaa at position 133 is Ile, Ala, Val, Leu, or Gly
  SITE (136)..(136): Xaa at position 136 is Leu, Ala, Val, Gly, or Ile
  SITE (140)..(140): Xaa at position 140 is Met, Ile, Leu, Val, Ala, or Gly
  SITE (158)..(158): Xaa at position 158 is Leu, Ala, Val, Gly, or Ile
MKYTSXXLAXQLXXVLGSLGCYCQDPYVKEXENXKKYFNXGHSDVADNGTLXLGIXKNWKEESDRKXXQSQXXSFXXKXXKNFKDDQSXQKSXETXKEDXNVKXXNSNKKKRDDXEKLTNYSVTDLNVQRKXXHEXIQVXAELSPAAKTGKRKRSQMXFRGRRASQ

SEQ ID NO: 126 - protein, 271 aa, Homo sapiens
  SITE (135)..(135): Xaa at position 135 is Ile, Ala, Val, Leu, or Gly
  SITE (136)..(136): Xaa at position 136 is Leu, Ala, Val, Gly, or Ile
  SITE (163)..(163): Xaa at position 163 is Ala, Gly, or Pro
  SITE (166)..(166): Xaa at position 166 is Phe, Tyr, Met, His, Ile, Leu, Val Ala, or Gly
  SITE (170)..(170): Xaa at position 170 is Ala, Gly, or Pro
  SITE (171)..(171): Xaa at position 171 is Tyr, Phe, Met, His, Ile, Leu, Val Ala, or Gly
  SITE (178)..(178): Xaa at position 178 is Ala, Gly, or Pro
  SITE (182)..(182): Xaa at position 182 is Val, Ala, Gly, Leu, or Ile
  SITE (183)..(183): Xaa at position 183 is Ile, Ala, Val, Leu, or Gly
  SITE (192)..(192): Xaa at position 192 is Tyr, Phe, Met, His, Ile, Leu, Val Ala, or Gly
  SITE (214)..(214): Xaa at position 214 is Ile, Ala, Val, Leu, or Gly
  SITE (221)..(221): Xaa at position 221 is Leu, Ala, Val, Gly, or Ile
  SITE (223)..(223): Xaa at position 223 is Phe, Tyr, Met, His, Ile, Leu, Val Ala, or Gly
  SITE (234)..(234): Xaa at position 234 is Phe, Tyr, Met, His, Ile, Leu, Val Ala, or Gly
  SITE (244)..(244): Xaa at position 244 is Ile, Ala, Val, Leu, or Gly
  SITE (245)..(245): Xaa at position 245 is Ala, Gly, or Pro
  SITE (252)..(252): Xaa at position 252 is Val, Ala, Gly, Leu, or Ile
  SITE (254)..(254): Xaa at position 254 is Leu, Ala, Val, Gly, or Ile
  SITE (264)..(264): Xaa at position 264 is Phe, Tyr, Met, His, Ile, Leu, Val Ala, or Gly
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFXXNDALNQSIIRANDQYLTAAALHNLDEXVKXDMGXXKSSKDDXKITXXLRISKTQLXVTAQDEDQPVLLKEMPEIPKTXTGSETNXLXFWETHGTKNYXTSVAHPNLFXXTKQDYWXCXAGGPPSITDXQILENQA

SEQ ID NO: 127 - protein, 269 aa, Homo sapiens
  SITE (124)..(124): Xaa at position 124 is Cys, Ala, Val, Gly, Ser, or Thr
  SITE (126)..(126): Xaa at position 126 is Leu, Ala, Val, Gly, or Ile
  SITE (134)..(134): Xaa at position 134 is Leu, Ala, Val, Gly, or Ile
  SITE (135)..(135): Xaa at position 135 is Val, Ala, Gly, Leu, or Ile
  SITE (142)..(142): Xaa at position 142 is Leu, Ala, Val, Gly, or Ile
  SITE (144)..(144): Xaa at position 144 is Ala, Gly, or Pro
  SITE (156)..(156): Xaa at position 156 is Val, Ala, Gly, Leu, or Ile
  SITE (158)..(158): Xaa at position 158 is Phe, Tyr, Met, His, Ile, Leu, Val Ala, or Gly
  SITE (160)..(160): Xaa at position 160 is Met, Ile, Leu, Val, Ala, or Gly
  SITE (163)..(163): Xaa at position 163 is Val, Ala, Gly, Leu, or Ile
  SITE (174)..(174): Xaa at position 174 is Val, Ala, Gly, Leu, or Ile
  SITE (175)..(175): Xaa at position 175 is Ala, Gly, or Pro
  SITE (176)..(176): Xaa at position 176 is Leu, Ala, Val, Gly, or Ile
  SITE (178)..(178): Xaa at position 178 is Leu, Ala, Val, Gly, or Ile
  SITE (185)..(185): Xaa at position 185 is Leu, Ala, Val, Gly, or Ile
  SITE (187)..(187): Xaa at position 187 is Cys, Ala, Val, Gly, Ser, or Thr
  SITE (211)..(211): Xaa at position 211 is Met, Ile, Leu, Val, Ala, or Gly
  SITE (215)..(215): Xaa at position 215 is Phe, Tyr, Met, His, Ile, Leu, Val Ala, or Gly
  SITE (216)..(216): Xaa at position 216 is Val, Ala, Gly, Leu, or Ile
  SITE (217)..(217): Xaa at position 217 is Phe, Tyr, Met, His, Ile, Leu, Val Ala, or Gly
  SITE (226)..(226): Xaa at position 226 is Leu, Ala, Val, Gly, or Ile
  SITE (228)..(228): Xaa at position 228 is Phe, Tyr, Met, His, Ile, Leu, Val Ala, or Gly
  SITE (238)..(238): Xaa at position 238 is Ile, Ala, Val, Leu, or Gly
  SITE (262)..(262): Xaa at position 262 is Phe, Tyr, Met, His, Ile, Leu, Val Ala, or Gly
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNXTXRDSQQKSXXMSGPYEXKXLHLQGQDMEQQXVXSXSFXQGEESNDKIPXXXGXKEKNLYXSXVLKDDKPTLQLESVDPKNYPKKKXEKRXXXNKIEINNKXEXESAQFPNWYXSTSQAENMPVFLGGTKGGQDITDXTMQFVSS

SEQ ID NO: 128 - protein, 193 aa, Homo sapiens
  SITE (39)..(39): Xaa at position 39 is Leu, Ala, Val, Gly, or Ile
  SITE (46)..(46): Xaa at position 46 is Ala, Gly, or Pro
  SITE (49)..(49): Xaa at position 49 is Ala, Gly, or Pro
  SITE (56)..(56): Xaa at position 56 is Cys, Ala, Val, Gly, Ser, or Thr
  SITE (60)..(60): Xaa at position 60 is Cys, Ala, Val, Gly, Ser, or Thr
  SITE (62)..(62): Xaa at position 62 is Leu, Ala, Val, Gly, or Ile
  SITE (68)..(68): Xaa at position 68 is Val, Ala, Gly, Leu, or Ile
  SITE (87)..(87): Xaa at position 87 is Ala, Gly, or Pro
  SITE (90)..(90): Xaa at position 90 is Val, Ala, Gly, Leu, or Ile
  SITE (94)..(94): Xaa at position 94 is Leu, Ala, Val, Gly, or Ile
  SITE (97)..(97): Xaa at position 97 is Leu, Ala, Val, Gly, or Ile
  SITE (100)..(100): Xaa at position 100 is Ala, Gly, or Pro
  SITE (118)..(118): Xaa at position 118 is Leu, Ala, Val, Gly, or Ile
  SITE (122)..(122): Xaa at position 122 is Val, Ala, Gly, Leu, or Ile
  SITE (125)..(125): Xaa at position 125 is Ala, Gly, or Pro
  SITE (129)..(129): Xaa at position 129 is Leu, Ala, Val, Gly, or Ile
  SITE (132)..(132): Xaa at position 132 is Leu, Ala, Val, Gly, or Ile
  SITE (136)..(136): Xaa at position 136 is Leu, Ala, Val, Gly, or Ile
  SITE (141)..(141): Xaa at position 141 is Ala, Gly, or Pro
  SITE (145)..(145): Xaa at position 145 is Ala, Gly, or Pro
  SITE (162)..(162): Xaa at position 162 is Ala, Gly, or Pro
  SITE (168)..(168): Xaa at position 168 is Leu, Ala, Val, Gly, or Ile
  SITE (169)..(169): Xaa at position 169 is Phe, Tyr, Met, His, Ile, Leu, Val Ala, or Gly
  SITE (175)..(175): Xaa at position 175 is Phe, Tyr, Met, His, Ile, Leu, Val Ala, or Gly
  SITE (176)..(176): Xaa at position 176 is Leu, Ala, Val, Gly, or Ile
  SITE (180)..(180): Xaa at position 180 is Leu, Ala, Val, Gly, or Ile
  SITE (183)..(183): Xaa at position 183 is Tyr, Phe, Met, His, Ile, Leu, Val Ala, or Gly
MGVHECPAWLWLLLSLLSLPLGLPVLGAPPRLICDSRVXERYLLEXKEXENITTGXAEHXSXNENITXPDTKVNFYAWKRMEVGQQXVEXWQGXALXSEXVLRGQALLVNSSQPWEPXQLHXDKXVSGXRSXTTLXRALGXQKEXISPPDAASAAPLRTITXDTFRKXXRVYSNXXRGKXKLXTGEACRTGDR

SEQ ID NO: 129 - protein, 272 aa, Homo sapiens
  SITE (38)..(38): Xaa at position 38 is Ala, Gly, or Pro
  SITE (47)..(47): Xaa at position 47 is Leu, Ala, Val, Gly, or Ile
  SITE (67)..(67): Xaa at position 67 is Cys, Ala, Val, Gly, Ser, or Thr
  SITE (80)..(80): Xaa at position 80 is Cys, Ala, Val, Gly, Ser, or Thr
  SITE (125)..(125): Xaa at position 125 is Cys, Ala, Val, Gly, Ser, or Thr
  SITE (143)..(143): Xaa at position 143 is Val, Ala, Gly, Leu, or Ile
  SITE (148)..(148): Xaa at position 148 is Val, Ala, Gly, Leu, or Ile
  SITE (150)..(150): Xaa at position 150 is Tyr, Phe, Met, His, Ile, Leu, Val Ala, or Gly
  SITE (168)..(168): Xaa at position 168 is Cys, Ala, Val, Gly, Ser, or Thr
MDSYLLMWGLLTFIMVPGCQAELCDDDPPEIPHATFKXMAYKEGTMXNCECKRGFRRIKSGSLYMLXTGNSSHSSWDNQXQCTSSATRNTTKQVTPQPEEQKERKTTEMQSPMQPVDQASLPGHXREPPPWENEATERIYHFXVGQMXYXQCVQGYRALHRGPAESVXKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 130 - protein, 458 aa, Homo sapiens
  SITE (39)..(39): Xaa at position 39 is Leu, Ala, Val, Gly, or Ile
  SITE (41)..(41): Xaa at position 41 is Cys, Ala, Val, Gly, Ser, or Thr
  SITE (43)..(43): Xaa at position 43 is Ala, Gly, or Pro
  SITE (51)..(51): Xaa at position 51 is Phe, Tyr, Met, His, Ile, Leu, Val Ala, or Gly
  SITE (53)..(53): Xaa at position 53 is Trp, Tyr, Phe, Met, His, Ile, Leu Val, Ala, or Gly
  SITE (61)..(61): Xaa at position 61 is Ile, Ala, Val, Leu, or Gly
  SITE (62)..(62): Xaa at position 62 is Leu, Ala, Val, Gly, or Ile
  SITE (69)..(69): Xaa at position 69 is Leu, Ala, Val, Gly, or Ile
  SITE (76)..(76): Xaa at position 76 is Leu, Ala, Val, Gly, or Ile
  SITE (80)..(80): Xaa at position 80 is Ala, Gly, or Pro
  SITE (87)..(87): Xaa at position 87 is Trp, Tyr, Phe, Met, His, Ile, Leu Val, Ala, or Gly
  SITE (92)..(92): Xaa at position 92 is Phe, Tyr, Met, His, Ile, Leu, Val Ala, or Gly
  SITE (94)..(94): Xaa at position 94 is Leu, Ala, Val, Gly, or Ile
  SITE (95)..(95): Xaa at position 95 is Ile, Ala, Val, Leu, or Gly
  SITE (96)..(96): Xaa at position 96 is Ile, Ala, Val, Leu, or Gly
  SITE (99)..(99): Xaa at position 99 is Leu, Ala, Val, Gly, or Ile
  SITE (107)..(107): Xaa at position 107 is Tyr, Phe, Met, His, Ile, Leu, Val Ala, or Gly
  SITE (109)..(109): Xaa at position 109 is Cys, Ala, Val, Gly, Ser, or Thr
  SITE (111)..(111): Xaa at position 111 is Val, Ala, Gly, Leu, or Ile
  SITE (118)..(118): Xaa at position 118 is Val, Ala, Gly, Leu, or Ile
  SITE (120)..(120): Xaa at position 120 is Leu, Ala, Val, Gly, or Ile
  SITE (121)..(121): Xaa at position 121 is Leu, Ala, Val, Gly, or Ile
  SITE (122)..(122): Xaa at position 122 is Val, Ala, Gly, Leu, or Ile
  SITE (123)..(123): Xaa at position 123 is Phe, Tyr, Met, His, Ile, Leu, Val Ala, or Gly
  SITE (134)..(134): Xaa at position 134 is Leu, Ala, Val, Gly, or Ile
  SITE (139)..(139): Xaa at position 139 is Leu, Ala, Val, Gly, or Ile
  SITE (141)..(141): Xaa at position 141 is Leu, Ala, Val, Gly, or Ile
  SITE (143)..(143): Xaa at position 143 is Leu, Ala, Val, Gly, or Ile
  SITE (153)..(153): Xaa at position 153 is Val, Ala, Gly, Leu, or Ile
  SITE (155)..(155): Xaa at position 155 is Cys, Ala, Val, Gly, Ser, or Thr
  SITE (169)..(169): Xaa at position 169 is Leu, Ala, Val, Gly, or Ile
  SITE (171)..(171): Xaa at position 171 is Val, Ala, Gly, Leu, or Ile
  SITE (174)..(174): Xaa at position 174 is Leu, Ala, Val, Gly, or Ile
  SITE (182)..(182): Xaa at position 182 is Trp, Tyr, Phe, Met, His, Ile, Leu Val, Ala, or Gly
  SITE (184)..(184): Xaa at position 184 is Cys, Ala, Val, Gly, Ser, or Thr
  SITE (186)..(186): Xaa at position 186 is Val, Ala, Gly, Leu, or Ile
  SITE (199)..(199): Xaa at position 199 is Ile, Ala, Val, Leu, or Gly
  SITE (201)..(201): Xaa at position 201 is Val, Ala, Gly, Leu, or Ile
  SITE (219)..(219): Xaa at position 219 is Val, Ala, Gly, Leu, or Ile
  SITE (221)..(221): Xaa at position 221 is Phe, Tyr, Met, His, Ile, Leu, Val Ala, or Gly
  SITE (223)..(223): Xaa at position 223 is Phe, Tyr, Met, His, Ile, Leu, Val Ala, or Gly
  SITE (238)..(238): Xaa at position 238 is Leu, Ala, Val, Gly, or Ile
  SITE (254)..(254): Xaa at position 254 is Phe, Tyr, Met, His, Ile, Leu, Val Ala, or Gly
  SITE (261)..(261): Xaa at position 261 is Val, Ala, Gly, Leu, or Ile
  SITE (274)..(274): Xaa at position 274 is Met, Ile, Leu, Val, Ala, or Gly
  SITE (282)..(282): Xaa at position 282 is Leu, Ala, Val, Gly, or Ile
  SITE (284)..(284): Xaa at position 284 is Leu, Ala, Val, Gly, or Ile
  SITE (287)..(287): Xaa at position 287 is Ala, Gly, or Pro
  SITE (292)..(292): Xaa at position 292 is Ala, Gly, or Pro
  SITE (297)..(297): Xaa at position 297 is Leu, Ala, Val, Gly, or Ile
  SITE (299)..(299): Xaa at position 299 is Leu, Ala, Val, Gly, or Ile
  SITE (308)..(308): Xaa at position 308 is Leu, Ala, Val, Gly, or Ile
  SITE (312)..(312): Xaa at position 312 is Val, Ala, Gly, Leu, or Ile
  SITE (314)..(314): Xaa at position 314 is Leu, Ala, Val, Gly, or Ile
  SITE (315)..(315): Xaa at position 315 is Val, Ala, Gly, Leu, or Ile
  SITE (316)..(316): Xaa at position 316 is Val, Ala, Gly, Leu, or Ile
  SITE (317)..(317): Xaa at position 317 is Met, Ile, Leu, Val, Ala, or Gly
  SITE (326)..(326): Xaa at position 326 is Leu, Ala, Val, Gly, or Ile
  SITE (328)..(328): Xaa at position 328 is Cys, Ala, Val, Gly, Ser, or Thr
  SITE (330)..(330): Xaa at position 330 is Val, Ala, Gly, Leu, or Ile
  SITE (340)..(340): Xaa at position 340 is Leu, Ala, Val, Gly, or Ile
  SITE (342)..(342): Xaa at position 342 is Leu, Ala, Val, Gly, or Ile
  SITE (358)..(358): Xaa at position 358 is Val, Ala, Gly, Leu, or Ile
  SITE (368)..(368): Xaa at position 368 is Trp, Tyr, Phe, Met, His, Ile, Leu Val, Ala, or Gly
  SITE (370)..(370): Xaa at position 370 is Cys, Ala, Val, Gly, Ser, or Thr
  SITE (372)..(372): Xaa at position 372 is Leu, Ala, Val, Gly, or Ile
MNRGVPFRHLLLVLQLALLPAATQGKKVVLGKKGDTVEXTXTXSQKKSIQXHXKNSNQIKXXGNQGSFXTKGPSKXNDRXDSRRSLXDQGNXPXXXKNXKIEDSDTXIXEXEDQKEEXQXXXXGLTANSDTHLXQGQSXTXTXESPPGSSPSXQXRSPRGKNIQGGKTXSXSQXELQDSGTXTXTXLQNQKKVEFKIDXVXLAFQKASSIVYKKEGEQXEXSXPLAFTVEKLTGSGEXWWQAERASSSKSWITXDLKNKEXSVKRVTQDPKLQXGKKLPLHXTXPQXLPQYXGSGNXTXALEAKTGKXHQEXNXXXXRATQLQKNXTXEXWGPTSPKLMXSXKLENKEAKVSKREKAXWVLNPEAGMXQXLXSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 131 - protein, 428 aa, Homo sapiens
  SITE (131)..(131): Xaa at position 131 is Ile, Ala, Val, Leu, or Gly
  SITE (133)..(133): Xaa at position 133 is Leu, Ala, Val, Gly, or Ile
  SITE (135)..(135): Xaa at position 135 is Cys, Ala, Val, Gly, Ser, or Thr
  SITE (137)..(137): Xaa at position 137 is Val, Ala, Gly, Leu, or Ile
  SITE (149)..(149): Xaa at position 149 is Trp, Tyr, Phe, Met, His, Ile, Leu Val, Ala, or Gly
  SITE (178)..(178): Xaa at position 178 is Leu, Ala, Val, Gly, or Ile
  SITE (185)..(185): Xaa at position 185 is Trp, Tyr, Phe, Met, His, Ile, Leu Val, Ala, or Gly
  SITE (191)..(191): Xaa at position 191 is Tyr, Phe, Met, His, Ile, Leu, Val Ala, or Gly
  SITE (193)..(193): Xaa at position 193 is Cys, Ala, Val, Gly, Ser, or Thr
  SITE (195)..(195): Xaa at position 195 is Val, Ala, Gly, Leu, or Ile
  SITE (237)..(237): Xaa at position 237 is Ile, Ala, Val, Leu, or Gly
  SITE (239)..(239): Xaa at position 239 is Cys, Ala, Val, Gly, Ser, or Thr
  SITE (241)..(241): Xaa at position 241 is Val, Ala, Gly, Leu, or Ile
  SITE (251)..(251): Xaa at position 251 is Val, Ala, Gly, Leu, or Ile
  SITE (280)..(280): Xaa at position 280 is Val, Ala, Gly, Leu, or Ile
  SITE (284)..(284): Xaa at position 284 is Leu, Ala, Val, Gly, or Ile
  SITE (297)..(297): Xaa at position 297 is Tyr, Phe, Met, His, Ile, Leu, Val Ala, or Gly
  SITE (299)..(299): Xaa at position 299 is Cys, Ala, Val, Gly, Ser, or Thr
  SITE (301)..(301): Xaa at position 301 is Val, Ala, Gly, Leu, or Ile
  SITE (310)..(310): Xaa at position 310 is Leu, Ala, Val, Gly, or Ile
  SITE (326)..(326): Xaa at position 326 is Val, Ala, Gly, Leu, or Ile
  SITE (343)..(343): Xaa at position 343 is Leu, Ala, Val, Gly, or Ile
  SITE (345)..(345): Xaa at position 345 is Cys, Ala, Val, Gly, Ser, or Thr
  SITE (347)..(347): Xaa at position 347 is Ile, Ala, Val, Leu, or Gly
  SITE (350)..(350): Xaa at position 350 is Phe, Tyr, Met, His, Ile, Leu, Val Ala, or Gly
  SITE (355)..(355): Xaa at position 355 is Ile, Ala, Val, Leu, or Gly
  SITE (357)..(357): Xaa at position 357 is Val, Ala, Gly, Leu, or Ile
  SITE (359)..(359): Xaa at position 359 is Trp, Tyr, Phe, Met, His, Ile, Leu Val, Ala, or Gly
  SITE (386)..(386): Xaa at position 386 is Val, Ala, Gly, Leu, or Ile
  SITE (390)..(390): Xaa at position 390 is Leu, Ala, Val, Gly, or Ile
  SITE (392)..(392): Xaa at position 392 is Val, Ala, Gly, Leu, or Ile
  SITE (403)..(403): Xaa at position 403 is Phe, Tyr, Met, His, Ile, Leu, Val Ala, or Gly
  SITE (405)..(405): Xaa at position 405 is Cys, Ala, Val, Gly, Ser, or Thr
  SITE (407)..(407): Xaa at position 407 is Ala, Gly, or Pro
  SITE (408)..(408): Xaa at position 408 is Val, Ala, Gly, Leu, or Ile
  SITE (409)..(409): Xaa at position 409 is His, Phe, Tyr, Lys, Arg, Gly, Ser Thr, Ala, Val, Leu, Ile, Asn, Met, or Gln
  SITE (412)..(412): Xaa at position 412 is Ala, Gly, or Pro
  SITE (418)..(418): Xaa at position 418 is Val, Ala, Gly, Leu, or Ile
  SITE (424)..(424): Xaa at position 424 is Val, Ala, Gly, Leu, or Ile
ASTQSPSVFPLTRCCKNIPSNATSVTLGCLATGYFPEPVMVTWDTGSLNGTTMTLPATTLTLSGHYATISLLTVSGAWAKQMFTCRVAHTPSSTDWVDNKTFSVCSRDFTPPTVKILQSSCDGGGHFPPTXQXLXLXSGYTPGTINITXLEDGQVMDVDLSTASTTQEGELASTQSEXTLSQKHXLSDRTXTXQXTYQGHTFEDSTKKCADSNPRGVSAYLSRPSPFDLFIRKSPTXTXLXVDLAPSKGTXNLTWSRASGKPVNHSTRKEEKQRNGTLTXTSTXPVGTRDWIEGETXQXRXTHPHLPRAXMRSTTKTSGPRAAPEXYAFATPEWPGSRDKRTXAXLXQNXMPEDXSXQXLHNEVQLPDARHSTTQPRKTKGSGFFXFSRXEXTRAEWEQKDEXIXRXXXEAXSPSQTXQRAVSXNPGK

SEQ ID NO: 132 - protein, 362 aa, Homo sapiens
  SITE (29)..(29): Xaa at position 29 is Met, Ile, Leu, Val, Ala, or Gly
  SITE (31)..(31): Xaa at position 31 is Tyr, Phe, Met, His, Ile, Leu, Val Ala, or Gly
  SITE (33)..(33): Xaa at position 33 is Tyr, Phe, Met, His, Ile, Leu, Val Ala, or Gly
  SITE (46)..(46): Xaa at position 46 is Phe, Tyr, Met, His, Ile, Leu, Val Ala, or Gly
  SITE (52)..(52): Xaa at position 52 is Val, Ala, Gly, Leu, or Ile
  SITE (57)..(57): Xaa at position 57 is Phe, Tyr, Met, His, Ile, Leu, Val Ala, or Gly
  SITE (58)..(58): Xaa at position 58 is Val, Ala, Gly, Leu, or Ile
  SITE (60)..(60): Xaa at position 60 is Phe, Tyr, Met, His, Ile, Leu, Val Ala, or Gly
  SITE (73)..(73): Xaa at position 73 is Ala, Gly, or Pro
  SITE (75)..(75): Xaa at position 75 is Trp, Tyr, Phe, Met, His, Ile, Leu Val, Ala, or Gly
  SITE (76)..(76): Xaa at position 76 is Ile, Ala, Val, Leu, or Gly
  SITE (83)..(83): Xaa at position 83 is Tyr, Phe, Met, His, Ile, Leu, Val Ala, or Gly
  SITE (91)..(91): Xaa at position 91 is Tyr, Phe, Met, His, Ile, Leu, Val Ala, or Gly
  SITE (95)..(95): Xaa at position 95 is Ala, Gly, or Pro
  SITE (102)..(102): Xaa at position 102 is Leu, Ala, Val, Gly, or Ile
  SITE (105)..(105): Xaa at position 105 is Leu, Ala, Val, Gly, or Ile
  SITE (119)..(119): Xaa at position 119 is Leu, Ala, Val, Gly, or Ile
  SITE (122)..(122): Xaa at position 122 is Met, Ile, Leu, Val, Ala, or Gly
  SITE (125)..(125): Xaa at position 125 is Cys, Ala, Val, Gly, Ser, or Thr
  SITE (127)..(127): Xaa at position 127 is Val, Ala, Gly, Leu, or Ile
  SITE (140)..(140): Xaa at position 140 is Tyr, Phe, Met, His, Ile, Leu, Val Ala, or Gly
  SITE (142)..(142): Xaa at position 142 is Tyr, Phe, Met, His, Ile, Leu, Val Ala, or Gly
  SITE (147)..(147): Xaa at position 147 is Tyr, Phe, Met, His, Ile, Leu, Val Ala, or Gly
  SITE (148)..(148): Xaa at position 148 is Ile, Ala, Val, Leu, or Gly
  SITE (150)..(150): Xaa at position 150 is Leu, Ala, Val, Gly, or Ile
  SITE (154)..(154): Xaa at position 154 is Leu, Ala, Val, Gly, or Ile
  SITE (157)..(157): Xaa at position 157 is Trp, Tyr, Phe, Met, His, Ile, Leu Val, Ala, or Gly
  SITE (163)..(163): Xaa at position 163 is Ala, Gly, or Pro
  SITE (164)..(164): Xaa at position 164 is Ala, Gly, or Pro
  SITE (177)..(177): Xaa at position 177 is Ala, Gly, or Pro
  SITE (184)..(184): Xaa at position 184 is Leu, Ala, Val, Gly, or Ile
  SITE (188)..(188): Xaa at position 188 is Cys, Ala, Val, Gly, Ser, or Thr
  SITE (189)..(189): Xaa at position 189 is Val, Ala, Gly, Leu, or Ile
  SITE (192)..(192): Xaa at position 192 is Leu, Ala, Val, Gly, or Ile
  SITE (195)..(195): Xaa at position 195 is Tyr, Phe, Met, His, Ile, Leu, Val Ala, or Gly
  SITE (196)..(196): Xaa at position 196 is Leu, Ala, Val, Gly, or Ile
  SITE (203)..(203): Xaa at position 203 is Leu, Ala, Val, Gly, or Ile
  SITE (213)..(213): Xaa at position 213 is Val, Ala, Gly, Leu, or Ile
  SITE (223)..(223): Xaa at position 223 is Ala, Gly, or Pro
  SITE (225)..(225): Xaa at position 225 is Leu, Ala, Val, Gly, or Ile
  SITE (227)..(227): Xaa at position 227 is Cys, Ala, Val, Gly, Ser, or Thr
  SITE (229)..(229): Xaa at position 229 is Ala, Gly, or Pro
  SITE (232)..(232): Xaa at position 232 is Phe, Tyr, Met, His, Ile, Leu, Val Ala, or Gly
  SITE (233)..(233): Xaa at position 233 is Tyr, Phe, Met, His, Ile, Leu, Val Ala, or Gly
  SITE (239)..(239): Xaa at position 239 is Leu, Ala, Val, Gly, or Ile
  SITE (241)..(241): Xaa at position 241 is Trp, Tyr, Phe, Met, His, Ile, Leu Val, Ala, or Gly
  SITE (269)..(269): Xaa at position 269 is Ala, Gly, or Pro
  SITE (270)..(270): Xaa at position 270 is Ala, Gly, or Pro
  SITE (271)..(271): Xaa at position 271 is Val, Ala, Gly, Leu, or Ile
  SITE (272)..(272): Xaa at position 272 is Val, Ala, Gly, Leu, or Ile
  SITE (273)..(273): Xaa at position 273 is Val, Ala, Gly, Leu, or Ile
  SITE (281)..(281): Xaa at position 281 is Tyr, Phe, Met, His, Ile, Leu, Val Ala, or Gly
  SITE (283)..(283): Xaa at position 283 is Cys, Ala, Val, Gly, Ser, or Thr
  SITE (285)..(285): Xaa at position 285 is Val, Ala, Gly, Leu, or Ile
  SITE (287)..(287): Xaa at position 287 is His, Phe, Tyr, Lys, Arg, Gly, Ser Thr, Ala, Val, Leu, Ile, Asn, Met, or Gln
MLVMAPRTVLLLLSAALALTETWAGSHSXRXFXTSVSRPGRGEPRXISVGYXDDTQXXRXDSDAASPREEPRXPXXEQEGPEXWDRNTQIXKAQXQTDRESXRNXRGYYNQSEAGSHTXQSXYGXDXGPDGRLLRGHDQXAXDGKDXXAXNEDXRSXTAADTXXQITQRKWEAAREXEQRRAYXEGEXXEWXRRXXENGKDKXERADPPKTHXTHHPISDHEXTXRXWXLGXXPAEITXTXQRDGEDQTQDTELVETRPAGDRTFQKWXXXXXPSGEEQRXTXHXQXEGLPKPLTLRWEPSSQSTVPIVGIVAGLAVLAVVVIGAVVAAVMCRRKSSGGKGGSYSQAACSDSAQGSDVSLTA

SEQ ID NO: 133 - protein, 254 aa, Homo sapiens
  SITE (47)..(47): Xaa at position 47 is Phe, Tyr, Met, His, Ile, Leu, Val Ala, or Gly
  SITE (48)..(48): Xaa at position 48 is Met, Ile, Leu, Val, Ala, or Gly
  SITE (49)..(49): Xaa at position 49 is Phe, Tyr, Met, His, Ile, Leu, Val Ala, or Gly
  SITE (57)..(57): Xaa at position 57 is Phe, Tyr, Met, His, Ile, Leu, Val Ala, or Gly
  SITE (59)..(59): Xaa at position 59 is Val, Ala, Gly, Leu, or Ile
  SITE (77)..(77): Xaa at position 77 is Ala, Gly, or Pro
  SITE (81)..(81): Xaa at position 81 is Ala, Gly, or Pro
  SITE (84)..(84): Xaa at position 84 is Ala, Gly, or Pro
  SITE (86)..(86): Xaa at position 86 is Ala, Gly, or Pro
  SITE (88)..(88): Xaa at position 88 is Ile, Ala, Val, Leu, or Gly
  SITE (130)..(130): Xaa at position 130 is Leu, Ala, Val, Gly, or Ile
  SITE (131)..(131): Xaa at position 131 is Ile, Ala, Val, Leu, or Gly
  SITE (132)..(132): Xaa at position 132 is Cys, Ala, Val, Gly, Ser, or Thr
  SITE (134)..(134): Xaa at position 134 is Ile, Ala, Val, Leu, or Gly
  SITE (137)..(137): Xaa at position 137 is Phe, Tyr, Met, His, Ile, Leu, Val Ala, or Gly
  SITE (146)..(146): Xaa at position 146 is Trp, Tyr, Phe, Met, His, Ile, Leu Val, Ala, or Gly
  SITE (173)..(173): Xaa at position 173 is Phe, Tyr, Met, His, Ile, Leu, Val Ala, or Gly
  SITE (176)..(176): Xaa at position 176 is Leu, Ala, Val, Gly, or Ile
  SITE (179)..(179): Xaa at position 179 is Leu, Ala, Val, Gly, or Ile
  SITE (186)..(186): Xaa at position 186 is Tyr, Phe, Met, His, Ile, Leu, Val Ala, or Gly
  SITE (188)..(188): Xaa at position 188 is Cys, Ala, Val, Gly, Ser, or Thr
  SITE (190)..(190): Xaa at position 190 is Val, Ala, Gly, Leu, or Ile
  SITE (192)..(192): Xaa at position 192 is His, Phe, Tyr, Lys, Arg, Gly, Ser Thr, Ala, Val, Leu, Ile, Asn, Met, or Gln
MAISGVPVLGFFIIAVLMSAQESWAIKEEHVIIQAEFYLNPDQSGEXXXDFDGDEIXHXDMAKKETVWRLEEFGRFXSFEXQGXLXNXAVDKANLEIMTKRSNYTPITNVPPEVTVLTNSPVELREPNVXXXFXDKXTPPVVNVTXLRNGKPVTTGVSETVFLPREDHLFRKXHYXPFXPSTEDVXDXRXEXWGLDEPLLKHWEFDAPSPLPETTENVVCALGLTVGLVGIIIGTIFIIKGVRKSNAAERRGPL

SEQ ID NO: 134 - protein, 255 aa, Homo sapiens
  SITE (50)..(50): Xaa at position 50 is His, Phe, Tyr, Lys, Arg, Gly, Ser Thr, Ala, Val, Leu, Ile, Asn, Met, or Gln
  SITE (58)..(58): Xaa at position 58 is Phe, Tyr, Met, His, Ile, Leu, Val Ala, or Gly
  SITE (60)..(60): Xaa at position 60 is Val, Ala, Gly, Leu, or Ile
  SITE (78)..(78): Xaa at position 78 is Ile, Ala, Val, Leu, or Gly
  SITE (85)..(85): Xaa at position 85 is Ala, Gly, or Pro
  SITE (89)..(89): Xaa at position 89 is Met, Ile, Leu, Val, Ala, or Gly
  SITE (131)..(131): Xaa at position 131 is Leu, Ala, Val, Gly, or Ile
  SITE (132)..(132): Xaa at position 132 is Ile, Ala, Val, Leu, or Gly
  SITE (133)..(133): Xaa at position 133 is Cys, Ala, Val, Gly, Ser, or Thr
  SITE (135)..(135): Xaa at position 135 is Val, Ala, Gly, Leu, or Ile
  SITE (138)..(138): Xaa at position 138 is Ile, Ala, Val, Leu, or Gly
  SITE (147)..(147): Xaa at position 147 is Trp, Tyr, Phe, Met, His, Ile, Leu Val, Ala, or Gly
  SITE (174)..(174): Xaa at position 174 is Ile, Ala, Val, Leu, or Gly
  SITE (177)..(177): Xaa at position 177 is Leu, Ala, Val, Gly, or Ile
  SITE (180)..(180): Xaa at position 180 is Leu, Ala, Val, Gly, or Ile
  SITE (187)..(187): Xaa at position 187 is Tyr, Phe, Met, His, Ile, Leu, Val Ala, or Gly
  SITE (189)..(189): Xaa at position 189 is Cys, Ala, Val, Gly, Ser, or Thr
  SITE (191)..(191): Xaa at position 191 is Val, Ala, Gly, Leu, or Ile
  SITE (193)..(193): Xaa at position 193 is His, Phe, Tyr, Lys, Arg, Gly, Ser Thr, Ala, Val, Leu, Ile, Asn, Met, or Gln
MILNKALLLGALALTAVMSPCGGEDIVADHVASYGVNFYQSHGPSGQYTXEFDGDEEXYXDLETKETVWQLPMFSKFXSFDPQSXLRNXAVGKHTLEFMMRQSNSTAATNEVPEVTVFSKFPVTLGQPNTXXXLXDNXFPPVVNITXLSNGHSVTEGVSETSFLSKSDHSFFKXSYXTFXPSADEIXDXKXEXWGLDEPLLKHWEPEIPAPMSELTETLVCALGLSVGLMGIVVGTVFIIQGLRSVGASRHQGLL

SEQ ID NO: 135 - protein, 254 aa, Homo sapiens
  SITE (50)..(50): Xaa at position 50 is His, Phe, Tyr, Lys, Arg, Gly, Ser Thr, Ala, Val, Leu, Ile, Asn, Met, or Gln
  SITE (58)..(58): Xaa at position 58 is Phe, Tyr, Met, His, Ile, Leu, Val Ala, or Gly
  SITE (60)..(60): Xaa at position 60 is Val, Ala, Gly, Leu, or Ile
  SITE (84)..(84): Xaa at position 84 is Ala, Gly, or Pro
  SITE (88)..(88): Xaa at position 88 is Ile, Ala, Val, Leu, or Gly
  SITE (130)..(130): Xaa at position 130 is Leu, Ala, Val, Gly, or Ile
  SITE (132)..(132): Xaa at position 132 is Cys, Ala, Val, Gly, Ser, or Thr
  SITE (134)..(134): Xaa at position 134 is Val, Ala, Gly, Leu, or Ile
  SITE (137)..(137): Xaa at position 137 is Ile, Ala, Val, Leu, or Gly
  SITE (146)..(146): Xaa at position 146 is Trp, Tyr, Phe, Met, His, Ile, Leu Val, Ala, or Gly
  SITE (173)..(173): Xaa at position 173 is Ile, Ala, Val, Leu, or Gly
  SITE (176)..(176): Xaa at position 176 is Leu, Ala, Val, Gly, or Ile
  SITE (179)..(179): Xaa at position 179 is Leu, Ala, Val, Gly, or Ile
  SITE (186)..(186): Xaa at position 186 is Tyr, Phe, Met, His, Ile, Leu, Val Ala, or Gly
  SITE (188)..(188): Xaa at position 188 is Cys, Ala, Val, Gly, Ser, or Thr
  SITE (190)..(190): Xaa at position 190 is Val, Ala, Gly, Leu, or Ile
  SITE (192)..(192): Xaa at position 192 is His, Phe, Tyr, Lys, Arg, Gly, Ser Thr, Ala, Val, Leu, Ile, Asn, Met, or Gln
MILNKALMLGALALTTVMSPCGGEDIVADHVASYGVNLYQSYGPSGQYTXEFDGDEQXYXDLGRKETVWCLPVLRQFRFDPQFXLTNXAVLKHNLNSLIKRSNSTAATNEVPEVTVFSKSPVTLGQPNIXIXLXDNXFPPVVNITXLSNGHSVTEGVSETSFLSKSDHSFFKXSYXTLXPSAEESXDXKXEXWGLDKPLLKHWEPEIPAPMSELTETVVCALGLSVGLVGIVVGTVFIIRGLRSVGASRHQGPL

SEQ ID NO: 136 - protein, 266 aa, Homo sapiens
  SITE (36)..(36): Xaa at position 36 is Phe, Tyr, Met, His, Ile, Leu, Val Ala, or Gly
  SITE (37)..(37): Xaa at position 37 is Leu, Ala, Val, Gly, or Ile
  SITE (46)..(46): Xaa at position 46 is Phe, Tyr, Met, His, Ile, Leu, Val Ala, or Gly
  SITE (47)..(47): Xaa at position 47 is Phe, Tyr, Met, His, Ile, Leu, Val Ala, or Gly
  SITE (53)..(53): Xaa at position 53 is Val, Ala, Gly, Leu, or Ile
  SITE (55)..(55): Xaa at position 55 is Phe, Tyr, Met, His, Ile, Leu, Val Ala, or Gly
  SITE (56)..(56): Xaa at position 56 is Leu, Ala, Val, Gly, or Ile
  SITE (59)..(59): Xaa at position 59 is Tyr, Phe, Met, His, Ile, Leu, Val Ala, or Gly
  SITE (67)..(67): Xaa at position 67 is Val, Ala, Gly, Leu, or Ile
  SITE (69)..(69): Xaa at position 69 is Phe, Tyr, Met, His, Ile, Leu, Val Ala, or Gly
  SITE (76)..(76): Xaa at position 76 is Phe, Tyr, Met, His, Ile, Leu, Val Ala, or Gly
  SITE (90)..(90): Xaa at position 90 is Trp, Tyr, Phe, Met, His, Ile, Leu Val, Ala, or Gly
  SITE (97)..(97): Xaa at position 97 is Leu, Ala, Val, Gly, or Ile
  SITE (103)..(103): Xaa at position 103 is Ala, Gly, or Pro
  SITE (108)..(108): Xaa at position 108 is Cys, Ala, Val, Gly, Ser, or Thr
  SITE (120)..(120): Xaa at position 120 is Val, Ala, Gly, Leu, or Ile
  SITE (128)..(128): Xaa at position 128 is Val, Ala, Gly, Leu, or Ile
  SITE (138)..(138): Xaa at position 138 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (145)..(145): Xaa at position 145 is Val, Ala, Gly, Leu, or Ile
  SITE (146)..(146): Xaa at position 146 is Cys, Ala, Val, Gly, Ser, or Thr
  SITE (148)..(148): Xaa at position 148 is Val, Ala, Gly, Leu, or Ile
  SITE (151)..(151): Xaa at position 151 is Phe, Tyr, Met, His, Ile, Leu, Val Ala, or Gly
  SITE (160)..(160): Xaa at position 160 is Trp, Tyr, Phe, Met, His, Ile, Leu Val, Ala, or Gly
  SITE (171)..(171): Xaa at position 171 is Met, Ile, Leu, Val, Ala, or Gly
  SITE (190)..(190): Xaa at position 190 is Leu, Ala, Val, Gly, or Ile
  SITE (199)..(199): Xaa at position 199 is Val, Ala, Gly, Leu, or Ile
  SITE (200)..(200): Xaa at position 200 is Tyr, Phe, Met, His, Ile, Leu, Val Ala, or Gly
  SITE (202)..(202): Xaa at position 202 is Cys, Ala, Val, Gly, Ser, or Thr
  SITE (204)..(204): Xaa at position 204 is Val, Ala, Gly, Leu, or Ile
MVCLKLPGGSCMTALTVTLMVLSSPLALSGDTRPRXXWQPKRECHXXNGTERXRXXDRXFYNQEESXRXDSDVGEXRAVTELGRPDAEYXNSQKDIXEQARAXVDTYXRHNYGVVESFTXQRRVQPKXTVYPSKTQPXQHHNXXXXSXSGXYPGSIEVRXFLNGQEEKAGXVSTGLIQNGDWTFQTLVMXETVPRSGEXXTXQXEHPSVTSPLTVEWRARSESAQSKMLSGVGGFVLGLLFLGAGLFIYFRNQKGHSGLQPTGFLS

SEQ ID NO: 137 - protein, 266 aa, Homo sapiens
  SITE (36)..(36): Xaa at position 36 is Phe, Tyr, Met, His, Ile, Leu, Val Ala, or Gly
  SITE (37)..(37): Xaa at position 37 is Leu, Ala, Val, Gly, or Ile
  SITE (46)..(46): Xaa at position 46 is Phe, Tyr, Met, His, Ile, Leu, Val Ala, or Gly
  SITE (47)..(47): Xaa at position 47 is Phe, Tyr, Met, His, Ile, Leu, Val Ala, or Gly
  SITE (53)..(53): Xaa at position 53 is Val, Ala, Gly, Leu, or Ile
  SITE (55)..(55): Xaa at position 55 is Tyr, Phe, Met, His, Ile, Leu, Val Ala, or Gly
  SITE (56)..(56): Xaa at position 56 is Leu, Ala, Val, Gly, or Ile
  SITE (59)..(59): Xaa at position 59 is Tyr, Phe, Met, His, Ile, Leu, Val Ala, or Gly
  SITE (67)..(67): Xaa at position 67 is Val, Ala, Gly, Leu, or Ile
  SITE (69)..(69): Xaa at position 69 is Phe, Tyr, Met, His, Ile, Leu, Val Ala, or Gly
  SITE (76)..(76): Xaa at position 76 is Phe, Tyr, Met, His, Ile, Leu, Val Ala, or Gly
  SITE (90)..(90): Xaa at position 90 is Trp, Tyr, Phe, Met, His, Ile, Leu Val, Ala, or Gly
  SITE (97)..(97): Xaa at position 97 is Leu, Ala, Val, Gly, or Ile
  SITE (108)..(108): Xaa at position 108 is Cys, Ala, Val, Gly, Ser, or Thr
  SITE (120)..(120): Xaa at position 120 is Val, Ala, Gly, Leu, or Ile
  SITE (128)..(128): Xaa at position 128 is Val, Ala, Gly, Leu, or Ile
  SITE (138)..(138): Xaa at position 138 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (145)..(145): Xaa at position 145 is Val, Ala, Gly, Leu, or Ile
  SITE (146)..(146): Xaa at position 146 is Cys, Ala, Val, Gly, Ser, or Thr
  SITE (148)..(148): Xaa at position 148 is Val, Ala, Gly, Leu, or Ile
  SITE (151)..(151): Xaa at position 151 is Phe, Tyr, Met, His, Ile, Leu, Val Ala, or Gly
  SITE (160)..(160): Xaa at position 160 is Trp, Tyr, Phe, Met, His, Ile, Leu Val, Ala, or Gly
  SITE (171)..(171): Xaa at position 171 is Val, Ala, Gly, Leu, or Ile
  SITE (190)..(190): Xaa at position 190 is Leu, Ala, Val, Gly, or Ile
  SITE (199)..(199): Xaa at position 199 is Val, Ala, Gly, Leu, or Ile
  SITE (200)..(200): Xaa at position 200 is Tyr, Phe, Met, His, Ile, Leu, Val Ala, or Gly
  SITE (202)..(202): Xaa at position 202 is Cys, Ala, Val, Gly, Ser, or Thr
  SITE (204)..(204): Xaa at position 204 is Val, Ala, Gly, Leu, or Ile
MVCLRLPGGSCMAVLTVTLMVLSSPLALAGDTRPRXXEYSTSECHXXNGTERXRXXDRXFHNQEENXRXDSDVGEXRAVTELGRPDAEYXNSQKDLXEQKRGRVDNYXRHNYGVVESFTXQRRVHPKXTVYPSKTQPXQHHNXXXXSXSGXYPGSIEVRXFRNGQEEKTGXVSTGLIHNGDWTFQTLVMXETVPRSGEXXTXQXEHPSVTSPLTVEWRARSESAQSKMLSGVGGFVLGLLFLGAGLFIYFRNQKGHSGLQPRGFLS

SEQ ID NO: 138 - protein, 261 aa, Homo sapiens
  SITE (39)..(39): Xaa at position 39 is Phe, Tyr, Met, His, Ile, Leu, Val Ala, or Gly
  SITE (40)..(40): Xaa at position 40 is Val, Ala, Gly, Leu, or Ile
  SITE (49)..(49): Xaa at position 49 is Phe, Tyr, Met, His, Ile, Leu, Val Ala, or Gly
  SITE (56)..(56): Xaa at position 56 is Val, Ala, Gly, Leu, or Ile
  SITE (58)..(58): Xaa at position 58 is Tyr, Phe, Met, His, Ile, Leu, Val Ala, or Gly
  SITE (59)..(59): Xaa at position 59 is Val, Ala, Gly, Leu, or Ile
  SITE (62)..(62): Xaa at position 62 is Tyr, Phe, Met, His, Ile, Leu, Val Ala, or Gly
  SITE (70)..(70): Xaa at position 70 is Ala, Gly, or Pro
  SITE (72)..(72): Xaa at position 72 is Phe, Tyr, Met, His, Ile, Leu, Val Ala, or Gly
  SITE (79)..(79): Xaa at position 79 is Tyr, Phe, Met, His, Ile, Leu, Val Ala, or Gly
  SITE (93)..(93): Xaa at position 93 is Trp, Tyr, Phe, Met, His, Ile, Leu Val, Ala, or Gly
  SITE (100)..(100): Xaa at position 100 is Leu, Ala, Val, Gly, or Ile
  SITE (111)..(111): Xaa at position 111 is Cys, Ala, Val, Gly, Ser, or Thr
  SITE (123)..(123): Xaa at position 123 is Leu, Ala, Val, Gly, or Ile
  SITE (131)..(131): Xaa at position 131 is Val, Ala, Gly, Leu, or Ile
  SITE (141)..(141): Xaa at position 141 is Leu, Ala, Val, Gly, or Ile
  SITE (146)..(146): Xaa at position 146 is Leu, Ala, Val, Gly, or Ile
  SITE (147)..(147): Xaa at position 147 is Leu, Ala, Val, Gly, or Ile
  SITE (148)..(148): Xaa at position 148 is Val, Ala, Gly, Leu, or Ile
  SITE (149)..(149): Xaa at position 149 is Cys, Ala, Val, Gly, Ser, or Thr
  SITE (151)..(151): Xaa at position 151 is Val, Ala, Gly, Leu, or Ile
  SITE (154)..(154): Xaa at position 154 is Phe, Tyr, Met, His, Ile, Leu, Val Ala, or Gly
  SITE (163)..(163): Xaa at position 163 is Trp, Tyr, Phe, Met, His, Ile, Leu Val, Ala, or Gly
  SITE (174)..(174): Xaa at position 174 is Val, Ala, Gly, Leu, or Ile
  SITE (193)..(193): Xaa at position 193 is Leu, Ala, Val, Gly, or Ile
  SITE (202)..(202): Xaa at position 202 is Val, Ala, Gly, Leu, or Ile
  SITE (203)..(203): Xaa at position 203 is Tyr, Phe, Met, His, Ile, Leu, Val Ala, or Gly
  SITE (205)..(205): Xaa at position 205 is Cys, Ala, Val, Gly, Ser, or Thr
  SITE (207)..(207): Xaa at position 207 is Val, Ala, Gly, Leu, or Ile
MSWKKALRIPGGLRAATVTLMLAMLSTPVAEGRDSPEDXXYQFKAMCYXTNGTERXRXXTRXIYNREEYXRXDSDVEVXRAVTPLGPPDAEYXNSQKEVXERTRAELDTVXRHNYQLELRTTXQRRVEPTXTISPSRTEAXNHHNXXXXSXTDXYPAQIKVRXFRNDQEETTGXVSTPLIRNGDWTFQILVMXEMTPQHGDXXTXHXEHPSLQNPITVEWRAQSESAQSKMLSGIGGFVLGLIFLGLGLIIHHRSQKGLLH

SEQ ID NO: 139 - protein, 1464 aa, Homo sapiens
  SITE (63)..(63): Xaa at position 63 is Cys, Ala, Val, Gly, Ser, or Thr
MFSFVDLRLLLLLAATALLTHGQEEGQVEGQDEDIPPITCVQNGLRYHDRDVWKPEPCRICVXDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 140 - protein, 1487 aa, Homo sapiens
  SITE (57)..(57): Xaa at position 57 is Cys, Ala, Val, Gly, Ser, or Thr
MIRLGAPQTLVLLTLLVAAVLRCQGQDVQEAGSCVQDGQRYNDKDVWKPEPCRICVXDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 141 - protein, 1466 aa, Homo sapiens
  SITE (55)..(55): Xaa at position 55 is Cys, Ala, Val, Gly, Ser, or Thr
  SITE (1262)..(1262): Xaa at position 1262 is Cys, Ala, Val, Gly, Ser, or Thr
  SITE (1265)..(1265): Xaa at position 1265 is Leu, Ala, Val, Gly, or Ile
  SITE (1279)..(1279): Xaa at position 1279 is Val, Ala, Gly, Leu, or Ile
  SITE (1290)..(1290): Xaa at position 1290 is Ile, Ala, Val, Leu, or Gly
  SITE (1294)..(1294): Xaa at position 1294 is Cys, Ala, Val, Gly, Ser, or Thr
  SITE (1303)..(1303): Xaa at position 1303 is Ile, Ala, Val, Leu, or Gly
  SITE (1310)..(1310): Xaa at position 1310 is Val, Ala, Gly, Leu, or Ile
  SITE (1326)..(1326): Xaa at position 1326 is Val, Ala, Gly, Leu, or Ile
  SITE (1328)..(1328): Xaa at position 1328 is Phe, Tyr, Met, His, Ile, Leu Val, Ala, or Gly
  SITE (1364)..(1364): Xaa at position 1364 is Ala, Gly, or Pro
  SITE (1368)..(1368): Xaa at position 1368 is Ile, Ala, Val, Leu, or Gly
  SITE (1370)..(1370): Xaa at position 1370 is Tyr, Phe, Met, His, Ile, Leu Val, Ala, or Gly
  SITE (1377)..(1377): Xaa at position 1377 is Ala, Gly, or Pro
  SITE (1390)..(1390): Xaa at position 1390 is Leu, Ala, Val, Gly, or Ile
  SITE (1392)..(1392): Xaa at position 1392 is Leu, Ala, Val, Gly, or Ile
  SITE (1400)..(1400): Xaa at position 1400 is Phe, Tyr, Met, His, Ile, Leu Val, Ala, or Gly
  SITE (1417)..(1417): Xaa at position 1417 is Cys, Ala, Val, Gly, Ser, or Thr
  SITE (1429)..(1429): Xaa at position 1429 is Phe, Tyr, Met, His, Ile, Leu Val, Ala, or Gly
  SITE (1431)..(1431): Xaa at position 1431 is Tyr, Phe, Met, His, Ile, Leu Val, Ala, or Gly
  SITE (1439)..(1439): Xaa at position 1439 is Leu, Ala, Val, Gly, or Ile
  SITE (1441)..(1441): Xaa at position 1441 is Ile, Ala, Val, Leu, or Gly
  SITE (1444)..(1444): Xaa at position 1444 is Ile, Ala, Val, Leu, or Gly
  SITE (1445)..(1445): Xaa at position 1445 is Ala, Gly, or Pro
  SITE (1458)..(1458): Xaa at position 1458 is Val, Ala, Gly, Leu, or Ile
  SITE (1463)..(1463): Xaa at position 1463 is Val, Ala, Gly, Leu, or Ile
  SITE (1465)..(1465): Xaa at position 1465 is Phe, Tyr, Met, His, Ile, Leu Val, Ala, or Gly
MMSFVQKGSWLLLALLHPTIILAQQEAVEGGCSHLGQSYADRDVWKPEPCQICVXDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNXRDXKFCHPELKSGEYWXDPNQGCKLDAXKVFXNMETGETCXSANPLNXPRKHWWTDSSAEKKHXWXGESMDGGFQFSYGNPELPEDVLDVHLAFLRLLSSRXSQNXTXHCKNSIXYMDQASGNVKKAXKXMGSNEGEXKAEGNSKFTYTVLEDGXTKHTGEWSKTVXEXRTRKAVRXPXVDXXPYDIGGPDQEFGXDVGPXCXL

SEQ ID NO: 142 - protein, 1669 aa, Homo sapiens
  SITE (1448)..(1448): Xaa at position 1448 is Val, Ala, Gly, Leu, or Ile
  SITE (1474)..(1474): Xaa at position 1474 is Leu, Ala, Val, Gly, or Ile
  SITE (1475)..(1475): Xaa at position 1475 is Tyr, Phe, Met, His, Ile, Leu Val, Ala, or Gly
  SITE (1487)..(1487): Xaa at position 1487 is Leu, Ala, Val, Gly, or Ile
  SITE (1521)..(1521): Xaa at position 1521 is Tyr, Phe, Met, His, Ile, Leu Val, Ala, or Gly
  SITE (1522)..(1522): Xaa at position 1522 is Trp, Tyr, Phe, Met, His, Ile Leu, Val, Ala, or Gly
  SITE (1523)..(1523): Xaa at position 1523 is Leu, Ala, Val, Gly, or Ile
  SITE (1545)..(1545): Xaa at position 1545 is Ile, Ala, Val, Leu, or Gly
  SITE (1548)..(1548): Xaa at position 1548 is Cys, Ala, Val, Gly, Ser, or Thr
  SITE (1549)..(1549): Xaa at position 1549 is Ala, Gly, or Pro
  SITE (1550)..(1550): Xaa at position 1550 is Val, Ala, Gly, Leu, or Ile
  SITE (1551)..(1551): Xaa at position 1551 is Cys, Ala, Val, Gly, Ser, or Thr
  SITE (1553)..(1553): Xaa at position 1553 is Ala, Gly, or Pro
  SITE (1583)..(1583): Xaa at position 1583 is Phe, Tyr, Met, His, Ile, Leu Val, Ala, or Gly
  SITE (1586)..(1586): Xaa at position 1586 is His, Phe, Tyr, Lys, Arg, Gly Ser, Thr, Ala, Val, Leu, Ile, Asn, Met, or Gln
  SITE (1604)..(1604): Xaa at position 1604 is Cys, Ala, Val, Gly, Ser, or Thr
  SITE (1613)..(1613): Xaa at position 1613 is Phe, Tyr, Met, His, Ile, Leu Val, Ala, or Gly
  SITE (1614)..(1614): Xaa at position 1614 is Ile, Ala, Val, Leu, or Gly
  SITE (1616)..(1616): Xaa at position 1616 is Cys, Ala, Val, Gly, Ser, or Thr
  SITE (1622)..(1622): Xaa at position 1622 is Cys, Ala, Val, Gly, Ser, or Thr
  SITE (1662)..(1662): Xaa at position 1662 is Cys, Ala, Val, Gly, Ser, or Thr
  SITE (1664)..(1664): Xaa at position 1664 is Val, Ala, Gly, Leu, or Ile
  SITE (1665)..(1665): Xaa at position 1665 is Cys, Ala, Val, Gly, Ser, or Thr
  SITE (1666)..(1666): Xaa at position 1666 is Met, Ile, Leu, Val, Ala, or Gly
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLXTRHSQTIDDPQCPSGTKILYHGYSLXXVQGNERAHGQDXGTAGSCLRKFSTMPFLFCNINNVCNFASRNDYSXXXSTPEPMPMSMAPITGENIRPFXSRXXXXEXPAMVMAVHSQTIQIPPCPSGWSSLWIGYSXVMXTSAGAEGSGQALASPGSXLEEFRSAPXXEXHGRGTXNYYANAYSFWLATIERSEMFKKPTPSTLKAGELRTHVSRXQXXXRRT

SEQ ID NO: 143 - protein, 173 aa, Homo sapiens
  SITE (75)..(75): Xaa at position 75 is Leu, Ala, Val, Gly, or Ile
  SITE (77)..(77): Xaa at position 77 is Val, Ala, Gly, Leu, or Ile
  SITE (94)..(94): Xaa at position 94 is Val, Ala, Gly, Leu, or Ile
  SITE (96)..(96): Xaa at position 96 is Ile, Ala, Val, Leu, or Gly
  SITE (124)..(124): Xaa at position 124 is Val, Ala, Gly, Leu, or Ile
  SITE (129)..(129): Xaa at position 129 is Leu, Ala, Val, Gly, or Ile
  SITE (139)..(139): Xaa at position 139 is Leu, Ala, Val, Gly, or Ile
  SITE (141)..(141): Xaa at position 141 is Phe, Tyr, Met, His, Ile, Leu, Val Ala, or Gly
MDVTIQHPWFKRTLGPFYPSRLFDQFFGEGLFEYDLLPFLSSTISPYYRQSLFRTVLDSGISEVRSDRDKFVIFXDXKHFSPEDLTVKVQDDFXEXHGKHNERQDDHGYISREFHRRYRLPSNXDQSAXSCSLSADGMXTXCGPKIQTGLDATHAERAIPVSREEKPTSAPSS

SEQ ID NO: 144 - protein, 267 aa, Homo sapiens
  SITE (35)..(35): Xaa at position 35 is Val, Ala, Gly, Leu, or Ile
  SITE (38)..(38): Xaa at position 38 is Leu, Ala, Val, Gly, or Ile
  SITE (39)..(39): Xaa at position 39 is Ala, Gly, or Pro
  SITE (42)..(42): Xaa at position 42 is Tyr, Phe, Met, His, Ile, Leu, Val Ala, or Gly
  SITE (46)..(46): Xaa at position 46 is Leu, Ala, Val, Gly, or Ile
  SITE (53)..(53): Xaa at position 53 is Tyr, Phe, Met, His, Ile, Leu, Val Ala, or Gly
  SITE (57)..(57): Xaa at position 57 is Phe, Tyr, Met, His, Ile, Leu, Val Ala, or Gly
  SITE (106)..(106): Xaa at position 106 is Leu, Ala, Val, Gly, or Ile
  SITE (117)..(117): Xaa at position 117 is Val, Ala, Gly, Leu, or Ile
  SITE (138)..(138): Xaa at position 138 is Leu, Ala, Val, Gly, or Ile
  SITE (139)..(139): Xaa at position 139 is Tyr, Phe, Met, His, Ile, Leu, Val Ala, or Gly
  SITE (198)..(198): Xaa at position 198 is Leu, Ala, Val, Gly, or Ile
MKAAVLTLAVLFLTGSQARHFWQQDEPPQSPWDRXKDXXTVXVDVXKDSGRDXVSQXEGSALGKQLNLKLLDNWDSVTSTFSKLREQLGPVTQEFWDNLEKETEGXRQEMSKDLEEXKAKVQPYLDDFQKKWQEEMEXXRQKVEPLRAELQEGARQKLHELQEKLSPLGEEMRDRARAHVDALRTHLAPYSDELRQRXAARLEALKENGGARLAEYHAKATEHLSTLSEKAKPALEDLRQGLLPVLESFKVSFLSALEEYTKKLNTQ

SEQ ID NO: 145 - protein, 317 aa, Homo sapiens
  SITE (44)..(44): Xaa at position 44 is Trp, Tyr, Phe, Met, His, Ile, Leu Val, Ala, or Gly
  SITE (47)..(47): Xaa at position 47 is Ala, Gly, or Pro
  SITE (51)..(51): Xaa at position 51 is Phe, Tyr, Met, His, Ile, Leu, Val Ala, or Gly
  SITE (55)..(55): Xaa at position 55 is Leu, Ala, Val, Gly, or Ile
  SITE (58)..(58): Xaa at position 58 is Val, Ala, Gly, Leu, or Ile
  SITE (65)..(65): Xaa at position 65 is Val, Ala, Gly, Leu, or Ile
  SITE (69)..(69): Xaa at position 69 is Leu, Ala, Val, Gly, or Ile
  SITE (70)..(70): Xaa at position 70 is Leu, Ala, Val, Gly, or Ile
  SITE (74)..(74): Xaa at position 74 is Val, Ala, Gly, Leu, or Ile
  SITE (78)..(78): Xaa at position 78 is Leu, Ala, Val, Gly, or Ile
  SITE (86)..(86): Xaa at position 86 is Met, Ile, Leu, Val, Ala, or Gly
  SITE (89)..(89): Xaa at position 89 is Leu, Ala, Val, Gly, or Ile
  SITE (96)..(96): Xaa at position 96 is Leu, Ala, Val, Gly, or Ile
  SITE (100)..(100): Xaa at position 100 is Leu, Ala, Val, Gly, or Ile
  SITE (109)..(109): Xaa at position 109 is Ala, Gly, or Pro
  SITE (111)..(111): Xaa at position 111 is Leu, Ala, Val, Gly, or Ile
  SITE (115)..(115): Xaa at position 115 is Leu, Ala, Val, Gly, or Ile
  SITE (117)..(117): Xaa at position 117 is Ala, Gly, or Pro
  SITE (118)..(118): Xaa at position 118 is Ala, Gly, or Pro
  SITE (122)..(122): Xaa at position 122 is Leu, Ala, Val, Gly, or Ile
  SITE (126)..(126): Xaa at position 126 is Met, Ile, Leu, Val, Ala, or Gly
  SITE (129)..(129): Xaa at position 129 is Val, Ala, Gly, Leu, or Ile
  SITE (130)..(130): Xaa at position 130 is Cys, Ala, Val, Gly, Ser, or Thr
  SITE (133)..(133): Xaa at position 133 is Leu, Ala, Val, Gly, or Ile
  SITE (136)..(136): Xaa at position 136 is Tyr, Phe, Met, His, Ile, Leu, Val Ala, or Gly
  SITE (144)..(144): Xaa at position 144 is Leu, Ala, Val, Gly, or Ile
  SITE (151)..(151): Xaa at position 151 is Leu, Ala, Val, Gly, or Ile
  SITE (153)..(153): Xaa at position 153 is Val, Ala, Gly, Leu, or Ile
  SITE (155)..(155): Xaa at position 155 is Leu, Ala, Val, Gly, or Ile
  SITE (156)..(156): Xaa at position 156 is Ala, Gly, or Pro
  SITE (159)..(159): Xaa at position 159 is Leu, Ala, Val, Gly, or Ile
  SITE (162)..(162): Xaa at position 162 is Leu, Ala, Val, Gly, or Ile
  SITE (166)..(166): Xaa at position 166 is Leu, Ala, Val, Gly, or Ile
  SITE (173)..(173): Xaa at position 173 is Leu, Ala, Val, Gly, or Ile
  SITE (177)..(177): Xaa at position 177 is Leu, Ala, Val, Gly, or Ile
  SITE (180)..(180): Xaa at position 180 is Tyr, Phe, Met, His, Ile, Leu, Val Ala, or Gly
  SITE (194)..(194): Xaa at position 194 is Ala, Gly, or Pro
  SITE (247)..(247): Xaa at position 247 is Leu, Ala, Val, Gly, or Ile
  SITE (270)..(270): Xaa at position 270 is Leu, Ala, Val, Gly, or Ile
  SITE (298)..(298): Xaa at position 298 is Val, Ala, Gly, Leu, or Ile
MKVLWAALLVTFLAGCQAKVEQAVETEPEPELRQQTEWQSGQRXELXLGRXWDYXRWXQTLSEQXQEEXXSSQXTQEXRALMDETXKEXKAYKSEXEEQXTPVAEETRXRXSKEXQXXQARXGADXEDXXGRXVQXRGEVQAMXGQSTEEXRXRXXSHXRKXRKRXLRDADDXQKRXAVXQAGAREGAERGLSXIRERLGPLVEQGRVRAATVGSLAGQPLQERAQAWGERLRARMEEMGSRTRDRXDEVKEQVAEVRAKLEEQAQQIRXQAEAFQARLKSWFEPLVEDMQRQWAGLXEKVQAAVGTSAAPVPSDNH

SEQ ID NO: 146 - protein, 866 aa, Homo sapiens
  SITE (675)..(675): Xaa at position 675 is Ile, Ala, Val, Leu, or Gly
  SITE (692)..(692): Xaa at position 692 is Tyr, Phe, Met, His, Ile, Leu, Val Ala, or Gly
  SITE (708)..(708): Xaa at position 708 is Trp, Tyr, Phe, Met, His, Ile, Leu Val, Ala, or Gly
  SITE (714)..(714): Xaa at position 714 is Leu, Ala, Val, Gly, or Ile
  SITE (724)..(724): Xaa at position 724 is Leu, Ala, Val, Gly, or Ile
  SITE (726)..(726): Xaa at position 726 is Val, Ala, Gly, Leu, or Ile
  SITE (728)..(728): Xaa at position 728 is Leu, Ala, Val, Gly, or Ile
  SITE (738)..(738): Xaa at position 738 is Ala, Gly, or Pro
  SITE (740)..(740): Xaa at position 740 is Tyr, Phe, Met, His, Ile, Leu, Val Ala, or Gly
  SITE (744)..(744): Xaa at position 744 is Val, Ala, Gly, Leu, or Ile
  SITE (751)..(751): Xaa at position 751 is Tyr, Phe, Met, His, Ile, Leu, Val Ala, or Gly
  SITE (753)..(753): Xaa at position 753 is Leu, Ala, Val, Gly, or Ile
  SITE (762)..(762): Xaa at position 762 is Ala, Gly, or Pro
  SITE (765)..(765): Xaa at position 765 is Ala, Gly, or Pro
  SITE (780)..(780): Xaa at position 780 is His, Phe, Tyr, Lys, Arg, Gly, Ser Thr, Ala, Val, Leu, Ile, Asn, Met, or Gln
  SITE (785)..(785): Xaa at position 785 is Phe, Tyr, Met, His, Ile, Leu, Val Ala, or Gly
  SITE (799)..(799): Xaa at position 799 is Cys, Ala, Val, Gly, Ser, or Thr
  SITE (800)..(800): Xaa at position 800 is Ala, Gly, or Pro
  SITE (807)..(807): Xaa at position 807 is Trp, Tyr, Phe, Met, His, Ile, Leu Val, Ala, or Gly
  SITE (809)..(809): Xaa at position 809 is Tyr, Phe, Met, His, Ile, Leu, Val Ala, or Gly
  SITE (815)..(815): Xaa at position 815 is Ala, Gly, or Pro
  SITE (817)..(817): Xaa at position 817 is Leu, Ala, Val, Gly, or Ile
  SITE (841)..(841): Xaa at position 841 is Val, Ala, Gly, Leu, or Ile
  SITE (843)..(843): Xaa at position 843 is Trp, Tyr, Phe, Met, His, Ile, Leu Val, Ala, or Gly
  SITE (853)..(853): Xaa at position 853 is Leu, Ala, Val, Gly, or Ile
  SITE (856)..(856): Xaa at position 856 is Val, Ala, Gly, Leu, or Ile
  SITE (858)..(858): Xaa at position 858 is Met, Ile, Leu, Val, Ala, or Gly
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLXQQRMDGSLNFNRTWQDXKRGFGSLNDEGEGEFXLGNDYXHLLTQRGSVXRXEXEDWAGNEAYXEXHFRXGSEAEGXAXQVSSYEGTXGDXLIEGSVEEGAEYTSXNNMQXSTFDRDADQWEENXXEVYGGGXWXNNCQAXNXNGIYYPGGSYDPRNNSPYEIENGXVXVSFRGADYSXRAXRXKIRPLVTQ

SEQ ID NO: 147 - protein, 491 aa, Homo sapiens
  SITE (241)..(241): Xaa at position 241 is Cys, Ala, Val, Gly, Ser, or Thr
  SITE (244)..(244): Xaa at position 244 is Ile, Ala, Val, Leu, or Gly
  SITE (254)..(254): Xaa at position 254 is Met, Ile, Leu, Val, Ala, or Gly
  SITE (255)..(255): Xaa at position 255 is Tyr, Phe, Met, His, Ile, Leu, Val Ala, or Gly
  SITE (257)..(257): Xaa at position 257 is Ile, Ala, Val, Leu, or Gly
  SITE (268)..(268): Xaa at position 268 is Val, Ala, Gly, Leu, or Ile
  SITE (270)..(270): Xaa at position 270 is Cys, Ala, Val, Gly, Ser, or Thr
  SITE (279)..(279): Xaa at position 279 is Trp, Tyr, Phe, Met, His, Ile, Leu Val, Ala, or Gly
  SITE (282)..(282): Xaa at position 282 is Ile, Ala, Val, Leu, or Gly
  SITE (292)..(292): Xaa at position 292 is Phe, Tyr, Met, His, Ile, Leu, Val Ala, or Gly
  SITE (299)..(299): Xaa at position 299 is Tyr, Phe, Met, His, Ile, Leu, Val Ala, or Gly
  SITE (316)..(316): Xaa at position 316 is Cys, Ala, Val, Gly, Ser, or Thr
  SITE (322)..(322): Xaa at position 322 is Tyr, Phe, Met, His, Ile, Leu, Val Ala, or Gly
  SITE (323)..(323): Xaa at position 323 is Trp, Tyr, Phe, Met, His, Ile, Leu Val, Ala, or Gly
  SITE (329)..(329): Xaa at position 329 is Ile, Ala, Val, Leu, or Gly
  SITE (340)..(340): Xaa at position 340 is Leu, Ala, Val, Gly, or Ile
  SITE (341)..(341): Xaa at position 341 is Leu, Ala, Val, Gly, or Ile
  SITE (342)..(342): Xaa at position 342 is Ile, Ala, Val, Leu, or Gly
  SITE (344)..(344): Xaa at position 344 is Met, Ile, Leu, Val, Ala, or Gly
  SITE (354)..(354): Xaa at position 354 is Ala, Gly, or Pro
  SITE (355)..(355): Xaa at position 355 is His, Phe, Tyr, Lys, Arg, Gly, Ser Thr, Ala, Val, Leu, Ile, Asn, Met, or Gln
  SITE (356)..(356): Xaa at position 356 is Tyr, Phe, Met, His, Ile, Leu, Val Ala, or Gly
  SITE (359)..(359): Xaa at position 359 is Phe, Tyr, Met, His, Ile, Leu, Val Ala, or Gly
  SITE (361)..(361): Xaa at position 361 is Val, Ala, Gly, Leu, or Ile
  SITE (368)..(368): Xaa at position 368 is Tyr, Phe, Met, His, Ile, Leu, Val Ala, or Gly
  SITE (372)..(372): Xaa at position 372 is Val, Ala, Gly, Leu, or Ile
  SITE (379)..(379): Xaa at position 379 is Ala, Gly, or Pro
  SITE (382)..(382): Xaa at position 382 is Ala, Gly, or Pro
  SITE (383)..(383): Xaa at position 383 is Leu, Ala, Val, Gly, or Ile
  SITE (387)..(387): Xaa at position 387 is Ala, Gly, or Pro
  SITE (400)..(400): Xaa at position 400 is His, Phe, Tyr, Lys, Arg, Gly, Ser Thr, Ala, Val, Leu, Ile, Asn, Met, or Gln
  SITE (405)..(405): Xaa at position 405 is Phe, Tyr, Met, His, Ile, Leu, Val Ala, or Gly
  SITE (424)..(424): Xaa at position 424 is Cys, Ala, Val, Gly, Ser, or Thr
  SITE (432)..(432): Xaa at position 432 is Trp, Tyr, Phe, Met, His, Ile, Leu Val, Ala, or Gly
  SITE (433)..(433): Xaa at position 433 is Trp, Tyr, Phe, Met, His, Ile, Leu Val, Ala, or Gly
  SITE (434)..(434): Xaa at position 434 is Tyr, Phe, Met, His, Ile, Leu, Val Ala, or Gly
  SITE (439)..(439): Xaa at position 439 is Ala, Gly, or Pro
  SITE (440)..(440): Xaa at position 440 is Ala, Gly, or Pro
  SITE (447)..(447): Xaa at position 447 is Tyr, Phe, Met, His, Ile, Leu, Val Ala, or Gly
  SITE (452)..(452): Xaa at position 452 is Tyr, Phe, Met, His, Ile, Leu, Val Ala, or Gly
  SITE (465)..(465): Xaa at position 465 is Val, Ala, Gly, Leu, or Ile
  SITE (466)..(466): Xaa at position 466 is Val, Ala, Gly, Leu, or Ile
  SITE (467)..(467): Xaa at position 467 is Trp, Tyr, Phe, Met, His, Ile, Leu Val, Ala, or Gly
  SITE (477)..(477): Xaa at position 477 is Met, Ile, Leu, Val, Ala, or Gly
  SITE (480)..(480): Xaa at position 480 is Met, Ile, Leu, Val, Ala, or Gly
  SITE (482)..(482): Xaa at position 482 is Met, Ile, Leu, Val, Ala, or Gly
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKEXEEXIRKGGETSEXXLXQPDSSVKPYRXYXDMNTENGGXTVXQNRQDGSVDXGRKWDPXKQGFGNVATNTDGKNYXGLPGEXXLGNDKXSQLTRMGPTEXXXEXEDWKGDKVKXXXGGXTXQNEANKXQISXNKYRGTXGNXXMDGXSQLMGENRTMTIXNGMFXSTYDRDNDGWLTSDPRKQXSKEDGGGXXXNRCHXXNPNGRYXWGGQXTWDMAKHGTDDGXXXMNWKGSWYSXRKXSXKIRPFFPQQ

SEQ ID NO: 148 - protein, 453 aa, Homo sapiens
  SITE (179)..(179): Xaa at position 179 is Cys, Ala, Val, Gly, Ser, or Thr
  SITE (182)..(182): Xaa at position 182 is Ile, Ala, Val, Leu, or Gly
  SITE (193)..(193): Xaa at position 193 is Tyr, Phe, Met, His, Ile, Leu, Val Ala, or Gly
  SITE (195)..(195): Xaa at position 195 is Ile, Ala, Val, Leu, or Gly
  SITE (206)..(206): Xaa at position 206 is Val, Ala, Gly, Leu, or Ile
  SITE (208)..(208): Xaa at position 208 is Cys, Ala, Val, Gly, Ser, or Thr
  SITE (219)..(219): Xaa at position 219 is Val, Ala, Gly, Leu, or Ile
  SITE (220)..(220): Xaa at position 220 is Phe, Tyr, Met, His, Ile, Leu, Val Ala, or Gly
  SITE (237)..(237): Xaa at position 237 is Tyr, Phe, Met, His, Ile, Leu, Val Ala, or Gly
  SITE (253)..(253): Xaa at position 253 is Trp, Tyr, Phe, Met, His, Ile, Leu Val, Ala, or Gly
  SITE (259)..(259): Xaa at position 259 is Ile, Ala, Val, Leu, or Gly
  SITE (262)..(262): Xaa at position 262 is Ile, Ala, Val, Leu, or Gly
  SITE (270)..(270): Xaa at position 270 is Tyr, Phe, Met, His, Ile, Leu, Val Ala, or Gly
  SITE (271)..(271): Xaa at position 271 is Ala, Gly, or Pro
  SITE (272)..(272): Xaa at position 272 is Leu, Ala, Val, Gly, or Ile
  SITE (274)..(274): Xaa at position 274 is Val, Ala, Gly, Leu, or Ile
  SITE (276)..(276): Xaa at position 276 is Leu, Ala, Val, Gly, or Ile
  SITE (286)..(286): Xaa at position 286 is Ala, Gly, or Pro
  SITE (288)..(288): Xaa at position 288 is Tyr, Phe, Met, His, Ile, Leu, Val Ala, or Gly
  SITE (289)..(289): Xaa at position 289 is Ala, Gly, or Pro
  SITE (291)..(291): Xaa at position 291 is Phe, Tyr, Met, His, Ile, Leu, Val Ala, or Gly
  SITE (293)..(293): Xaa at position 293 is Val, Ala, Gly, Leu, or Ile
  SITE (300)..(300): Xaa at position 300 is Tyr, Phe, Met, His, Ile, Leu, Val Ala, or Gly
  SITE (302)..(302): Xaa at position 302 is Leu, Ala, Val, Gly, or Ile
  SITE (307)..(307): Xaa at position 307 is Phe, Tyr, Met, His, Ile, Leu, Val Ala, or Gly
  SITE (312)..(312): Xaa at position 312 is Ala, Gly, or Pro
  SITE (315)..(315): Xaa at position 315 is Ala, Gly, or Pro
  SITE (316)..(316): Xaa at position 316 is Phe, Tyr, Met, His, Ile, Leu, Val Ala, or Gly
  SITE (321)..(321): Xaa at position 321 is Phe, Tyr, Met, His, Ile, Leu, Val Ala, or Gly
  SITE (333)..(333): Xaa at position 333 is His, Phe, Tyr, Lys, Arg, Gly, Ser Thr, Ala, Val, Leu, Ile, Asn, Met, or Gln
  SITE (338)..(338): Xaa at position 338 is Phe, Tyr, Met, His, Ile, Leu, Val Ala, or Gly
  SITE (348)..(348): Xaa at position 348 is Phe, Tyr, Met, His, Ile, Leu, Val Ala, or Gly
  SITE (352)..(352): Xaa at position 352 is Cys, Ala, Val, Gly, Ser, or Thr
  SITE (353)..(353): Xaa at position 353 is Ala, Gly, or Pro
  SITE (360)..(360): Xaa at position 360 is Trp, Tyr, Phe, Met, His, Ile, Leu Val, Ala, or Gly
  SITE (361)..(361): Xaa at position 361 is Trp, Tyr, Phe, Met, His, Ile, Leu Val, Ala, or Gly
  SITE (362)..(362): Xaa at position 362 is Met, Ile, Leu, Val, Ala, or Gly
  SITE (366)..(366): Xaa at position 366 is His, Phe, Tyr, Lys, Arg, Gly, Ser Thr, Ala, Val, Leu, Ile, Asn, Met, or Gln
  SITE (367)..(367): Xaa at position 367 is Ala, Gly, or Pro
  SITE (369)..(369): Xaa at position 369 is His, Phe, Tyr, Lys, Arg, Gly, Ser Thr, Ala, Val, Leu, Ile, Asn, Met, or Gln
  SITE (370)..(370): Xaa at position 370 is Leu, Ala, Val, Gly, or Ile
  SITE (375)..(375): Xaa at position 375 is Tyr, Phe, Met, His, Ile, Leu, Val Ala, or Gly
  SITE (380)..(380): Xaa at position 380 is Tyr, Phe, Met, His, Ile, Leu, Val Ala, or Gly
  SITE (389)..(389): Xaa at position 389 is Tyr, Phe, Met, His, Ile, Leu, Val Ala, or Gly
  SITE (393)..(393): Xaa at position 393 is Ile, Ala, Val, Leu, or Gly
  SITE (394)..(394): Xaa at position 394 is Ile, Ala, Val, Leu, or Gly
  SITE (395)..(395): Xaa at position 395 is Trp, Tyr, Phe, Met, His, Ile, Leu Val, Ala, or Gly
  SITE (405)..(405): Xaa at position 405 is Met, Ile, Leu, Val, Ala, or Gly
  SITE (410)..(410): Xaa at position 410 is Met, Ile, Leu, Val, Ala, or Gly
  SITE (412)..(412): Xaa at position 412 is Ile, Ala, Val, Leu, or Gly
  SITE (413)..(413): Xaa at position 413 is Ile, Ala, Val, Leu, or Gly
  SITE (418)..(418): Xaa at position 418 is Leu, Ala, Val, Gly, or Ile
  SITE (427)..(427): Xaa at position 427 is His, Phe, Tyr, Lys, Arg, Gly, Ser Thr, Ala, Val, Leu, Ile, Asn, Met, or Gln
  SITE (431)..(431): Xaa at position 431 is Ala, Gly, or Pro
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDXQDXANKGAKQSGLXFXKPLKANQQFLXYXEIDGSGNGWTXXQKRLDGSVDFKKNWIQXKEGFGHLSPTGTTEFXLGNEKXHLXSTQSAIPXXXRXEXEDWNGRTSTXDXXMXKXGPEADKXRXTYAYXAGGDXGDXXDGFDXGDDPSDKFFTSXNGMQXSTWDNDNDKXEGNXXEQDGSGXXXNKCXXGXXNGVYXQGGTXSKASTPNGXDNGXXXATWKTRWYSXKKTTXKXXPFNRXTIGEGQQHXLGGXKQVRPEHPAETEYDSLYPEDDL

SEQ ID NO: 149 - protein, 482 aa, Homo sapiens
  SITE (153)..(153): Xaa at position 153 is Val, Ala, Gly, Leu, or Ile
  SITE (154)..(154): Xaa at position 154 is Leu, Ala, Val, Gly, or Ile
  SITE (167)..(167): Xaa at position 167 is Ala, Gly, or Pro
  SITE (177)..(177): Xaa at position 177 is Val, Ala, Gly, Leu, or Ile
  SITE (201)..(201): Xaa at position 201 is Val, Ala, Gly, Leu, or Ile
  SITE (203)..(203): Xaa at position 203 is Ile, Ala, Val, Leu, or Gly
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKXXLQYTGHITWTPPXIFKSYCEIIXTHFPFDEQNCSMKLGTWTYDGSVXAXNPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 150 - protein, 911 aa, Homo sapiens
  SITE (435)..(435): Xaa at position 435 is Met, Ile, Leu, Val, Ala, or Gly
  SITE (479)..(479): Xaa at position 479 is Cys, Ala, Val, Gly, Ser, or Thr
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQXGVSELLISTAVQGILFALLGAQPLLVVGFSGPLLVFEEAFFSFXETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 151 - protein, 352 aa, Homo sapiens
  SITE (287)..(287): Xaa at position 287 is Cys, Ala, Val, Gly, Ser, or Thr
  SITE (304)..(304): Xaa at position 304 is Ala, Gly, or Pro
  SITE (333)..(333): Xaa at position 333 is Cys, Ala, Val, Gly, Ser, or Thr
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAAXNLPIVRGPCRAFIQLWXFDAVKGKCVLFPYGGCQGNGNKFYSEKEXREYCGVPGDGDEELLRFSN

SEQ ID NO: 152 - protein, 147 aa, Homo sapiens
  SITE (32)..(32): Xaa at position 32 is Leu, Ala, Val, Gly, or Ile
  SITE (34)..(34): Xaa at position 34 is Val, Ala, Gly, Leu, or Ile
  SITE (36)..(36): Xaa at position 36 is Val, Ala, Gly, Leu, or Ile
  SITE (45)..(45): Xaa at position 45 is Ala, Gly, or Pro
  SITE (48)..(48): Xaa at position 48 is Val, Ala, Gly, Leu, or Ile
  SITE (50)..(50): Xaa at position 50 is Val, Ala, Gly, Leu, or Ile
  SITE (52)..(52): Xaa at position 52 is Val, Ala, Gly, Leu, or Ile
  SITE (75)..(75): Xaa at position 75 is Leu, Ala, Val, Gly, or Ile
  SITE (78)..(78): Xaa at position 78 is Leu, Ala, Val, Gly, or Ile
  SITE (84)..(84): Xaa at position 84 is Phe, Tyr, Met, His, Ile, Leu, Val Ala, or Gly
  SITE (88)..(88): Xaa at position 88 is Ile, Ala, Val, Leu, or Gly
  SITE (89)..(89): Xaa at position 89 is Tyr, Phe, Met, His, Ile, Leu, Val Ala, or Gly
  SITE (91)..(91): Xaa at position 91 is Val, Ala, Gly, Leu, or Ile
  SITE (93)..(93): Xaa at position 93 is Ile, Ala, Val, Leu, or Gly
  SITE (98)..(98): Xaa at position 98 is Tyr, Phe, Met, His, Ile, Leu, Val Ala, or Gly
  SITE (99)..(99): Xaa at position 99 is Trp, Tyr, Phe, Met, His, Ile, Leu Val, Ala, or Gly
  SITE (111)..(111): Xaa at position 111 is Ala, Gly, or Pro
  SITE (117)..(117): Xaa at position 117 is Ala, Gly, or Pro
  SITE (127)..(127): Xaa at position 127 is Ile, Ala, Val, Leu, or Gly
  SITE (128)..(128): Xaa at position 128 is Ala, Gly, or Pro
  SITE (129)..(129): Xaa at position 129 is Ala, Gly, or Pro
  SITE (130)..(130): Xaa at position 130 is Leu, Ala, Val, Gly, or Ile
  SITE (131)..(131): Xaa at position 131 is Leu, Ala, Val, Gly, or Ile
MASHRLLLLCLAGLVFVSEAGPTGTGESKCPXMXKXLDAVRGSPXINXAXHXFRKAADDTWEPFASGKTSESGEXHGXTTEEEXVEGXXKXEXDTKSXXKALGISPFHEHXEVVFTXNDSGPRRYTXXXXXSPYSYSTTAVVTNPKE

SEQ ID NO: 153 - protein, 609 aa, Homo sapiens
  SITE (31)..(31): Xaa at position 31 is Val, Ala, Gly, Leu, or Ile
  SITE (32)..(32): Xaa at position 32 is Ala, Gly, or Pro
  SITE (43)..(43): Xaa at position 43 is Phe, Tyr, Met, His, Ile, Leu, Val Ala, or Gly
  SITE (45)..(45): Xaa at position 45 is Ala, Gly, or Pro
  SITE (46)..(46): Xaa at position 46 is Leu, Ala, Val, Gly, or Ile
  SITE (47)..(47): Xaa at position 47 is Val, Ala, Gly, Leu, or Ile
  SITE (48)..(48): Xaa at position 48 is Leu, Ala, Val, Gly, or Ile
  SITE (49)..(49): Xaa at position 49 is Ile, Ala, Val, Leu, or Gly
  SITE (50)..(50): Xaa at position 50 is Ala, Gly, or Pro
  SITE (51)..(51): Xaa at position 51 is Phe, Tyr, Met, His, Ile, Leu, Val Ala, or Gly
  SITE (52)..(52): Xaa at position 52 is Ala, Gly, or Pro
  SITE (54)..(54): Xaa at position 54 is Tyr, Phe, Met, His, Ile, Leu, Val Ala, or Gly
  SITE (55)..(55): Xaa at position 55 is Leu, Ala, Val, Gly, or Ile
  SITE (58)..(58): Xaa at position 58 is Cys, Ala, Val, Gly, Ser, or Thr
  SITE (63)..(63): Xaa at position 63 is His, Phe, Tyr, Lys, Arg, Gly, Ser Thr, Ala, Val, Leu, Ile, Asn, Met, or Gln
  SITE (66)..(66): Xaa at position 66 is Leu, Ala, Val, Gly, or Ile
  SITE (70)..(70): Xaa at position 70 is Val, Ala, Gly, Leu, or Ile
  SITE (74)..(74): Xaa at position 74 is Ala, Gly, or Pro
  SITE (77)..(77): Xaa at position 77 is Cys, Ala, Val, Gly, Ser, or Thr
  SITE (86)..(86): Xaa at position 86 is Cys, Ala, Val, Gly, Ser, or Thr
  SITE (93)..(93): Xaa at position 93 is Leu, Ala, Val, Gly, or Ile
  SITE (98)..(98): Xaa at position 98 is Leu, Ala, Val, Gly, or Ile
  SITE (102)..(102): Xaa at position 102 is Ala, Gly, or Pro
  SITE (111)..(111): Xaa at position 111 is Met, Ile, Leu, Val, Ala, or Gly
  SITE (114)..(114): Xaa at position 114 is Cys, Ala, Val, Gly, Ser, or Thr
  SITE (126)..(126): Xaa at position 126 is Phe, Tyr, Met, His, Ile, Leu, Val Ala, or Gly
  SITE (148)..(148): Xaa at position 148 is Cys, Ala, Val, Gly, Ser, or Thr
  SITE (151)..(151): Xaa at position 151 is Phe, Tyr, Met, His, Ile, Leu, Val Ala, or Gly
  SITE (163)..(163): Xaa at position 163 is Leu, Ala, Val, Gly, or Ile
  SITE (167)..(167): Xaa at position 167 is Ala, Gly, or Pro
  SITE (173)..(173): Xaa at position 173 is Phe, Tyr, Met, His, Ile, Leu, Val Ala, or Gly
  SITE (175)..(175): Xaa at position 175 is Ala, Gly, or Pro
  SITE (178)..(178): Xaa at position 178 is Leu, Ala, Val, Gly, or Ile
  SITE (181)..(181): Xaa at position 181 is Phe, Tyr, Met, His, Ile, Leu, Val Ala, or Gly
  SITE (182)..(182): Xaa at position 182 is Ala, Gly, or Pro
  SITE (188)..(188): Xaa at position 188 is Ala, Gly, or Pro
  SITE (189)..(189): Xaa at position 189 is Phe, Tyr, Met, His, Ile, Leu, Val Ala, or Gly
  SITE (192)..(192): Xaa at position 192 is Cys, Ala, Val, Gly, Ser, or Thr
  SITE (202)..(202): Xaa at position 202 is Leu, Ala, Val, Gly, or Ile
  SITE (209)..(209): Xaa at position 209 is Leu, Ala, Val, Gly, or Ile
  SITE (215)..(215): Xaa at position 215 is Ala, Gly, or Pro
  SITE (224)..(224): Xaa at position 224 is Cys, Ala, Val, Gly, Ser, or Thr
  SITE (225)..(225): Xaa at position 225 is Ala, Gly, or Pro
  SITE (235)..(235): Xaa at position 235 is Phe, Tyr, Met, His, Ile, Leu, Val Ala, or Gly
  SITE (239)..(239): Xaa at position 239 is Ala, Gly, or Pro
  SITE (241)..(241): Xaa at position 241 is Ala, Gly, or Pro
  SITE (247)..(247): Xaa at position 247 is Phe, Tyr, Met, His, Ile, Leu, Val Ala, or Gly
  SITE (250)..(250): Xaa at position 250 is Ala, Gly, or Pro
  SITE (253)..(253): Xaa at position 253 is Ala, Gly, or Pro
  SITE (255)..(255): Xaa at position 255 is Val, Ala, Gly, Leu, or Ile
  SITE (258)..(258): Xaa at position 258 is Leu, Ala, Val, Gly, or Ile
  SITE (259)..(259): Xaa at position 259 is Val, Ala, Gly, Leu, or Ile
  SITE (265)..(265): Xaa at position 265 is Val, Ala, Gly, Leu, or Ile
  SITE (270)..(270): Xaa at position 270 is Cys, Ala, Val, Gly, Ser, or Thr
  SITE (274)..(274): Xaa at position 274 is Leu, Ala, Val, Gly, or Ile
  SITE (275)..(275): Xaa at position 275 is Leu, Ala, Val, Gly, or Ile
  SITE (277)..(277): Xaa at position 277 is Cys, Ala, Val, Gly, Ser, or Thr
  SITE (285)..(285): Xaa at position 285 is Ala, Gly, or Pro
  SITE (295)..(295): Xaa at position 295 is Ile, Ala, Val, Leu, or Gly
  SITE (299)..(299): Xaa at position 299 is Leu, Ala, Val, Gly, or Ile
  SITE (302)..(302): Xaa at position 302 is Cys, Ala, Val, Gly, Ser, or Thr
  SITE (317)..(317): Xaa at position 317 is Val, Ala, Gly, Leu, or Ile
  SITE (333)..(333): Xaa at position 333 is Phe, Tyr, Met, His, Ile, Leu, Val Ala, or Gly
  SITE (334)..(334): Xaa at position 334 is Val, Ala, Gly, Leu, or Ile
  SITE (339)..(339): Xaa at position 339 is Val, Ala, Gly, Leu, or Ile
  SITE (343)..(343): Xaa at position 343 is Tyr, Phe, Met, His, Ile, Leu, Val Ala, or Gly
  SITE (354)..(354): Xaa at position 354 is Phe, Tyr, Met, His, Ile, Leu, Val Ala, or Gly
  SITE (359)..(359): Xaa at position 359 is Ala, Gly, or Pro
  SITE (367)..(367): Xaa at position 367 is Val, Ala, Gly, Leu, or Ile
  SITE (369)..(369): Xaa at position 369 is Leu, Ala, Val, Gly, or Ile
  SITE (370)..(370): Xaa at position 370 is Leu, Ala, Val, Gly, or Ile
  SITE (371)..(371): Xaa at position 371 is Leu, Ala, Val, Gly, or Ile
  SITE (373)..(373): Xaa at position 373 is Leu, Ala, Val, Gly, or Ile
  SITE (377)..(377): Xaa at position 377 is Tyr, Phe, Met, His, Ile, Leu, Val Ala, or Gly
  SITE (381)..(381): Xaa at position 381 is Leu, Ala, Val, Gly, or Ile
  SITE (384)..(384): Xaa at position 384 is Cys, Ala, Val, Gly, Ser, or Thr
  SITE (394)..(394): Xaa at position 394 is Tyr, Phe, Met, His, Ile, Leu, Val Ala, or Gly
  SITE (397)..(397): Xaa at position 397 is Val, Ala, Gly, Leu, or Ile
  SITE (401)..(401): Xaa at position 401 is Phe, Tyr, Met, His, Ile, Leu, Val Ala, or Gly
  SITE (405)..(405): Xaa at position 405 is Val, Ala, Gly, Leu, or Ile
  SITE (416)..(416): Xaa at position 416 is Cys, Ala, Val, Gly, Ser, or Thr
  SITE (427)..(427): Xaa at position 427 is Phe, Tyr, Met, His, Ile, Leu, Val Ala, or Gly
  SITE (431)..(431): Xaa at position 431 is Leu, Ala, Val, Gly, or Ile
  SITE (432)..(432): Xaa at position 432 is Leu, Ala, Val, Gly, or Ile
  SITE (439)..(439): Xaa at position 439 is Val, Ala, Gly, Leu, or Ile
  SITE (442)..(442): Xaa at position 442 is Val, Ala, Gly, Leu, or Ile
  SITE (447)..(447): Xaa at position 447 is Leu, Ala, Val, Gly, or Ile
  SITE (448)..(448): Xaa at position 448 is Val, Ala, Gly, Leu, or Ile
  SITE (450)..(450): Xaa at position 450 is Val, Ala, Gly, Leu, or Ile
  SITE (454)..(454): Xaa at position 454 is Leu, Ala, Val, Gly, or Ile
  SITE (457)..(457): Xaa at position 457 is Val, Ala, Gly, Leu, or Ile
  SITE (461)..(461): Xaa at position 461 is Cys, Ala, Val, Gly, Ser, or Thr
  SITE (473)..(473): Xaa at position 473 is Ala, Gly, or Pro
  SITE (480)..(480): Xaa at position 480 is Val, Ala, Gly, Leu, or Ile
  SITE (481)..(481): Xaa at position 481 is Leu, Ala, Val, Gly, or Ile
  SITE (484)..(484): Xaa at position 484 is Leu, Ala, Val, Gly, or Ile
  SITE (486)..(486): Xaa at position 486 is Val, Ala, Gly, Leu, or Ile
  SITE (488)..(488): Xaa at position 488 is His, Phe, Tyr, Lys, Arg, Gly, Ser Thr, Ala, Val, Leu, Ile, Asn, Met, or Gln
  SITE (497)..(497): Xaa at position 497 is Val, Ala, Gly, Leu, or Ile
  SITE (500)..(500): Xaa at position 500 is Cys, Ala, Val, Gly, Ser, or Thr
  SITE (512)..(512): Xaa at position 512 is Phe, Tyr, Met, His, Ile, Leu, Val Ala, or Gly
  SITE (531)..(531): Xaa at position 531 is Phe, Tyr, Met, His, Ile, Leu, Val Ala, or Gly
  SITE (535)..(535): Xaa at position 535 is Ala, Gly, or Pro
  SITE (537)..(537): Xaa at position 537 is Ile, Ala, Val, Leu, or Gly
  SITE (552)..(552): Xaa at position 552 is Ala, Gly, or Pro
  SITE (553)..(553): Xaa at position 553 is Leu, Ala, Val, Gly, or Ile
  SITE (554)..(554): Xaa at position 554 is Val, Ala, Gly, Leu, or Ile
  SITE (556)..(556): Xaa at position 556 is Leu, Ala, Val, Gly, or Ile
  SITE (557)..(557): Xaa at position 557 is Val, Ala, Gly, Leu, or Ile
  SITE (563)..(563): Xaa at position 563 is Ala, Gly, or Pro
  SITE (568)..(568): Xaa at position 568 is Leu, Ala, Val, Gly, or Ile
  SITE (571)..(571): Xaa at position 571 is Val, Ala, Gly, Leu, or Ile
  SITE (575)..(575): Xaa at position 575 is Phe, Tyr, Met, His, Ile, Leu, Val Ala, or Gly
  SITE (578)..(578): Xaa at position 578 is Phe, Tyr, Met, His, Ile, Leu, Val Ala, or Gly
  SITE (579)..(579): Xaa at position 579 is Val, Ala, Gly, Leu, or Ile
  SITE (582)..(582): Xaa at position 582 is Cys, Ala, Val, Gly, Ser, or Thr
  SITE (592)..(592): Xaa at position 592 is Phe, Tyr, Met, His, Ile, Leu, Val Ala, or Gly
  SITE (607)..(607): Xaa at position 607 is Leu, Ala, Val, Gly, or Ile
  SITE (609)..(609): Xaa at position 609 is Leu, Ala, Val, Gly, or Ile
MKWVTFISLLFLFSSAYSRGVFRRDAHKSEXXHRFKDLGEENXKXXXXXXXXQXXQQXPFEDXVKXVNEXTEFXKTXVADESAENXDKSLHTXFGDKXCTVXTLRETYGEXADXCAKQEPERNECXLQHKDDNPNLPRLVRPEVDVMXTAXHDNEETFLKKYXYEIXRRHPYXYXPEXLFXXKRYKAXXTEXCQAADKAACXLPKLDEXRDEGKXSSAKQRLKXXSLQKFGERAXKAWXVXRLSQRXPKXEFXEXSKXXTDLTKXHTECXHGDXXEXADDRADLXKYICENQDSXSSKXKEXCEKPLLEKSHCIAEXENDEMPADLPSLAADXXESKDXCKNXAEAKDVFLGMXLYEYXRRHPDYSXVXXXRXAKTXETTXEKXCAAADPHECXAKXFDEXKPLXEEPQNLIKQNXELFEQLGEYKXQNAXXVRYTKKXPQXSTPTXXEXSRNXGKXGSKXCKHPEAKRMPCXEDYLSVXXNQXCXLXEKTPVSDRXTKXCTESLVNRRPCXSALEVDETYVPKEFNAETXTFHXDXCTLSEKERQIKKQTXXXEXXKHKPKXTKEQXKAXMDDXAAXXEKXCKADDKETCXAEEGKKLVAASQAAXGX

SEQ ID NO: 154 - protein, 175 aa, Homo sapiens
  SITE (13)..(13): Xaa at position 13 is Val, Ala, Gly, Leu, or Ile
  SITE (15)..(15): Xaa at position 15 is Ala, Gly, or Pro
  SITE (17)..(17): Xaa at position 17 is Val, Ala, Gly, Leu, or Ile
  SITE (20)..(20): Xaa at position 20 is Leu, Ala, Val, Gly, or Ile
  SITE (21)..(21): Xaa at position 21 is Val, Ala, Gly, Leu, or Ile
  SITE (24)..(24): Xaa at position 24 is Tyr, Phe, Met, His, Ile, Leu, Val Ala, or Gly
  SITE (27)..(27): Xaa at position 27 is Ala, Gly, or Pro
  SITE (31)..(31): Xaa at position 31 is Tyr, Phe, Met, His, Ile, Leu, Val Ala, or Gly
  SITE (34)..(34): Xaa at position 34 is Leu, Ala, Val, Gly, or Ile
  SITE (37)..(37): Xaa at position 37 is Tyr, Phe, Met, His, Ile, Leu, Val Ala, or Gly
  SITE (38)..(38): Xaa at position 38 is Phe, Tyr, Met, His, Ile, Leu, Val Ala, or Gly
  SITE (48)..(48): Xaa at position 48 is Val, Ala, Gly, Leu, or Ile
  SITE (51)..(51): Xaa at position 51 is Phe, Tyr, Met, His, Ile, Leu, Val Ala, or Gly
  SITE (52)..(52): Xaa at position 52 is Phe, Tyr, Met, His, Ile, Leu, Val Ala, or Gly
  SITE (55)..(55): Xaa at position 55 is Leu, Ala, Val, Gly, or Ile
  SITE (56)..(56): Xaa at position 56 is Ala, Gly, or Pro
  SITE (63)..(63): Xaa at position 63 is Tyr, Phe, Met, His, Ile, Leu, Val Ala, or Gly
  SITE (66)..(66): Xaa at position 66 is Leu, Ala, Val, Gly, or Ile
  SITE (67)..(67): Xaa at position 67 is Leu, Ala, Val, Gly, or Ile
  SITE (69)..(69): Xaa at position 69 is Met, Ile, Leu, Val, Ala, or Gly
  SITE (90)..(90): Xaa at position 90 is Trp, Tyr, Phe, Met, His, Ile, Leu Val, Ala, or Gly
  SITE (96)..(96): Xaa at position 96 is Ala, Gly, or Pro
  SITE (97)..(97): Xaa at position 97 is Met, Ile, Leu, Val, Ala, or Gly
  SITE (99)..(99): Xaa at position 99 is Ala, Gly, or Pro
  SITE (100)..(100): Xaa at position 100 is Ala, Gly, or Pro
  SITE (101)..(101): Xaa at position 101 is Met, Ile, Leu, Val, Ala, or Gly
  SITE (107)..(107): Xaa at position 107 is Leu, Ala, Val, Gly, or Ile
  SITE (111)..(111): Xaa at position 111 is Leu, Ala, Val, Gly, or Ile
  SITE (112)..(112): Xaa at position 112 is Leu, Ala, Val, Gly, or Ile
  SITE (114)..(114): Xaa at position 114 is Leu, Ala, Val, Gly, or Ile
  SITE (126)..(126): Xaa at position 126 is Leu, Ala, Val, Gly, or Ile
  SITE (130)..(130): Xaa at position 130 is Leu, Ala, Val, Gly, or Ile
  SITE (134)..(134): Xaa at position 134 is Phe, Tyr, Met, His, Ile, Leu, Val Ala, or Gly
  SITE (145)..(145): Xaa at position 145 is Met, Ile, Leu, Val, Ala, or Gly
  SITE (149)..(149): Xaa at position 149 is Leu, Ala, Val, Gly, or Ile
  SITE (152)..(152): Xaa at position 152 is Leu, Ala, Val, Gly, or Ile
  SITE (167)..(167): Xaa at position 167 is Phe, Tyr, Met, His, Ile, Leu, Val Ala, or Gly
MSSQIRQNYSTDXEXAXNSXXNLXLQXSYTXLSXGFXXDRDDVALEGXSHXXREXXEEKREGXERXXKXQNQRGGRALFQDIKKPAEDEXGKTPDXXKXXXALEKKXNQAXXDXHALGSARTDPHXCDFXETHXLDEEVKLIKKXGDHXTNXHRLGGPEAGLGEYLXERLTLKHD

SEQ ID NO: 155 - protein, 183 aa, Hepatitis B virus
  genotype D subtype adw (isolate United Kingdom/adyw/1979) (HBV-D)
  SITE (9)..(9): Xaa at position 9 is Phe, Tyr, Met, His, Ile, Leu, Val Ala, or Gly
  SITE (15)..(15): Xaa at position 15 is Leu, Ala, Val, Gly, or Ile
  SITE (19)..(19): Xaa at position 19 is Leu, Ala, Val, Gly, or Ile
  SITE (23)..(23): Xaa at position 23 is Phe, Tyr, Met, His, Ile, Leu, Val Ala, or Gly
  SITE (24)..(24): Xaa at position 24 is Phe, Tyr, Met, His, Ile, Leu, Val Ala, or Gly
  SITE (36)..(36): Xaa at position 36 is Ala, Gly, or Pro
  SITE (38)..(38): Xaa at position 38 is Tyr, Phe, Met, His, Ile, Leu, Val Ala, or Gly
  SITE (54)..(54): Xaa at position 54 is Ala, Gly, or Pro
  SITE (55)..(55): Xaa at position 55 is Leu, Ala, Val, Gly, or Ile
  SITE (61)..(61): Xaa at position 61 is Cys, Ala, Val, Gly, Ser, or Thr
  SITE (71)..(71): Xaa at position 71 is Trp, Tyr, Phe, Met, His, Ile, Leu Val, Ala, or Gly
  SITE (102)..(102): Xaa at position 102 is Trp, Tyr, Phe, Met, His, Ile, Leu Val, Ala, or Gly
  SITE (103)..(103): Xaa at position 103 is Phe, Tyr, Met, His, Ile, Leu, Val Ala, or Gly
  SITE (108)..(108): Xaa at position 108 is Leu, Ala, Val, Gly, or Ile
  SITE (110)..(110): Xaa at position 110 is Phe, Tyr, Met, His, Ile, Leu, Val Ala, or Gly
  SITE (120)..(120): Xaa at position 120 is Val, Ala, Gly, Leu, or Ile
  SITE (122)..(122): Xaa at position 122 is Phe, Tyr, Met, His, Ile, Leu, Val Ala, or Gly
  SITE (125)..(125): Xaa at position 125 is Trp, Tyr, Phe, Met, His, Ile, Leu Val, Ala, or Gly
  SITE (131)..(131): Xaa at position 131 is Ala, Gly, or Pro
  SITE (132)..(132): Xaa at position 132 is Tyr, Phe, Met, His, Ile, Leu, Val Ala, or Gly
  SITE (137)..(137): Xaa at position 137 is Ala, Gly, or Pro
  SITE (139)..(139): Xaa at position 139 is Ile, Ala, Val, Leu, or Gly
  SITE (140)..(140): Xaa at position 140 is Leu, Ala, Val, Gly, or Ile
MDIDPYKEXGATVEXLSFXPSDXXPSVRDLLDTAAXLXRDALESPEHCSPHHTXXRQAILXWGDLMTLATXVGTNLEDPASRDLVVSYVNTNVGLKFRQLLXXHISCXTXGRETVLEYLXSXGVXIRTPPXXRPPNXPXXSTLPETTVVRRRGRSPRRRTPSPRRRRSQSPRRRRSQSRESQC

SEQ ID NO: 156 - protein, 595 aa, Homo sapiens
  SITE (185)..(185): Xaa at position 185 is Cys, Ala, Val, Gly, Ser, or Thr
  SITE (187)..(187): Xaa at position 187 is Val, Ala, Gly, Leu, or Ile
  SITE (188)..(188): Xaa at position 188 is Cys, Ala, Val, Gly, Ser, or Thr
  SITE (199)..(199): Xaa at position 199 is Val, Ala, Gly, Leu, or Ile
  SITE (202)..(202): Xaa at position 202 is Cys, Ala, Val, Gly, Ser, or Thr
  SITE (205)..(205): Xaa at position 205 is Cys, Ala, Val, Gly, Ser, or Thr
  SITE (209)..(209): Xaa at position 209 is Phe, Tyr, Met, His, Ile, Leu, Val Ala, or Gly
  SITE (227)..(227): Xaa at position 227 is Cys, Ala, Val, Gly, Ser, or Thr
  SITE (229)..(229): Xaa at position 229 is Ile, Ala, Val, Leu, or Gly
  SITE (237)..(237): Xaa at position 237 is Cys, Ala, Val, Gly, Ser, or Thr
  SITE (239)..(239): Xaa at position 239 is Ala, Gly, or Pro
  SITE (240)..(240): Xaa at position 240 is Cys, Ala, Val, Gly, Ser, or Thr
  SITE (242)..(242): Xaa at position 242 is Leu, Ala, Val, Gly, or Ile
  SITE (245)..(245): Xaa at position 245 is Cys, Ala, Val, Gly, Ser, or Thr
  SITE (250)..(250): Xaa at position 250 is Met, Ile, Leu, Val, Ala, or Gly
  SITE (307)..(307): Xaa at position 307 is Ala, Gly, or Pro
  SITE (315)..(315): Xaa at position 315 is Met, Ile, Leu, Val, Ala, or Gly
  SITE (319)..(319): Xaa at position 319 is Leu, Ala, Val, Gly, or Ile
  SITE (322)..(322): Xaa at position 322 is Ala, Gly, or Pro
  SITE (342)..(342): Xaa at position 342 is Met, Ile, Leu, Val, Ala, or Gly
  SITE (345)..(345): Xaa at position 345 is Leu, Ala, Val, Gly, or Ile
  SITE (349)..(349): Xaa at position 349 is Leu, Ala, Val, Gly, or Ile
  SITE (354)..(354): Xaa at position 354 is Leu, Ala, Val, Gly, or Ile
  SITE (357)..(357): Xaa at position 357 is Met, Ile, Leu, Val, Ala, or Gly
  SITE (358)..(358): Xaa at position 358 is Ile, Ala, Val, Leu, or Gly
  SITE (360)..(360): Xaa at position 360 is Trp, Tyr, Phe, Met, His, Ile, Leu Val, Ala, or Gly
  SITE (361)..(361): Xaa at position 361 is Ala, Gly, or Pro
  SITE (364)..(364): Xaa at position 364 is Val, Ala, Gly, Leu, or Ile
  SITE (367)..(367): Xaa at position 367 is Phe, Tyr, Met, His, Ile, Leu, Val Ala, or Gly
  SITE (376)..(376): Xaa at position 376 is Val, Ala, Gly, Leu, or Ile
  SITE (378)..(378): Xaa at position 378 is Leu, Ala, Val, Gly, or Ile
  SITE (379)..(379): Xaa at position 379 is Leu, Ala, Val, Gly, or Ile
  SITE (382)..(382): Xaa at position 382 is Ala, Gly, or Pro
  SITE (383)..(383): Xaa at position 383 is Trp, Tyr, Phe, Met, His, Ile, Leu Val, Ala, or Gly
  SITE (389)..(389): Xaa at position 389 is Ile, Ala, Val, Leu, or Gly
  SITE (391)..(391): Xaa at position 391 is Leu, Ala, Val, Gly, or Ile
  SITE (392)..(392): Xaa at position 392 is Val, Ala, Gly, Leu, or Ile
  SITE (402)..(402): Xaa at position 402 is Leu, Ala, Val, Gly, or Ile
  SITE (405)..(405): Xaa at position 405 is Ala, Gly, or Pro
  SITE (408)..(408): Xaa at position 408 is Leu, Ala, Val, Gly, or Ile
  SITE (410)..(410): Xaa at position 410 is Leu, Ala, Val, Gly, or Ile
  SITE (418)..(418): Xaa at position 418 is Val, Ala, Gly, Leu, or Ile
  SITE (425)..(425): Xaa at position 425 is Phe, Tyr, Met, His, Ile, Leu, Val Ala, or Gly
  SITE (435)..(435): Xaa at position 435 is Phe, Tyr, Met, His, Ile, Leu, Val Ala, or Gly
  SITE (445)..(445): Xaa at position 445 is Phe, Tyr, Met, His, Ile, Leu, Val Ala, or Gly
  SITE (446)..(446): Xaa at position 446 is Val, Ala, Gly, Leu, or Ile
  SITE (447)..(447): Xaa at position 447 is Cys, Ala, Val, Gly, Ser, or Thr
  SITE (448)..(448): Xaa at position 448 is Leu, Ala, Val, Gly, or Ile
  SITE (452)..(452): Xaa at position 452 is Ile, Ala, Val, Leu, or Gly
  SITE (453)..(453): Xaa at position 453 is Leu, Ala, Val, Gly, or Ile
  SITE (454)..(454): Xaa at position 454 is Leu, Ala, Val, Gly, or Ile
  SITE (458)..(458): Xaa at position 458 is Val, Ala, Gly, Leu, or Ile
  SITE (474)..(474): Xaa at position 474 is His, Phe, Tyr, Lys, Arg, Gly, Ser Thr, Ala, Val, Leu, Ile, Asn, Met, or Gln
  SITE (475)..(475): Xaa at position 475 is Ile, Ala, Val, Leu, or Gly
  SITE (478)..(478): Xaa at position 478 is Val, Ala, Gly, Leu, or Ile
  SITE (482)..(482): Xaa at position 482 is Ile, Ala, Val, Leu, or Gly
  SITE (486)..(486): Xaa at position 486 is Leu, Ala, Val, Gly, or Ile
  SITE (490)..(490): Xaa at position 490 is Met, Ile, Leu, Val, Ala, or Gly
  SITE (507)..(507): Xaa at position 507 is Leu, Ala, Val, Gly, or Ile
  SITE (510)..(510): Xaa at position 510 is Ile, Ala, Val, Leu, or Gly
  SITE (514)..(514): Xaa at position 514 is Ile, Ala, Val, Leu, or Gly
  SITE (517)..(517): Xaa at position 517 is Met, Ile, Leu, Val, Ala, or Gly
  SITE (522)..(522): Xaa at position 522 is Met, Ile, Leu, Val, Ala, or Gly
  SITE (528)..(528): Xaa at position 528 is Met, Ile, Leu, Val, Ala, or Gly
  SITE (540)..(540): Xaa at position 540 is Leu, Ala, Val, Gly, or Ile
  SITE (544)..(544): Xaa at position 544 is Leu, Ala, Val, Gly, or Ile
MTMTLHTKASGMALLHQIQGNELEPLNRPQLKIPLERPLGEVYLDSSKPAVYNYPEGAAYEFNAAAAANAQVYGQTGLPYGPGSEAAAFGSNGLGGFPPLNSVSPSPLMLLHPPPQLSPFLQPHGQQVPYYLENEPSGYTVREAGPPAFYRPNSDNRRQGGRERLASTNDKGSMAMESAKETRYXAXXNDYASGYHYGXWSXEGXKAFXKRSIQGHNDYMCPATNQXTXDKNRRKSXQXXRXRKXYEVGXMKGGIRKDRRGGRMLKHKRQRDDGEGRGEVGSAGDMRAANLWPSPLMIKRSKKNSLXLSLTADQXVSAXLDXEPPILYSEYDPTRPFSEASXMGXLTNXADREXVHXXNXXKRXPGXVDLTLHDQXHXXECXXLEILMXGXXWRSMEHPGKXLFXPNXLXDRNQGKCXEGMVEIXDMLLATSSRXRMMNLQGEEXXXXKSIXXXNSGXYTFLSSTLKSLEEKDXXHRXLDKXTDTXIHLXAKAGLTLQQQHQRLAQXLLXLSHXRHXSNKGXEHLYSXKCKNVVPLYDLXLEMXDAHRLHAPTSRGGASVEETDQSHLATAGSTSSHSLQKYYITGEAEGFPATV

SEQ ID NO: 157 - protein, 574 aa, Human respiratory syncytial virus A
  strain A2
  SITE (32)..(32): Xaa at position 32 is Phe, Tyr, Met, His, Ile, Leu, Val Ala, or Gly
  SITE (37)..(37): Xaa at position 37 is Cys, Ala, Val, Gly, Ser, or Thr
  SITE (39)..(39): Xaa at position 39 is Ala, Gly, or Pro
  SITE (40)..(40): Xaa at position 40 is Val, Ala, Gly, Leu, or Ile
  SITE (47)..(47): Xaa at position 47 is Ala, Gly, or Pro
  SITE (48)..(48): Xaa at position 48 is Leu, Ala, Val, Gly, or Ile
  SITE (56)..(56): Xaa at position 56 is Val, Ala, Gly, Leu, or Ile
  SITE (57)..(57): Xaa at position 57 is Ile, Ala, Val, Leu, or Gly
  SITE (59)..(59): Xaa at position 59 is Ile, Ala, Val, Leu, or Gly
  SITE (76)..(76): Xaa at position 76 is Val, Ala, Gly, Leu, or Ile
  SITE (79)..(79): Xaa at position 79 is Ile, Ala, Val, Leu, or Gly
  SITE (83)..(83): Xaa at position 83 is Leu, Ala, Val, Gly, or Ile
  SITE (89)..(89): Xaa at position 89 is Ala, Gly, or Pro
  SITE (90)..(90): Xaa at position 90 is Val, Ala, Gly, Leu, or Ile
  SITE (93)..(93): Xaa at position 93 is Leu, Ala, Val, Gly, or Ile
  SITE (158)..(158): Xaa at position 158 is Leu, Ala, Val, Gly, or Ile
  SITE (164)..(164): Xaa at position 164 is Val, Ala, Gly, Leu, or Ile
  SITE (171)..(171): Xaa at position 171 is Leu, Ala, Val, Gly, or Ile
  SITE (187)..(187): Xaa at position 187 is Val, Ala, Gly, Leu, or Ile
  SITE (188)..(188): Xaa at position 188 is Leu, Ala, Val, Gly, or Ile
  SITE (195)..(195): Xaa at position 195 is Leu, Ala, Val, Gly, or Ile
  SITE (199)..(199): Xaa at position 199 is Ile, Ala, Val, Leu, or Gly
  SITE (203)..(203): Xaa at position 203 is Leu, Ala, Val, Gly, or Ile
  SITE (212)..(212): Xaa at position 212 is Cys, Ala, Val, Gly, Ser, or Thr
  SITE (214)..(214): Xaa at position 214 is Ile, Ala, Val, Leu, or Gly
  SITE (220)..(220): Xaa at position 220 is Val, Ala, Gly, Leu, or Ile
  SITE (223)..(223): Xaa at position 223 is Phe, Tyr, Met, His, Ile, Leu, Val Ala, or Gly
  SITE (230)..(230): Xaa at position 230 is Leu, Ala, Val, Gly, or Ile
  SITE (233)..(233): Xaa at position 233 is Ile, Ala, Val, Leu, or Gly
  SITE (237)..(237): Xaa at position 237 is Phe, Tyr, Met, His, Ile, Leu, Val Ala, or Gly
  SITE (247)..(247): Xaa at position 247 is Val, Ala, Gly, Leu, or Ile
  SITE (251)..(251): Xaa at position 251 is Met, Ile, Leu, Val, Ala, or Gly
  SITE (252)..(252): Xaa at position 252 is Leu, Ala, Val, Gly, or Ile
  SITE (257)..(257): Xaa at position 257 is Leu, Ala, Val, Gly, or Ile
  SITE (260)..(260): Xaa at position 260 is Leu, Ala, Val, Gly, or Ile
  SITE (261)..(261): Xaa at position 261 is Ile, Ala, Val, Leu, or Gly
  SITE (264)..(264): Xaa at position 264 is Met, Ile, Leu, Val, Ala, or Gly
  SITE (266)..(266): Xaa at position 266 is Ile, Ala, Val, Leu, or Gly
  SITE (274)..(274): Xaa at position 274 is Met, Ile, Leu, Val, Ala, or Gly
  SITE (280)..(280): Xaa at position 280 is Ile, Ala, Val, Leu, or Gly
  SITE (281)..(281): Xaa at position 281 is Val, Ala, Gly, Leu, or Ile
  SITE (288)..(288): Xaa at position 288 is Ile, Ala, Val, Leu, or Gly
  SITE (290)..(290): Xaa at position 290 is Ser, Ala, or Gly
  SITE (291)..(291): Xaa at position 291 is Ile, Ala, Val, Leu, or Gly
  SITE (297)..(297): Xaa at position 297 is Leu, Ala, Val, Gly, or Ile
  SITE (298)..(298): Xaa at position 298 is Ala, Gly, or Pro
  SITE (299)..(299): Xaa at position 299 is Tyr, Phe, Met, His, Ile, Leu, Val Ala, or Gly
  SITE (300)..(300): Xaa at position 300 is Val, Ala, Gly, Leu, or Ile
  SITE (301)..(301): Xaa at position 301 is Val, Ala, Gly, Leu, or Ile
  SITE (303)..(303): Xaa at position 303 is Leu, Ala, Val, Gly, or Ile
  SITE (306)..(306): Xaa at position 306 is Tyr, Phe, Met, His, Ile, Leu, Val Ala, or Gly
  SITE (313)..(313): Xaa at position 313 is Cys, Ala, Val, Gly, Ser, or Thr
  SITE (322)..(322): Xaa at position 322 is Cys, Ala, Val, Gly, Ser, or Thr
  SITE (332)..(332): Xaa at position 332 is Ile, Ala, Val, Leu, or Gly
  SITE (333)..(333): Xaa at position 333 is Cys, Ala, Val, Gly, Ser, or Thr
  SITE (334)..(334): Xaa at position 334 is Leu, Ala, Val, Gly, or Ile
  SITE (342)..(342): Xaa at position 342 is Tyr, Phe, Met, His, Ile, Leu, Val Ala, or Gly
  SITE (343)..(343): Xaa at position 343 is Cys, Ala, Val, Gly, Ser, or Thr
  SITE (349)..(349): Xaa at position 349 is Val, Ala, Gly, Leu, or Ile
  SITE (351)..(351): Xaa at position 351 is Phe, Tyr, Met, His, Ile, Leu, Val Ala, or Gly
  SITE (352)..(352): Xaa at position 352 is Phe, Tyr, Met, His, Ile, Leu, Val Ala, or Gly
  SITE (365)..(365): Xaa at position 365 is Val, Ala, Gly, Leu, or Ile
  SITE (366)..(366): Xaa at position 366 is Phe, Tyr, Met, His, Ile, Leu, Val Ala, or Gly
  SITE (367)..(367): Xaa at position 367 is Cys, Ala, Val, Gly, Ser, or Thr
  SITE (379)..(379): Xaa at position 379 is Ile, Ala, Val, Leu, or Gly
  SITE (381)..(381): Xaa at position 381 is Leu, Ala, Val, Gly, or Ile
  SITE (382)..(382): Xaa at position 382 is Cys, Ala, Val, Gly, Ser, or Thr
  SITE (393)..(393): Xaa at position 393 is Cys, Ala, Val, Gly, Ser, or Thr
  SITE (395)..(395): Xaa at position 395 is Ile, Ala, Val, Leu, or Gly
  SITE (407)..(407): Xaa at position 407 is Ile, Ala, Val, Leu, or Gly
  SITE (410)..(410): Xaa at position 410 is Leu, Ala, Val, Gly, or Ile
  SITE (412)..(412): Xaa at position 412 is Ala, Gly, or Pro
  SITE (413)..(413): Xaa at position 413 is Ile, Ala, Val, Leu, or Gly
  SITE (414)..(414): Xaa at position 414 is Val, Ala, Gly, Leu, or Ile
  SITE (416)..(416): Xaa at position 416 is Cys, Ala, Val, Gly, Ser, or Thr
  SITE (422)..(422): Xaa at position 422 is Cys, Ala, Val, Gly, Ser, or Thr
  SITE (424)..(424): Xaa at position 424 is Ala, Gly, or Pro
  SITE (442)..(442): Xaa at position 442 is Val, Ala, Gly, Leu, or Ile
  SITE (447)..(447): Xaa at position 447 is Met, Ile, Leu, Val, Ala, or Gly
  SITE (450)..(450): Xaa at position 450 is Val, Ala, Gly, Leu, or Ile
  SITE (459)..(459): Xaa at position 459 is Val, Ala, Gly, Leu, or Ile
  SITE (475)..(475): Xaa at position 475 is Ile, Ala, Val, Leu, or Gly
  SITE (478)..(478): Xaa at position 478 is Tyr, Phe, Met, His, Ile, Leu, Val Ala, or Gly
  SITE (490)..(490): Xaa at position 490 is Ala, Gly, or Pro
  SITE (495)..(495): Xaa at position 495 is Val, Ala, Gly, Leu, or Ile
MELLILKANAITTILTAVTFCFASGQNITEEXYQSTXSXXSKGYLSXXRTGWYTSXXTXELSNIKENKCNGTDAKXKLXKQEXDKYKNXXTEXQLLMQSTPPTNNRARRELPRFMNYTLNNAKKTNVTLSKKRKRRFLGFLLGVGSAIASGVAVSKVXHLEGEXNKIKSAXLSTNKAVVSLSNGVSXXTSKVLDXKNYXDKQXLPIVNKQSXSXSNIETXIEXQQKNNRXLEXTREXSVNAGVTTPXSTYXXTNSEXLSXXNDXPXTNDQKKLXSNNVQXXRQQSYSXMXXIKEEVXXXXXQXPLXGVIDTPXWKLHTSPLXTTNTKEGSNXXXTRTDRGWXXDNAGSXSXXPQAETCKVQSNRXXXDTMNSLTLPSEXNXXNVDIFNPKYDXKXMTSKTDVSSSVXTSXGXXXSXYGKTKXTXSNKNRGIIKTFSNGCDYXSNKGXDTXSVGNTLYYXNKQEGKSLYVKGEPIXNFXDPLVFPSDEFDXSISQXNEKINQSLAFIRKSDELLHNVNAGKSTTNIMITTIIIVIIVILLSLIAVGLLLYCKARSTPVTLSKDQLSGINNIAFSN

SEQ ID NO: 158 - protein, 550 aa, Influenza A virus
  strain A/Bangkok/1/1979 H3N2
  SITE (11)..(11): Xaa at position 11 is Ala, Gly, or Pro
  SITE (13)..(13): Xaa at position 13 is Leu, Ala, Val, Gly, or Ile
  SITE (14)..(14): Xaa at position 14 is Cys, Ala, Val, Gly, Ser, or Thr
  SITE (15)..(15): Xaa at position 15 is Leu, Ala, Val, Gly, or Ile
  SITE (19)..(19): Xaa at position 19 is Ala, Gly, or Pro
  SITE (26)..(26): Xaa at position 26 is Val, Ala, Gly, Leu, or Ile
  SITE (36)..(36): Xaa at position 36 is Val, Ala, Gly, Leu, or Ile
  SITE (42)..(42): Xaa at position 42 is Leu, Ala, Val, Gly, or Ile
  SITE (43)..(43): Xaa at position 43 is Val, Ala, Gly, Leu, or Ile
  SITE (51)..(51): Xaa at position 51 is Ile, Ala, Val, Leu, or Gly
  SITE (52)..(52): Xaa at position 52 is Cys, Ala, Val, Gly, Ser, or Thr
  SITE (58)..(58): Xaa at position 58 is Ile, Ala, Val, Leu, or Gly
  SITE (64)..(64): Xaa at position 64 is Cys, Ala, Val, Gly, Ser, or Thr
  SITE (66)..(66): Xaa at position 66 is Leu, Ala, Val, Gly, or Ile
  SITE (67)..(67): Xaa at position 67 is Ile, Ala, Val, Leu, or Gly
  SITE (70)..(70): Xaa at position 70 is Leu, Ala, Val, Gly, or Ile
  SITE (71)..(71): Xaa at position 71 is Leu, Ala, Val, Gly, or Ile
  SITE (76)..(76): Xaa at position 76 is Cys, Ala, Val, Gly, Ser, or Thr
  SITE (79)..(79): Xaa at position 79 is Phe, Tyr, Met, His, Ile, Leu, Val Ala, or Gly
  SITE (86)..(86): Xaa at position 86 is Leu, Ala, Val, Gly, or Ile
  SITE (87)..(87): Xaa at position 87 is Phe, Tyr, Met, His, Ile, Leu, Val Ala, or Gly
  SITE (88)..(88): Xaa at position 88 is Val, Ala, Gly, Leu, or Ile
  SITE (94)..(94): Xaa at position 94 is Phe, Tyr, Met, His, Ile, Leu, Val Ala, or Gly
  SITE (97)..(97): Xaa at position 97 is Cys, Ala, Val, Gly, Ser, or Thr
  SITE (98)..(98): Xaa at position 98 is Tyr, Phe, Met, His, Ile, Leu, Val Ala, or Gly
  SITE (100)..(100): Xaa at position 100 is Tyr, Phe, Met, His, Ile, Leu, Val Ala, or Gly
  SITE (105)..(105): Xaa at position 105 is Tyr, Phe, Met, His, Ile, Leu, Val Ala, or Gly
  SITE (106)..(106): Xaa at position 106 is Ala, Gly, or Pro
  SITE (108)..(108): Xaa at position 108 is Leu, Ala, Val, Gly, or Ile
  SITE (112)..(112): Xaa at position 112 is Val, Ala, Gly, Leu, or Ile
  SITE (113)..(113): Xaa at position 113 is Ala, Gly, or Pro
  SITE (118)..(118): Xaa at position 118 is Leu, Ala, Val, Gly, or Ile
  SITE (125)..(125): Xaa at position 125 is Phe, Tyr, Met, His, Ile, Leu, Val Ala, or Gly
  SITE (138)..(138): Xaa at position 138 is Ala, Gly, or Pro
  SITE (139)..(139): Xaa at position 139 is Cys, Ala, Val, Gly, Ser, or Thr
  SITE (147)..(147): Xaa at position 147 is Phe, Tyr, Met, His, Ile, Leu, Val Ala, or Gly
  SITE (148)..(148): Xaa at position 148 is Phe, Tyr, Met, His, Ile, Leu, Val Ala, or Gly
  SITE (151)..(151): Xaa at position 151 is Leu, Ala, Val, Gly, or Ile
  SITE (154)..(154): Xaa at position 154 is Leu, Ala, Val, Gly, or Ile
  SITE (164)..(164): Xaa at position 164 is Leu, Ala, Val, Gly, or Ile
  SITE (178)..(178): Xaa at position 178 is Tyr, Phe, Met, His, Ile, Leu, Val Ala, or Gly
  SITE (180)..(180): Xaa at position 180 is Trp, Tyr, Phe, Met, His, Ile, Leu Val, Ala, or Gly
  SITE (182)..(182): Xaa at position 182 is Val, Ala, Gly, Leu, or Ile
  SITE (183)..(183): Xaa at position 183 is His, Phe, Tyr, Lys, Arg, Gly, Ser Thr, Ala, Val, Leu, Ile, Asn, Met, or Gln
  SITE (184)..(184): Xaa at position 184 is His, Phe, Tyr, Lys, Arg, Gly, Ser Thr, Ala, Val, Leu, Ile, Asn, Met, or Gln
  SITE (195)..(195): Xaa at position 195 is Tyr, Phe, Met, His, Ile, Leu, Val Ala, or Gly
  SITE (202)..(202): Xaa at position 202 is Val, Ala, Gly, Leu, or Ile
  SITE (204)..(204): Xaa at position 204 is Val, Ala, Gly, Leu, or Ile
  SITE (230)..(230): Xaa at position 230 is Ile, Ala, Val, Leu, or Gly
  SITE (232)..(232): Xaa at position 232 is Ile, Ala, Val, Leu, or Gly
  SITE (233)..(233): Xaa at position 233 is Tyr, Phe, Met, His, Ile, Leu, Val Ala, or Gly
  SITE (236)..(236): Xaa at position 236 is Ile, Ala, Val, Leu, or Gly
  SITE (237)..(237): Xaa at position 237 is Val, Ala, Gly, Leu, or Ile
  SITE (242)..(242): Xaa at position 242 is Ile, Ala, Val, Leu, or Gly
  SITE (243)..(243): Xaa at position 243 is Leu, Ala, Val, Gly, or Ile
  SITE (245)..(245): Xaa at position 245 is Ile, Ala, Val, Leu, or Gly
  SITE (251)..(251): Xaa at position 251 is Leu, Ala, Val, Gly, or Ile
  SITE (252)..(252): Xaa at position 252 is Ile, Ala, Val, Leu, or Gly
  SITE (253)..(253): Xaa at position 253 is Ala, Gly, or Pro
  SITE (258)..(258): Xaa at position 258 is Phe, Tyr, Met, His, Ile, Leu, Val Ala, or Gly
  SITE (274)..(274): Xaa at position 274 is Ile, Ala, Val, Leu, or Gly
  SITE (281)..(281): Xaa at position 281 is Cys, Ala, Val, Gly, Ser, or Thr
  SITE (282)..(282): Xaa at position 282 is Ile, Ala, Val, Leu, or Gly
  SITE (288)..(288): Xaa at position 288 is Ile, Ala, Val, Leu, or Gly
  SITE (294)..(294): Xaa at position 294 is undefined in the entry for UniProt ID P03441
  SITE (309)..(309): Xaa at position 309 is Val, Ala, Gly, Leu, or Ile
  SITE (316)..(316): Xaa at position 316 is Leu, Ala, Val, Gly, or Ile
  SITE (317)..(317): Xaa at position 317 is Ala, Gly, or Pro
  SITE (334)..(334): Xaa at position 334 is Ala, Gly, or Pro
  SITE (343)..(343): Xaa at position 343 is Trp, Tyr, Phe, Met, His, Ile, Leu Val, Ala, or Gly
  SITE (347)..(347): Xaa at position 347 is undefined in the entry for UniProt ID P03441
  SITE (348)..(348): Xaa at position 348 is undefined in the entry for UniProt ID P03441
  SITE (351)..(351): Xaa at position 351 is Tyr, Phe, Met, His, Ile, Leu, Val Ala, or Gly
  SITE (373)..(373): Xaa at position 373 is Ala, Gly, or Pro
  SITE (425)..(425): Xaa at position 425 is Ala, Gly, or Pro
  SITE (447)..(447): Xaa at position 447 is Leu, Ala, Val, Gly, or Ile
  SITE (455)..(455): Xaa at position 455 is Leu, Ala, Val, Gly, or Ile
  SITE (466)..(466): Xaa at position 466 is Cys, Ala, Val, Gly, Ser, or Thr
  SITE (467)..(467): Xaa at position 467 is Phe, Tyr, Met, His, Ile, Leu, Val Ala, or Gly
  SITE (469)..(469): Xaa at position 469 is Ile, Ala, Val, Leu, or Gly
  SITE (471)..(471): Xaa at position 471 is His, Phe, Tyr, Lys, Arg, Gly, Ser Thr, Ala, Val, Leu, Ile, Asn, Met, or Gln
  SITE (473)..(473): Xaa at position 473 is Cys, Ala, Val, Gly, Ser, or Thr
  SITE (477)..(477): Xaa at position 477 is Cys, Ala, Val, Gly, Ser, or Thr
  SITE (478)..(478): Xaa at position 478 is Ile, Ala, Val, Leu, or Gly
  SITE (481)..(481): Xaa at position 481 is Ile, Ala, Val, Leu, or Gly
  SITE (495)..(495): Xaa at position 495 is Ala, Gly, or Pro
  SITE (509)..(509): Xaa at position 509 is undefined in the entry for UniProt ID P03441
  SITE (538)..(538): Xaa at position 538 is undefined in the entry for UniProt ID P03441
QNLPGNDNSTXTXXXGHHXVPNGTLXKTITNDQIEXTNATEXXQSSSTGRXXDSPHRXLDGKNXTXXDAXXGDPHXDGXQNEKWDXXXERSKAXSNXXPXDVPDXXSXRSLXXSSGTXEFINEGXNWTGVTQSGGSYXXKRGSDNSXXSRXNWXYESESKYPVXNVTMPNNGNFDKLXIXGXXXPSTDKEQTNLXVRASGRXTXSTKRSQQTIIPNIGSRPWVRGLSSRXSXXWTXXKPGDXXLXNSNGNXXXPRGYXKIRTGKSSIMRSDAPXGTCSSEXXTPNGSXPNDKPXQNVNKITYGACPKYXKQNTLKXXTGMRNVPEKQTRGIFGXIAGFIENGXEGMXXGWXGFRHQNSEGTGQAADLKSTQAXIDQINGKLNRVIEKTNEKFHQIEKEFSEVEGRIQDLEKYVEDTKIDLWSYNXELLVALENQHTIDLTDSEMNKXFEKTRRQXRENAEDMGNGXXKXYXKXDNAXXGSXRNGTYDHDVYRDEXLNNRFQIKGVELKXGYKDWILWISFAISCFLLCVVLLGFIMVXCQKGNIRCNICI

SEQ ID NO: 159 - protein, 564 aa, Influenza A virus
  strain A/Duck/Alberta/60/1976 H12N5
  SITE (20)..(20): Xaa at position 20 is Ile, Ala, Val, Leu, or Gly
  SITE (21)..(21): Xaa at position 21 is Cys, Ala, Val, Gly, Ser, or Thr
  SITE (22)..(22): Xaa at position 22 is Ile, Ala, Val, Leu, or Gly
  SITE (33)..(33): Xaa at position 33 is Val, Ala, Gly, Leu, or Ile
  SITE (43)..(43): Xaa at position 43 is Val, Ala, Gly, Leu, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (69)..(69): Xaa at position 69 is Leu, Ala, Val, Gly, or Ile
  SITE (72)..(72): Xaa at position 72 is Cys, Ala, Val, Gly, Ser, or Thr
  SITE (74)..(74): Xaa at position 74 is Leu, Ala, Val, Gly, or Ile
  SITE (78)..(78): Xaa at position 78 is Ile, Ala, Val, Leu, or Gly
  SITE (79)..(79): Xaa at position 79 is Leu, Ala, Val, Gly, or Ile
  SITE (95)..(95): Xaa at position 95 is Tyr, Phe, Met, His, Ile, Leu, Val Ala, or Gly
  SITE (96)..(96): Xaa at position 96 is Ile, Ala, Val, Leu, or Gly
  SITE (97)..(97): Xaa at position 97 is Val, Ala, Gly, Leu, or Ile
  SITE (118)..(118): Xaa at position 118 is Leu, Ala, Val, Gly, or Ile
  SITE (122)..(122): Xaa at position 122 is Phe, Tyr, Met, His, Ile, Leu, Val Ala, or Gly
  SITE (150)..(150): Xaa at position 150 is Cys, Ala, Val, Gly, Ser, or Thr
  SITE (163)..(163): Xaa at position 163 is Met, Ile, Leu, Val, Ala, or Gly
  SITE (166)..(166): Xaa at position 166 is Leu, Ala, Val, Gly, or Ile
  SITE (188)..(188): Xaa at position 188 is Ile, Ala, Val, Leu, or Gly
  SITE (189)..(189): Xaa at position 189 is Val, Ala, Gly, Leu, or Ile
  SITE (190)..(190): Xaa at position 190 is Phe, Tyr, Met, His, Ile, Leu, Val Ala, or Gly
  SITE (192)..(192): Xaa at position 192 is Trp, Tyr, Phe, Met, His, Ile, Leu Val, Ala, or Gly
  SITE (194)..(194): Xaa at position 194 is Ile, Ala, Val, Leu, or Gly
  SITE (207)..(207): Xaa at position 207 is Tyr, Phe, Met, His, Ile, Leu, Val Ala, or Gly
  SITE (216)..(216): Xaa at position 216 is Val, Ala, Gly, Leu, or Ile
  SITE (242)..(242): Xaa at position 242 is Met, Ile, Leu, Val, Ala, or Gly
  SITE (244)..(244): Xaa at position 244 is Tyr, Phe, Met, His, Ile, Leu, Val Ala, or Gly
  SITE (249)..(249): Xaa at position 249 is Leu, Ala, Val, Gly, or Ile
  SITE (255)..(255): Xaa at position 255 is Val, Ala, Gly, Leu, or Ile
  SITE (257)..(257): Xaa at position 257 is Ile, Ala, Val, Leu, or Gly
  SITE (263)..(263): Xaa at position 263 is Leu, Ala, Val, Gly, or Ile
  SITE (264)..(264): Xaa at position 264 is Ile, Ala, Val, Leu, or Gly
  SITE (265)..(265): Xaa at position 265 is Ala, Gly, or Pro
  SITE (294)..(294): Xaa at position 294 is Cys, Ala, Val, Gly, Ser, or Thr
  SITE (327)..(327): Xaa at position 327 is Leu, Ala, Val, Gly, or Ile
  SITE (347)..(347): Xaa at position 347 is Ala, Gly, or Pro
  SITE (364)..(364): Xaa at position 364 is Tyr, Phe, Met, His, Ile, Leu, Val Ala, or Gly
  SITE (386)..(386): Xaa at position 386 is Ala, Gly, or Pro
  SITE (460)..(460): Xaa at position 460 is Leu, Ala, Val, Gly, or Ile
  SITE (468)..(468): Xaa at position 468 is Leu, Ala, Val, Gly, or Ile
  SITE (484)..(484): Xaa at position 484 is His, Phe, Tyr, Lys, Arg, Gly, Ser Thr, Ala, Val, Leu, Ile, Asn, Met, or Gln
  SITE (486)..(486): Xaa at position 486 is Cys, Ala, Val, Gly, Ser, or Thr
  SITE (490)..(490): Xaa at position 490 is Cys, Ala, Val, Gly, Ser, or Thr
MEKFIILSTVLAASFAYDKXXXGYQTNNSTETXNTLSEQNVPXTQVEELVHRGIDPIXXGTELGSPLVXDDXSXEGLXXGNPKCDLYLNGREWSXXXERPKEMEGVCYPGSIENQEEXRSLXSSIKKYERVKMFDFTKWNVTYTGTSKAXNNTSNQGSFYRSXRWXTLKSGQFPVQTDEYKNTRDSDXXXTXAXHHPPTSDEQVKLXKNPDTLSSXTTVEINRSFKPNIGPRPLVRGQQGRXDXYWAVXKPGQTXKXQTNGNXXXPEYGHLITGKSHGRILKNNLPMGQCVTEXQLNEGVMNTSKPFQNTSKHYIGKCPKYIPSGSXKLAIGLRNVPQVQDRGLFGXIAGFIEGGWPGLVAGWXGFQHQNAEGTGIAADRDSTQRXIDNMQNKLNNVIDKMNKQFEVVNHEFSEVESRINMINSKIDDQITDIWAYNAELLVLLENQKTLDEHDANVRNXHDRVRRVXRENAIDTGDGCFEILXKXDNNXMDTIRNGTYNHKEYEEESKIERQKVNGVKLEENSTYKILSIYSSVASSLVLLLMIIGGFIFGCQNGNVRCTFCI

SEQ ID NO: 160 - protein, 566 aa, Influenza A virus
  strain A/Shearwater/Australia/1972 H6N5
  SITE (8)..(8): Xaa at position 8 is Ala, Gly, or Pro
  SITE (19)..(19): Xaa at position 19 is Ile, Ala, Val, Leu, or Gly
  SITE (21)..(21): Xaa at position 21 is Ile, Ala, Val, Leu, or Gly
  SITE (42)..(42): Xaa at position 42 is Val, Ala, Gly, Leu, or Ile
  SITE (48)..(48): Xaa at position 48 is Leu, Ala, Val, Gly, or Ile
  SITE (49)..(49): Xaa at position 49 is Leu, Ala, Val, Gly, or Ile
  SITE (57)..(57): Xaa at position 57 is Phe, Tyr, Met, His, Ile, Leu, Val Ala, or Gly
  SITE (58)..(58): Xaa at position 58 is Cys, Ala, Val, Gly, Ser, or Thr
  SITE (66)..(66): Xaa at position 66 is Leu, Ala, Val, Gly, or Ile
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (73)..(73): Xaa at position 73 is Ile, Ala, Val, Leu, or Gly
  SITE (76)..(76): Xaa at position 76 is Trp, Tyr, Phe, Met, His, Ile, Leu Val, Ala, or Gly
  SITE (77)..(77): Xaa at position 77 is Ile, Ala, Val, Leu, or Gly
  SITE (78)..(78): Xaa at position 78 is Leu, Ala, Val, Gly, or Ile
  SITE (83)..(83): Xaa at position 83 is Cys, Ala, Val, Gly, Ser, or Thr
  SITE (86)..(86): Xaa at position 86 is Leu, Ala, Val, Gly, or Ile
  SITE (92)..(92): Xaa at position 92 is Trp, Tyr, Phe, Met, His, Ile, Leu Val, Ala, or Gly
  SITE (94)..(94): Xaa at position 94 is Tyr, Phe, Met, His, Ile, Leu, Val Ala, or Gly
  SITE (95)..(95): Xaa at position 95 is Ile, Ala, Val, Leu, or Gly
  SITE (96)..(96): Xaa at position 96 is Val, Ala, Gly, Leu, or Ile
  SITE (107)..(107): Xaa at position 107 is Tyr, Phe, Met, His, Ile, Leu, Val Ala, or Gly
  SITE (117)..(117): Xaa at position 117 is Leu, Ala, Val, Gly, or Ile
  SITE (120)..(120): Xaa at position 120 is Leu, Ala, Val, Gly, or Ile
  SITE (121)..(121): Xaa at position 121 is Ile, Ala, Val, Leu, or Gly
  SITE (127)..(127): Xaa at position 127 is Val, Ala, Gly, Leu, or Ile
  SITE (133)..(133): Xaa at position 133 is Phe, Tyr, Met, His, Ile, Leu, Val Ala, or Gly
  SITE (151)..(151): Xaa at position 151 is Cys, Ala, Val, Gly, Ser, or Thr
  SITE (153)..(153): Xaa at position 153 is Tyr, Phe, Met, His, Ile, Leu, Val Ala, or Gly
  SITE (163)..(163): Xaa at position 163 is Leu, Ala, Val, Gly, or Ile
  SITE (164)..(164): Xaa at position 164 is Leu, Ala, Val, Gly, or Ile
  SITE (165)..(165): Xaa at position 165 is Trp, Tyr, Phe, Met, His, Ile, Leu Val, Ala, or Gly
  SITE (166)..(166): Xaa at position 166 is Ile, Ala, Val, Leu, or Gly
  SITE (177)..(177): Xaa at position 177 is Ile, Ala, Val, Leu, or Gly
  SITE (189)..(189): Xaa at position 189 is Ile, Ala, Val, Leu, or Gly
  SITE (190)..(190): Xaa at position 190 is Leu, Ala, Val, Gly, or Ile
  SITE (191)..(191): Xaa at position 191 is Tyr, Phe, Met, His, Ile, Leu, Val Ala, or Gly
  SITE (192)..(192): Xaa at position 192 is Phe, Tyr, Met, His, Ile, Leu, Val Ala, or Gly
  SITE (193)..(193): Xaa at position 193 is Trp, Tyr, Phe, Met, His, Ile, Leu Val, Ala, or Gly
  SITE (195)..(195): Xaa at position 195 is Val, Ala, Gly, Leu, or Ile
  SITE (196)..(196): Xaa at position 196 is His, Phe, Tyr, Lys, Arg, Gly, Ser Thr, Ala, Val, Leu, Ile, Asn, Met, or Gln
  SITE (197)..(197): Xaa at position 197 is His, Phe, Tyr, Lys, Arg, Gly, Ser Thr, Ala, Val, Leu, Ile, Asn, Met, or Gln
  SITE (208)..(208): Xaa at position 208 is Tyr, Phe, Met, His, Ile, Leu, Val Ala, or Gly
  SITE (215)..(215): Xaa at position 215 is Val, Ala, Gly, Leu, or Ile
  SITE (217)..(217): Xaa at position 217 is Met, Ile, Leu, Val, Ala, or Gly
  SITE (243)..(243): Xaa at position 243 is Ile, Ala, Val, Leu, or Gly
  SITE (245)..(245): Xaa at position 245 is Tyr, Phe, Met, His, Ile, Leu, Val Ala, or Gly
  SITE (249)..(249): Xaa at position 249 is Ile, Ala, Val, Leu, or Gly
  SITE (250)..(250): Xaa at position 250 is Leu, Ala, Val, Gly, or Ile
  SITE (256)..(256): Xaa at position 256 is Leu, Ala, Val, Gly, or Ile
  SITE (258)..(258): Xaa at position 258 is Val, Ala, Gly, Leu, or Ile
  SITE (264)..(264): Xaa at position 264 is Leu, Ala, Val, Gly, or Ile
  SITE (265)..(265): Xaa at position 265 is Ile, Ala, Val, Leu, or Gly
  SITE (266)..(266): Xaa at position 266 is Ala, Gly, or Pro
  SITE (269)..(269): Xaa at position 269 is Tyr, Phe, Met, His, Ile, Leu, Val Ala, or Gly
  SITE (270)..(270): Xaa at position 270 is Ala, Gly, or Pro
  SITE (271)..(271): Xaa at position 271 is Phe, Tyr, Met, His, Ile, Leu, Val Ala, or Gly
  SITE (273)..(273): Xaa at position 273 is Phe, Tyr, Met, His, Ile, Leu, Val Ala, or Gly
  SITE (281)..(281): Xaa at position 281 is Ala, Gly, or Pro
  SITE (292)..(292): Xaa at position 292 is Cys, Ala, Val, Gly, Ser, or Thr
  SITE (296)..(296): Xaa at position 296 is Cys, Ala, Val, Gly, Ser, or Thr
  SITE (302)..(302): Xaa at position 302 is Val, Ala, Gly, Leu, or Ile
  SITE (303)..(303): Xaa at position 303 is Leu, Ala, Val, Gly, or Ile
  SITE (317)..(317): Xaa at position 317 is Ile, Ala, Val, Leu, or Gly
  SITE (324)..(324): Xaa at position 324 is Val, Ala, Gly, Leu, or Ile
  SITE (329)..(329): Xaa at position 329 is Leu, Ala, Val, Gly, or Ile
  SITE (331)..(331): Xaa at position 331 is Leu, Ala, Val, Gly, or Ile
  SITE (332)..(332): Xaa at position 332 is Ala, Gly, or Pro
  SITE (349)..(349): Xaa at position 349 is Ala, Gly, or Pro
  SITE (361)..(361): Xaa at position 361 is Met, Ile, Leu, Val, Ala, or Gly
  SITE (366)..(366): Xaa at position 366 is Tyr, Phe, Met, His, Ile, Leu, Val Ala, or Gly
  SITE (388)..(388): Xaa at position 388 is Ala, Gly, or Pro
  SITE (389)..(389): Xaa at position 389 is Val, Ala, Gly, Leu, or Ile
  SITE (440)..(440): Xaa at position 440 is Ala, Gly, or Pro
  SITE (452)..(452): Xaa at position 452 is Leu, Ala, Val, Gly, or Ile
  SITE (459)..(459): Xaa at position 459 is Val, Ala, Gly, Leu, or Ile
  SITE (462)..(462): Xaa at position 462 is Leu, Ala, Val, Gly, or Ile
  SITE (466)..(466): Xaa at position 466 is Val, Ala, Gly, Leu, or Ile
  SITE (470)..(470): Xaa at position 470 is Leu, Ala, Val, Gly, or Ile
  SITE (481)..(481): Xaa at position 481 is Cys, Ala, Val, Gly, Ser, or Thr
  SITE (486)..(486): Xaa at position 486 is His, Phe, Tyr, Lys, Arg, Gly, Ser Thr, Ala, Val, Leu, Ile, Asn, Met, or Gln
  SITE (488)..(488): Xaa at position 488 is Cys, Ala, Val, Gly, Ser, or Thr
  SITE (492)..(492): Xaa at position 492 is Cys, Ala, Val, Gly, Ser, or Thr
  SITE (493)..(493): Xaa at position 493 is Met, Ile, Leu, Val, Ala, or Gly
MIAIIVVXILATAGRSDKXCXGYHANNSTTQIDTILEKNVTXTHSVEXXENQKEERXXKILKKAPXDXKGXTXEGXXXGNPQXDLXLGDQSXSXXXERPTAQNGICXPGVLNEVEEXKAXXGSGERXERFEMXPKSTWTGVDTSSGVTRAXPXNSGSSFYRNXXXXIKTKSAAYSVXKGAYNNTGNQPXXXXXGXXXPPDTNEQNTLXGSGDRYXRXGTESMNFAKSPEIAARPAVNGQRGRXDXYWSXXKPGETXNXESNGNXXXPWXXXRXVSTSNKGXVFKSNLPIENXDATXQTVAGXXRTNKTFQNVSPLWXGECPKYXKSESXRXXTGLRNVPQIETRGLFGXIAGFIEGGWTGXIDGWXGYHHENSQGSGYAADRESTQKXXDGITNKVNSIIDKMNTQFEAVDHEFSNLERRIDNLNKRMEDGFLDVWTYNXELLVLLENERTXDLHDANXKNXYERXKSQXRDNAMILGNGXFEFWXKXDDEXXESVKNGTYDYPKYQDESKLNRQEIESVKLESLGVYQILAIYSTVSSSLVLVGLIIAVGLWMCSNGSMQCRICI

SEQ ID NO: 161 - protein, 565 aa, Influenza A virus
  strain A/Turkey/Ontario/6118/1968 H8N4
  SITE (19)..(19): Xaa at position 19 is Ile, Ala, Val, Leu, or Gly
  SITE (20)..(20): Xaa at position 20 is Cys, Ala, Val, Gly, Ser, or Thr
  SITE (21)..(21): Xaa at position 21 is Ile, Ala, Val, Leu, or Gly
  SITE (32)..(32): Xaa at position 32 is Val, Ala, Gly, Leu, or Ile
  SITE (42)..(42): Xaa at position 42 is Val, Ala, Gly, Leu, or Ile
  SITE (57)..(57): Xaa at position 57 is Tyr, Phe, Met, His, Ile, Leu, Val Ala, or Gly
  SITE (58)..(58): Xaa at position 58 is Cys, Ala, Val, Gly, Ser, or Thr
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (73)..(73): Xaa at position 73 is Ile, Ala, Val, Leu, or Gly
  SITE (77)..(77): Xaa at position 77 is Ile, Ala, Val, Leu, or Gly
  SITE (78)..(78): Xaa at position 78 is Tyr, Phe, Met, His, Ile, Leu, Val Ala, or Gly
  SITE (94)..(94): Xaa at position 94 is Tyr, Phe, Met, His, Ile, Leu, Val Ala, or Gly
  SITE (95)..(95): Xaa at position 95 is Ile, Ala, Val, Leu, or Gly
  SITE (96)..(96): Xaa at position 96 is Val, Ala, Gly, Leu, or Ile
  SITE (117)..(117): Xaa at position 117 is Leu, Ala, Val, Gly, or Ile
  SITE (121)..(121): Xaa at position 121 is Phe, Tyr, Met, His, Ile, Leu, Val Ala, or Gly
  SITE (149)..(149): Xaa at position 149 is Cys, Ala, Val, Gly, Ser, or Thr
  SITE (162)..(162): Xaa at position 162 is Ile, Ala, Val, Leu, or Gly
  SITE (165)..(165): Xaa at position 165 is Leu, Ala, Val, Gly, or Ile
  SITE (188)..(188): Xaa at position 188 is Ile, Ala, Val, Leu, or Gly
  SITE (189)..(189): Xaa at position 189 is Ile, Ala, Val, Leu, or Gly
  SITE (190)..(190): Xaa at position 190 is Phe, Tyr, Met, His, Ile, Leu, Val Ala, or Gly
  SITE (191)..(191): Xaa at position 191 is Leu, Ala, Val, Gly, or Ile
  SITE (192)..(192): Xaa at position 192 is Trp, Tyr, Phe, Met, His, Ile, Leu Val, Ala, or Gly
  SITE (194)..(194): Xaa at position 194 is Ile, Ala, Val, Leu, or Gly
  SITE (207)..(207): Xaa at position 207 is Tyr, Phe, Met, His, Ile, Leu, Val Ala, or Gly
  SITE (216)..(216): Xaa at position 216 is Val, Ala, Gly, Leu, or Ile
  SITE (242)..(242): Xaa at position 242 is Met, Ile, Leu, Val, Ala, or Gly
  SITE (244)..(244): Xaa at position 244 is Tyr, Phe, Met, His, Ile, Leu, Val Ala, or Gly
  SITE (249)..(249): Xaa at position 249 is Leu, Ala, Val, Gly, or Ile
  SITE (255)..(255): Xaa at position 255 is Leu, Ala, Val, Gly, or Ile
  SITE (257)..(257): Xaa at position 257 is Ile, Ala, Val, Leu, or Gly
  SITE (263)..(263): Xaa at position 263 is Leu, Ala, Val, Gly, or Ile
  SITE (264)..(264): Xaa at position 264 is Ile, Ala, Val, Leu, or Gly
  SITE (265)..(265): Xaa at position 265 is Ala, Gly, or Pro
  SITE (295)..(295): Xaa at position 295 is Cys, Ala, Val, Gly, Ser, or Thr
  SITE (348)..(348): Xaa at position 348 is Ala, Gly, or Pro
  SITE (365)..(365): Xaa at position 365 is Tyr, Phe, Met, His, Ile, Leu, Val Ala, or Gly
  SITE (387)..(387): Xaa at position 387 is Ala, Gly, or Pro
  SITE (461)..(461): Xaa at position 461 is Leu, Ala, Val, Gly, or Ile
  SITE (469)..(469): Xaa at position 469 is Leu, Ala, Val, Gly, or Ile
  SITE (485)..(485): Xaa at position 485 is His, Phe, Tyr, Lys, Arg, Gly, Ser Thr, Ala, Val, Leu, Ile, Asn, Met, or Gln
  SITE (487)..(487): Xaa at position 487 is Cys, Ala, Val, Gly, Ser, or Thr
  SITE (491)..(491): Xaa at position 491 is Cys, Ala, Val, Gly, Ser, or Thr
  SITE (509)..(509): Xaa at position 509 is Ala, Gly, or Pro
MEKFIAIATLASTNAYDRXXXGYQSNNSTDTXNTLIEQNVPXTQTMELVETEKHPAXXNTDLGAPLEXRDXKXEAVXXGNPKCDIHLKDQGWSXXXERPSAPEGMCYPGSVENLEEXRFVXSSAASYKRIRLFDYSRWNVTRSGTSKAXNASTGGQSFYRSXNWXTKKEPDTYDFNEGAYVNNEDGDXXXXXGXHHPPDTKEQTTLXKNANTLSSXTTNTINRSFQPNIGPRPLVRGQQGRXDXYWGIXKRGETXKXRTNGNXXXPEFGYLLKGESYGRIIQNEDIPIGNCNTKXQTYAGAINSSKPFQNASRHYMGECPKYVKKASLRLAVGLRNTPSVEPRGLFGXIAGFIEGGWSGMIDGWXGFHHSNSEGTGMAADQKSTQEXIDKITNKVNNIVDKMNREFEVVNHEFSEVEKRINMINDKIDDQIEDLWAYNAELLVLLENQKTLDEHDSNVKNXFDEVKRRXSANAIDAGNGCFDILXKXDNEXMETIKNGTYDHKEYEEEXKLERSKINGVKLEENTTYKILSIYSTVAASLCLAILIAGGLILGMQNGSCRCMFCI

SEQ ID NO: 162 - protein, 560 aa, Influenza A virus
  strain A/Turkey/Wisconsin/1/1966 H9N2
  SITE (10)..(10): Xaa at position 10 is Leu, Ala, Val, Gly, or Ile
  SITE (21)..(21): Xaa at position 21 is Ile, Ala, Val, Leu, or Gly
  SITE (22)..(22): Xaa at position 22 is Cys, Ala, Val, Gly, Ser, or Thr
  SITE (23)..(23): Xaa at position 23 is Ile, Ala, Val, Leu, or Gly
  SITE (34)..(34): Xaa at position 34 is Val, Ala, Gly, Leu, or Ile
  SITE (44)..(44): Xaa at position 44 is Val, Ala, Gly, Leu, or Ile
  SITE (51)..(51): Xaa at position 51 is Leu, Ala, Val, Gly, or Ile
  SITE (59)..(59): Xaa at position 59 is Leu, Ala, Val, Gly, or Ile
  SITE (60)..(60): Xaa at position 60 is Cys, Ala, Val, Gly, Ser, or Thr
  SITE (68)..(68): Xaa at position 68 is Leu, Ala, Val, Gly, or Ile
  SITE (70)..(70): Xaa at position 70 is Leu, Ala, Val, Gly, or Ile
  SITE (73)..(73): Xaa at position 73 is Cys, Ala, Val, Gly, Ser, or Thr
  SITE (75)..(75): Xaa at position 75 is Ile, Ala, Val, Leu, or Gly
  SITE (79)..(79): Xaa at position 79 is Ile, Ala, Val, Leu, or Gly
  SITE (80)..(80): Xaa at position 80 is Tyr, Phe, Met, His, Ile, Leu, Val Ala, or Gly
  SITE (96)..(96): Xaa at position 96 is Tyr, Phe, Met, His, Ile, Leu, Val Ala, or Gly
  SITE (97)..(97): Xaa at position 97 is Ile, Ala, Val, Leu, or Gly
  SITE (98)..(98): Xaa at position 98 is Val, Ala, Gly, Leu, or Ile
  SITE (119)..(119): Xaa at position 119 is Leu, Ala, Val, Gly, or Ile
  SITE (123)..(123): Xaa at position 123 is Phe, Tyr, Met, His, Ile, Leu, Val Ala, or Gly
  SITE (151)..(151): Xaa at position 151 is Cys, Ala, Val, Gly, Ser, or Thr
  SITE (159)..(159): Xaa at position 159 is Met, Ile, Leu, Val, Ala, or Gly
  SITE (162)..(162): Xaa at position 162 is Leu, Ala, Val, Gly, or Ile
  SITE (174)..(174): Xaa at position 174 is Ala, Gly, or Pro
  SITE (184)..(184): Xaa at position 184 is Ile, Ala, Val, Leu, or Gly
  SITE (185)..(185): Xaa at position 185 is Leu, Ala, Val, Gly, or Ile
  SITE (186)..(186): Xaa at position 186 is Phe, Tyr, Met, His, Ile, Leu, Val Ala, or Gly
  SITE (187)..(187): Xaa at position 187 is Met, Ile, Leu, Val, Ala, or Gly
  SITE (188)..(188): Xaa at position 188 is Trp, Tyr, Phe, Met, His, Ile, Leu Val, Ala, or Gly
  SITE (190)..(190): Xaa at position 190 is Ile, Ala, Val, Leu, or Gly
  SITE (203)..(203): Xaa at position 203 is Tyr, Phe, Met, His, Ile, Leu, Val Ala, or Gly
  SITE (212)..(212): Xaa at position 212 is Val, Ala, Gly, Leu, or Ile
  SITE (238)..(238): Xaa at position 238 is Ile, Ala, Val, Leu, or Gly
  SITE (240)..(240): Xaa at position 240 is Tyr, Phe, Met, His, Ile, Leu, Val Ala, or Gly
  SITE (245)..(245): Xaa at position 245 is Leu, Ala, Val, Gly, or Ile
  SITE (251)..(251): Xaa at position 251 is Leu, Ala, Val, Gly, or Ile
  SITE (253)..(253): Xaa at position 253 is Ile, Ala, Val, Leu, or Gly
  SITE (259)..(259): Xaa at position 259 is Leu, Ala, Val, Gly, or Ile
  SITE (260)..(260): Xaa at position 260 is Ile, Ala, Val, Leu, or Gly
  SITE (261)..(261): Xaa at position 261 is Ala, Gly, or Pro
  SITE (290)..(290): Xaa at position 290 is Cys, Ala, Val, Gly, Ser, or Thr
  SITE (304)..(304): Xaa at position 304 is His, Phe, Tyr, Lys, Arg, Gly, Ser Thr, Ala, Val, Leu, Ile, Asn, Met, or Gln
  SITE (323)..(323): Xaa at position 323 is Leu, Ala, Val, Gly, or Ile
  SITE (343)..(343): Xaa at position 343 is Ala, Gly, or Pro
  SITE (360)..(360): Xaa at position 360 is Tyr, Phe, Met, His, Ile, Leu, Val Ala, or Gly
  SITE (382)..(382): Xaa at position 382 is Ala, Gly, or Pro
  SITE (456)..(456): Xaa at position 456 is Leu, Ala, Val, Gly, or Ile
  SITE (464)..(464): Xaa at position 464 is Leu, Ala, Val, Gly, or Ile
  SITE (480)..(480): Xaa at position 480 is His, Phe, Tyr, Lys, Arg, Gly, Ser Thr, Ala, Val, Leu, Ile, Asn, Met, or Gln
  SITE (482)..(482): Xaa at position 482 is Cys, Ala, Val, Gly, Ser, or Thr
  SITE (486)..(486): Xaa at position 486 is Cys, Ala, Val, Gly, Ser, or Thr
METKAIIAAXLMVTAANADKXXXGYQSTNSTETXDTLTESNVPXTHTKELXHTEHNGMXXATDLGHPXIXDTXTXEGLXXGNPSCDILLGGKEWSXXXERSSAVNGMCYPGNVENLEEXRSLXSSAKSYKRIQIFPDKTWNVTYSGTSRAXSNSFYRSXRWXTHKSNSYPFQNXHYTNNERENXXXXXGXHHPPTDTEQTDLXKNADTTTSXTTEDINRTFKPVIGPRPLVNGQQGRXDXYWSVXKPGQTXRXRSNGNXXXPWYGHVLTGESHGRILKTDLNNGNCVVQXQTEKGGLNTTLPFXNISKYAFGNCPKYVGVKSXKLPVGLRNVPAVSSRGLFGXIAGFIEGGWPGLVAGWXGFQHSNDQGVGMAADKGSTQKXIDKITSKVNNIIDKMNKQYEVIDHEFNELEARLNMINNKIDDQIQDIWAYNAELLVLLENQKTLDEHDANVNNXYNKVKRAXGSNAVEDGNGCFELYXKXDDQXMETIRNGTYDRQKYQEESRLERQKIEGVKLESEGTYKILTIYSTVASSLVLAMGFAAFLFWAMSNGSCRCNICI

SEQ ID NO: 163 - protein, 469 aa, Influenza A virus
  strain A/Memphis/1/1971 H3N2
  SITE (87)..(87): Xaa at position 87 is Trp, Tyr, Phe, Met, His, Ile, Leu Val, Ala, or Gly
  SITE (94)..(94): Xaa at position 94 is Ile, Ala, Val, Leu, or Gly
  SITE (97)..(97): Xaa at position 97 is Phe, Tyr, Met, His, Ile, Leu, Val Ala, or Gly
  SITE (106)..(106): Xaa at position 106 is Ile, Ala, Val, Leu, or Gly
  SITE (114)..(114): Xaa at position 114 is Ile, Ala, Val, Leu, or Gly
  SITE (116)..(116): Xaa at position 116 is Val, Ala, Gly, Leu, or Ile
  SITE (121)..(121): Xaa at position 121 is Tyr, Phe, Met, His, Ile, Leu, Val Ala, or Gly
  SITE (122)..(122): Xaa at position 122 is Val, Ala, Gly, Leu, or Ile
  SITE (124)..(124): Xaa at position 124 is Cys, Ala, Val, Gly, Ser, or Thr
  SITE (132)..(132): Xaa at position 132 is Phe, Tyr, Met, His, Ile, Leu, Val Ala, or Gly
  SITE (133)..(133): Xaa at position 133 is Ala, Gly, or Pro
  SITE (134)..(134): Xaa at position 134 is Leu, Ala, Val, Gly, or Ile
  SITE (140)..(140): Xaa at position 140 is Leu, Ala, Val, Gly, or Ile
  SITE (158)..(158): Xaa at position 158 is Leu, Ala, Val, Gly, or Ile
  SITE (159)..(159): Xaa at position 159 is Leu, Ala, Val, Gly, or Ile
  SITE (175)..(175): Xaa at position 175 is Cys, Ala, Val, Gly, Ser, or Thr
  SITE (177)..(177): Xaa at position 177 is Ala, Gly, or Pro
  SITE (183)..(183): Xaa at position 183 is Cys, Ala, Val, Gly, Ser, or Thr
  SITE (190)..(190): Xaa at position 190 is Leu, Ala, Val, Gly, or Ile
  SITE (192)..(192): Xaa at position 192 is Val, Ala, Gly, Leu, or Ile
  SITE (193)..(193): Xaa at position 193 is Cys, Ala, Val, Gly, Ser, or Thr
  SITE (194)..(194): Xaa at position 194 is Val, Ala, Gly, Leu, or Ile
  SITE (201)..(201): Xaa at position 201 is Ala, Gly, or Pro
  SITE (203)..(203): Xaa at position 203 is Ala, Gly, or Pro
  SITE (205)..(205): Xaa at position 205 is Phe, Tyr, Met, His, Ile, Leu, Val Ala, or Gly
  SITE (207)..(207): Xaa at position 207 is Tyr, Phe, Met, His, Ile, Leu, Val Ala, or Gly
  SITE (223)..(223): Xaa at position 223 is Leu, Ala, Val, Gly, or Ile
  SITE (230)..(230): Xaa at position 230 is Cys, Ala, Val, Gly, Ser, or Thr
  SITE (231)..(231): Xaa at position 231 is Val, Ala, Gly, Leu, or Ile
  SITE (232)..(232): Xaa at position 232 is Cys, Ala, Val, Gly, Ser, or Thr
  SITE (239)..(239): Xaa at position 239 is Val, Ala, Gly, Leu, or Ile
  SITE (240)..(240): Xaa at position 240 is Val, Ala, Gly, Leu, or Ile
  SITE (241)..(241): Xaa at position 241 is Met, Ile, Leu, Val, Ala, or Gly
  SITE (254)..(254): Xaa at position 254 is Ile, Ala, Val, Leu, or Gly
  SITE (255)..(255): Xaa at position 255 is Leu, Ala, Val, Gly, or Ile
  SITE (256)..(256): Xaa at position 256 is Phe, Tyr, Met, His, Ile, Leu, Val Ala, or Gly
  SITE (257)..(257): Xaa at position 257 is Ile, Ala, Val, Leu, or Gly
  SITE (275)..(275): Xaa at position 275 is Val, Ala, Gly, Leu, or Ile
  SITE (278)..(278): Xaa at position 278 is Cys, Ala, Val, Gly, Ser, or Thr
  SITE (280)..(280): Xaa at position 280 is Cys, Ala, Val, Gly, Ser, or Thr
  SITE (281)..(281): Xaa at position 281 is Tyr, Phe, Met, His, Ile, Leu, Val Ala, or Gly
  SITE (284)..(284): Xaa at position 284 is Tyr, Phe, Met, His, Ile, Leu, Val Ala, or Gly
  SITE (287)..(287): Xaa at position 287 is Val, Ala, Gly, Leu, or Ile
  SITE (289)..(289): Xaa at position 289 is Cys, Ala, Val, Gly, Ser, or Thr
  SITE (290)..(290): Xaa at position 290 is Ile, Ala, Val, Leu, or Gly
  SITE (291)..(291): Xaa at position 291 is Cys, Ala, Val, Gly, Ser, or Thr
  SITE (302)..(302): Xaa at position 302 is Val, Ala, Gly, Leu, or Ile
  SITE (303)..(303): Xaa at position 303 is Val, Ala, Gly, Leu, or Ile
  SITE (305)..(305): Xaa at position 305 is Ile, Ala, Val, Leu, or Gly
  SITE (316)..(316): Xaa at position 316 is Tyr, Phe, Met, His, Ile, Leu, Val Ala, or Gly
  SITE (317)..(317): Xaa at position 317 is Val, Ala, Gly, Leu, or Ile
  SITE (318)..(318): Xaa at position 318 is Cys, Ala, Val, Gly, Ser, or Thr
  SITE (321)..(321): Xaa at position 321 is Leu, Ala, Val, Gly, or Ile
  SITE (322)..(322): Xaa at position 322 is Val, Ala, Gly, Leu, or Ile
  SITE (349)..(349): Xaa at position 349 is Val, Ala, Gly, Leu, or Ile
  SITE (352)..(352): Xaa at position 352 is Trp, Tyr, Phe, Met, His, Ile, Leu Val, Ala, or Gly
  SITE (353)..(353): Xaa at position 353 is Ala, Gly, or Pro
  SITE (354)..(354): Xaa at position 354 is Phe, Tyr, Met, His, Ile, Leu, Val Ala, or Gly
  SITE (360)..(360): Xaa at position 360 is Val, Ala, Gly, Leu, or Ile
  SITE (361)..(361): Xaa at position 361 is Trp, Tyr, Phe, Met, His, Ile, Leu Val, Ala, or Gly
  SITE (362)..(362): Xaa at position 362 is Met, Ile, Leu, Val, Ala, or Gly
  SITE (374)..(374): Xaa at position 374 is Tyr, Phe, Met, His, Ile, Leu, Val Ala, or Gly
  SITE (377)..(377): Xaa at position 377 is Phe, Tyr, Met, His, Ile, Leu, Val Ala, or Gly
  SITE (379)..(379): Xaa at position 379 is Val, Ala, Gly, Leu, or Ile
  SITE (397)..(397): Xaa at position 397 is Ile, Ala, Val, Leu, or Gly
  SITE (398)..(398): Xaa at position 398 is Val, Ala, Gly, Leu, or Ile
  SITE (409)..(409): Xaa at position 409 is Ile, Ala, Val, Leu, or Gly
  SITE (410)..(410): Xaa at position 410 is Phe, Tyr, Met, His, Ile, Leu, Val Ala, or Gly
  SITE (418)..(418): Xaa at position 418 is Ile, Ala, Val, Leu, or Gly
  SITE (421)..(421): Xaa at position 421 is Cys, Ala, Val, Gly, Ser, or Thr
  SITE (422)..(422): Xaa at position 422 is Phe, Tyr, Met, His, Ile, Leu, Val Ala, or Gly
  SITE (423)..(423): Xaa at position 423 is Tyr, Phe, Met, His, Ile, Leu, Val Ala, or Gly
  SITE (424)..(424): Xaa at position 424 is Val, Ala, Gly, Leu, or Ile
  SITE (426)..(426): Xaa at position 426 is Leu, Ala, Val, Gly, or Ile
  SITE (436)..(436): Xaa at position 436 is Val, Ala, Gly, Leu, or Ile
  SITE (438)..(438): Xaa at position 438 is Trp, Tyr, Phe, Met, His, Ile, Leu Val, Ala, or Gly
  SITE (443)..(443): Xaa at position 443 is Ile, Ala, Val, Leu, or Gly
  SITE (444)..(444): Xaa at position 444 is Val, Ala, Gly, Leu, or Ile
  SITE (445)..(445): Xaa at position 445 is Val, Ala, Gly, Leu, or Ile
  SITE (446)..(446): Xaa at position 446 is Phe, Tyr, Met, His, Ile, Leu, Val Ala, or Gly
  SITE (464)..(464): Xaa at position 464 is Ile, Ala, Val, Leu, or Gly
MNPNQKIITIGSVSLTIATVCFLMQIAILVTTVTLHFKQYECDSPANNQVMPCEPIIIERNITEIVYLTNTTIEKEICPKLVEYRNXSKPQCKXTGXAPFSKDNSXRLSAGGDXWXTREPXXSXDPGKCYQXXXGQGTTXDNKHSNDTIHDRIPHRTXXMNELGVPFHLGTRQVXIXWSSSSXHDGKAWXHXXXTGDDKNXTXSXIXDGRLVDSIGSWSQNIXRTQESEXXXINGTCTXXXTDGSASGRADTRXXXXEEGKIVHISPLSGSAQHXEEXSXXPRXPGXRXXXRDNWKGSNRPXXDXNVKDYSIDSRXXXSGXXGDTPRNNDRSSNSNCRNPNNDKGNHGXKGXXXDDGNDXXXGRTISKDSRSGXETXKXIGGWSTPNSKSQINRQVXXDSDNRSGYSGXXSVEGKSCXNRXXXXEXIRGREQETRXWXTSNSXXXXCGTSGTYGTGSWPDGADXNLMPI

SEQ ID NO: 164 - protein, 470 aa, Influenza A virus
  strain A/Tern/Australia/G70C/1975 H11N9
  SITE (88)..(88): Xaa at position 88 is Leu, Ala, Val, Gly, or Ile
  SITE (95)..(95): Xaa at position 95 is Ile, Ala, Val, Leu, or Gly
  SITE (106)..(106): Xaa at position 106 is Ala, Gly, or Pro
  SITE (107)..(107): Xaa at position 107 is Val, Ala, Gly, Leu, or Ile
  SITE (115)..(115): Xaa at position 115 is Val, Ala, Gly, Leu, or Ile
  SITE (117)..(117): Xaa at position 117 is Val, Ala, Gly, Leu, or Ile
  SITE (122)..(122): Xaa at position 122 is Tyr, Phe, Met, His, Ile, Leu, Val Ala, or Gly
  SITE (123)..(123): Xaa at position 123 is Val, Ala, Gly, Leu, or Ile
  SITE (125)..(125): Xaa at position 125 is Cys, Ala, Val, Gly, Ser, or Thr
  SITE (132)..(132): Xaa at position 132 is Phe, Tyr, Met, His, Ile, Leu, Val Ala, or Gly
  SITE (133)..(133): Xaa at position 133 is Tyr, Phe, Met, His, Ile, Leu, Val Ala, or Gly
  SITE (134)..(134): Xaa at position 134 is Ala, Gly, or Pro
  SITE (135)..(135): Xaa at position 135 is Leu, Ala, Val, Gly, or Ile
  SITE (159)..(159): Xaa at position 159 is Leu, Ala, Val, Gly, or Ile
  SITE (160)..(160): Xaa at position 160 is Ile, Ala, Val, Leu, or Gly
  SITE (162)..(162): Xaa at position 162 is Trp, Tyr, Phe, Met, His, Ile, Leu Val, Ala, or Gly
  SITE (177)..(177): Xaa at position 177 is Cys, Ala, Val, Gly, Ser, or Thr
  SITE (178)..(178): Xaa at position 178 is Ile, Ala, Val, Leu, or Gly
  SITE (185)..(185): Xaa at position 185 is Cys, Ala, Val, Gly, Ser, or Thr
  SITE (192)..(192): Xaa at position 192 is Met, Ile, Leu, Val, Ala, or Gly
  SITE (194)..(194): Xaa at position 194 is Ile, Ala, Val, Leu, or Gly
  SITE (195)..(195): Xaa at position 195 is Cys, Ala, Val, Gly, Ser, or Thr
  SITE (196)..(196): Xaa at position 196 is Ile, Ala, Val, Leu, or Gly
  SITE (203)..(203): Xaa at position 203 is Ala, Gly, or Pro
  SITE (205)..(205): Xaa at position 205 is Ala, Gly, or Pro
  SITE (206)..(206): Xaa at position 206 is Val, Ala, Gly, Leu, or Ile
  SITE (207)..(207): Xaa at position 207 is Ile, Ala, Val, Leu, or Gly
  SITE (209)..(209): Xaa at position 209 is Tyr, Phe, Met, His, Ile, Leu, Val Ala, or Gly
  SITE (221)..(221): Xaa at position 221 is Ala, Gly, or Pro
  SITE (225)..(225): Xaa at position 225 is Leu, Ala, Val, Gly, or Ile
  SITE (232)..(232): Xaa at position 232 is Cys, Ala, Val, Gly, Ser, or Thr
  SITE (233)..(233): Xaa at position 233 is Val, Ala, Gly, Leu, or Ile
  SITE (234)..(234): Xaa at position 234 is Cys, Ala, Val, Gly, Ser, or Thr
  SITE (239)..(239): Xaa at position 239 is Cys, Ala, Val, Gly, Ser, or Thr
  SITE (241)..(241): Xaa at position 241 is Val, Ala, Gly, Leu, or Ile
  SITE (242)..(242): Xaa at position 242 is Val, Ala, Gly, Leu, or Ile
  SITE (243)..(243): Xaa at position 243 is Phe, Tyr, Met, His, Ile, Leu, Val Ala, or Gly
  SITE (256)..(256): Xaa at position 256 is Ile, Ala, Val, Leu, or Gly
  SITE (257)..(257): Xaa at position 257 is Tyr, Phe, Met, His, Ile, Leu, Val Ala, or Gly
  SITE (258)..(258): Xaa at position 258 is Tyr, Phe, Met, His, Ile, Leu, Val Ala, or Gly
  SITE (259)..(259): Xaa at position 259 is Phe, Tyr, Met, His, Ile, Leu, Val Ala, or Gly
  SITE (276)..(276): Xaa at position 276 is His, Phe, Tyr, Lys, Arg, Gly, Ser Thr, Ala, Val, Leu, Ile, Asn, Met, or Gln
  SITE (277)..(277): Xaa at position 277 is Ile, Ala, Val, Leu, or Gly
  SITE (280)..(280): Xaa at position 280 is Cys, Ala, Val, Gly, Ser, or Thr
  SITE (282)..(282): Xaa at position 282 is Cys, Ala, Val, Gly, Ser, or Thr
  SITE (283)..(283): Xaa at position 283 is Tyr, Phe, Met, His, Ile, Leu, Val Ala, or Gly
  SITE (289)..(289): Xaa at position 289 is Ile, Ala, Val, Leu, or Gly
  SITE (291)..(291): Xaa at position 291 is Cys, Ala, Val, Gly, Ser, or Thr
  SITE (293)..(293): Xaa at position 293 is Cys, Ala, Val, Gly, Ser, or Thr
  SITE (304)..(304): Xaa at position 304 is Val, Ala, Gly, Leu, or Ile
  SITE (305)..(305): Xaa at position 305 is Ile, Ala, Val, Leu, or Gly
  SITE (307)..(307): Xaa at position 307 is Ile, Ala, Val, Leu, or Gly
  SITE (318)..(318): Xaa at position 318 is Tyr, Phe, Met, His, Ile, Leu, Val Ala, or Gly
  SITE (319)..(319): Xaa at position 319 is Ile, Ala, Val, Leu, or Gly
  SITE (320)..(320): Xaa at position 320 is Cys, Ala, Val, Gly, Ser, or Thr
  SITE (323)..(323): Xaa at position 323 is Val, Ala, Gly, Leu, or Ile
  SITE (324)..(324): Xaa at position 324 is Leu, Ala, Val, Gly, or Ile
  SITE (350)..(350): Xaa at position 350 is Val, Ala, Gly, Leu, or Ile
  SITE (353)..(353): Xaa at position 353 is Phe, Tyr, Met, His, Ile, Leu, Val Ala, or Gly
  SITE (355)..(355): Xaa at position 355 is Tyr, Phe, Met, His, Ile, Leu, Val Ala, or Gly
  SITE (362)..(362): Xaa at position 362 is Trp, Tyr, Phe, Met, His, Ile, Leu Val, Ala, or Gly
  SITE (363)..(363): Xaa at position 363 is Leu, Ala, Val, Gly, or Ile
  SITE (369)..(369): Xaa at position 369 is Ile, Ala, Val, Leu, or Gly
  SITE (375)..(375): Xaa at position 375 is Tyr, Phe, Met, His, Ile, Leu, Val Ala, or Gly
  SITE (377)..(377): Xaa at position 377 is Met, Ile, Leu, Val, Ala, or Gly
  SITE (378)..(378): Xaa at position 378 is Leu, Ala, Val, Gly, or Ile
  SITE (380)..(380): Xaa at position 380 is Val, Ala, Gly, Leu, or Ile
  SITE (383)..(383): Xaa at position 383 is Ala, Gly, or Pro
  SITE (397)..(397): Xaa at position 397 is Ile, Ala, Val, Leu, or Gly
  SITE (398)..(398): Xaa at position 398 is Val, Ala, Gly, Leu, or Ile
  SITE (410)..(410): Xaa at position 410 is Phe, Tyr, Met, His, Ile, Leu, Val Ala, or Gly
  SITE (411)..(411): Xaa at position 411 is Met, Ile, Leu, Val, Ala, or Gly
  SITE (420)..(420): Xaa at position 420 is Tyr, Phe, Met, His, Ile, Leu, Val Ala, or Gly
  SITE (422)..(422): Xaa at position 422 is Ala, Gly, or Pro
  SITE (423)..(423): Xaa at position 423 is Cys, Ala, Val, Gly, Ser, or Thr
  SITE (424)..(424): Xaa at position 424 is Phe, Tyr, Met, His, Ile, Leu, Val Ala, or Gly
  SITE (425)..(425): Xaa at position 425 is Tyr, Phe, Met, His, Ile, Leu, Val Ala, or Gly
  SITE (426)..(426): Xaa at position 426 is Val, Ala, Gly, Leu, or Ile
  SITE (428)..(428): Xaa at position 428 is Leu, Ala, Val, Gly, or Ile
  SITE (438)..(438): Xaa at position 438 is Val, Ala, Gly, Leu, or Ile
  SITE (445)..(445): Xaa at position 445 is Ile, Ala, Val, Leu, or Gly
  SITE (446)..(446): Xaa at position 446 is Val, Ala, Gly, Leu, or Ile
  SITE (448)..(448): Xaa at position 448 is Met, Ile, Leu, Val, Ala, or Gly
  SITE (449)..(449): Xaa at position 449 is Cys, Ala, Val, Gly, Ser, or Thr
  SITE (464)..(464): Xaa at position 464 is Ala, Gly, or Pro
MNPNQKILCTSATALVIGTIAVLIGITNLGLNIGLHLKPSCNCSHSQPEATNASQTIINNYYNDTNITQISNTNIQVEERAIRDFNNXTKGLCTXNSWHIYGKDNXXRIGEDSDXLXTREPXXSXDPDECRXXXXSQGTTIRGKHSNGTIHDRSQYRAXXSXPLSSPPTVYNSRVEXXGWSSTSXHDGKTRXSXXXSGPNNNXSXXXWXNRRPVTEINTWXRNIXRTQESEXXXHNGVXPXXXTDGSATGPAETRXXXXKEGKILKWEPLAGTAKXXEEXSXXGERAEXTXTXRDNWQGSNRPXXRXDPVAMTHTSQXXXSPXXTDNPRPNDPTVGKCNDPYPGNNNNGXKGXSXLDGVNTXXGRTISXASRSGXEXXKXPNXLTDDKSKPTQGQTXXLNTDWSGYSGSXXDYWAEGECXRXXXXXEXIRGRPKEDKXWWTSNSXXSXXSSTEFLGQWDWPDGXKIEYFL

SEQ ID NO: 165 - protein, 466 aa, Influenza B virus
  strain B/Lee/1940
  SITE (92)..(92): Xaa at position 92 is Phe, Tyr, Met, His, Ile, Leu, Val Ala, or Gly
  SITE (114)..(114): Xaa at position 114 is Ile, Ala, Val, Leu, or Gly
  SITE (115)..(115): Xaa at position 115 is Ile, Ala, Val, Leu, or Gly
  SITE (119)..(119): Xaa at position 119 is Phe, Tyr, Met, His, Ile, Leu, Val Ala, or Gly
  SITE (120)..(120): Xaa at position 120 is Val, Ala, Gly, Leu, or Ile
  SITE (121)..(121): Xaa at position 121 is Ala, Gly, or Pro
  SITE (130)..(130): Xaa at position 130 is Phe, Tyr, Met, His, Ile, Leu, Val Ala, or Gly
  SITE (132)..(132): Xaa at position 132 is Leu, Ala, Val, Gly, or Ile
  SITE (156)..(156): Xaa at position 156 is Leu, Ala, Val, Gly, or Ile
  SITE (159)..(159): Xaa at position 159 is Val, Ala, Gly, Leu, or Ile
  SITE (175)..(175): Xaa at position 175 is Ala, Gly, or Pro
  SITE (176)..(176): Xaa at position 176 is Ala, Gly, or Pro
  SITE (181)..(181): Xaa at position 181 is Ala, Gly, or Pro
  SITE (182)..(182): Xaa at position 182 is Cys, Ala, Val, Gly, Ser, or Thr
  SITE (191)..(191): Xaa at position 191 is Ile, Ala, Val, Leu, or Gly
  SITE (193)..(193): Xaa at position 193 is Val, Ala, Gly, Leu, or Ile
  SITE (200)..(200): Xaa at position 200 is Ala, Gly, or Pro
  SITE (201)..(201): Xaa at position 201 is Leu, Ala, Val, Gly, or Ile
  SITE (202)..(202): Xaa at position 202 is Val, Ala, Gly, Leu, or Ile
  SITE (204)..(204): Xaa at position 204 is Ile, Ala, Val, Leu, or Gly
  SITE (221)..(221): Xaa at position 221 is Ile, Ala, Val, Leu, or Gly
  SITE (222)..(222): Xaa at position 222 is Leu, Ala, Val, Gly, or Ile
  SITE (232)..(232): Xaa at position 232 is Ile, Ala, Val, Leu, or Gly
  SITE (236)..(236): Xaa at position 236 is Cys, Ala, Val, Gly, Ser, or Thr
  SITE (237)..(237): Xaa at position 237 is Tyr, Phe, Met, His, Ile, Leu, Val Ala, or Gly
  SITE (238)..(238): Xaa at position 238 is Leu, Ala, Val, Gly, or Ile
  SITE (239)..(239): Xaa at position 239 is Met, Ile, Leu, Val, Ala, or Gly
  SITE (240)..(240): Xaa at position 240 is Ile, Ala, Val, Leu, or Gly
  SITE (245)..(245): Xaa at position 245 is Ala, Gly, or Pro
  SITE (253)..(253): Xaa at position 253 is Phe, Tyr, Met, His, Ile, Leu, Val Ala, or Gly
  SITE (254)..(254): Xaa at position 254 is Leu, Ala, Val, Gly, or Ile
  SITE (256)..(256): Xaa at position 256 is Ile, Ala, Val, Leu, or Gly
  SITE (265)..(265): Xaa at position 265 is Ile, Ala, Val, Leu, or Gly
  SITE (273)..(273): Xaa at position 273 is His, Phe, Tyr, Lys, Arg, Gly, Ser Thr, Ala, Val, Leu, Ile, Asn, Met, or Gln
  SITE (277)..(277): Xaa at position 277 is Cys, Ala, Val, Gly, Ser, or Thr
  SITE (287)..(287): Xaa at position 287 is Ile, Ala, Val, Leu, or Gly
  SITE (289)..(289): Xaa at position 289 is Cys, Ala, Val, Gly, Ser, or Thr
  SITE (290)..(290): Xaa at position 290 is Ala, Gly, or Pro
  SITE (291)..(291): Xaa at position 291 is Cys, Ala, Val, Gly, Ser, or Thr
  SITE (298)..(298): Xaa at position 298 is Ala, Gly, or Pro
  SITE (302)..(302): Xaa at position 302 is Phe, Tyr, Met, His, Ile, Leu, Val Ala, or Gly
  SITE (303)..(303): Xaa at position 303 is Val, Ala, Gly, Leu, or Ile
  SITE (305)..(305): Xaa at position 305 is Leu, Ala, Val, Gly, or Ile
  SITE (314)..(314): Xaa at position 314 is Ile, Ala, Val, Leu, or Gly
  SITE (323)..(323): Xaa at position 323 is Leu, Ala, Val, Gly, or Ile
  SITE (333)..(333): Xaa at position 333 is Ile, Ala, Val, Leu, or Gly
  SITE (354)..(354): Xaa at position 354 is His, Phe, Tyr, Lys, Arg, Gly, Ser Thr, Ala, Val, Leu, Ile, Asn, Met, or Gln
  SITE (364)..(364): Xaa at position 364 is Trp, Tyr, Phe, Met, His, Ile, Leu Val, Ala, or Gly
  SITE (377)..(377): Xaa at position 377 is Met, Ile, Leu, Val, Ala, or Gly
  SITE (379)..(379): Xaa at position 379 is Leu, Ala, Val, Gly, or Ile
  SITE (400)..(400): Xaa at position 400 is Met, Ile, Leu, Val, Ala, or Gly
  SITE (401)..(401): Xaa at position 401 is Val, Ala, Gly, Leu, or Ile
  SITE (411)..(411): Xaa at position 411 is Phe, Tyr, Met, His, Ile, Leu, Val Ala, or Gly
  SITE (424)..(424): Xaa at position 424 is Cys, Ala, Val, Gly, Ser, or Thr
  SITE (425)..(425): Xaa at position 425 is Ile, Ala, Val, Leu, or Gly
  SITE (427)..(427): Xaa at position 427 is Ile, Ala, Val, Leu, or Gly
  SITE (429)..(429): Xaa at position 429 is Met, Ile, Leu, Val, Ala, or Gly
  SITE (430)..(430): Xaa at position 430 is Val, Ala, Gly, Leu, or Ile
  SITE (431)..(431): Xaa at position 431 is His, Phe, Tyr, Lys, Arg, Gly, Ser Thr, Ala, Val, Leu, Ile, Asn, Met, or Gln
  SITE (439)..(439): Xaa at position 439 is His, Phe, Tyr, Lys, Arg, Gly, Ser Thr, Ala, Val, Leu, Ile, Asn, Met, or Gln
  SITE (441)..(441): Xaa at position 441 is Ala, Gly, or Pro
  SITE (442)..(442): Xaa at position 442 is Ala, Gly, or Pro
  SITE (444)..(444): Xaa at position 444 is Ala, Gly, or Pro
  SITE (445)..(445): Xaa at position 445 is Ile, Ala, Val, Leu, or Gly
  SITE (446)..(446): Xaa at position 446 is Tyr, Phe, Met, His, Ile, Leu, Val Ala, or Gly
  SITE (448)..(448): Xaa at position 448 is Leu, Ala, Val, Gly, or Ile
  SITE (454)..(454): Xaa at position 454 is Leu, Ala, Val, Gly, or Ile
  SITE (455)..(455): Xaa at position 455 is Leu, Ala, Val, Gly, or Ile
MLPSTVQTLTLLLTSGGVLLSLYVSASLSYLLYSDVLLKFSSTKTTAPTMSLECTNASNAQTVNHSATKEMTFPPPEPEWTYPRLSCQGSTXQKALLISPHRFGEIKGNSAPLXXREPXXXCGPKECRHXAXTHYAAQPGGYYNGTRKDRNKLRHXVSXKLGKIPTVENSIFHMXXWSGSXXHDGREWTYXGXDGPDNDXXXKXKYGEAYTDTYHSYAHNXXRTQESACNCXGGDXXXXXTDGSXSGISKCRXXKXREGRIIKEXLPTGRVEXTEEXTCGFASNKTXEXXXRDNSYTXKRPXXKXNVETDTAEXRLMCTKTYXDTPRPDDGSXAGPCESNGDKWLGGIKGGFVXQRMASKIGRXYSRTMSKTNRMGXEXYVKYDGDPWTDSDALTLSGVXXSIEEPGWYSXGFEIKDKKCDVPXXGXEXXXDGGKDTWXSXXTXXXCXMGSGQXXWDTVTGVDMAL

SEQ ID NO: 166 - protein, 469 aa, Influenza A virus
  strain A/Turkey/Oregon/1971 H7N3
  SITE (94)..(94): Xaa at position 94 is Phe, Tyr, Met, His, Ile, Leu, Val Ala, or Gly
  SITE (106)..(106): Xaa at position 106 is Ile, Ala, Val, Leu, or Gly
  SITE (116)..(116): Xaa at position 116 is Val, Ala, Gly, Leu, or Ile
  SITE (121)..(121): Xaa at position 121 is Tyr, Phe, Met, His, Ile, Leu, Val Ala, or Gly
  SITE (122)..(122): Xaa at position 122 is Val, Ala, Gly, Leu, or Ile
  SITE (124)..(124): Xaa at position 124 is Cys, Ala, Val, Gly, Ser, or Thr
  SITE (132)..(132): Xaa at position 132 is Phe, Tyr, Met, His, Ile, Leu, Val Ala, or Gly
  SITE (133)..(133): Xaa at position 133 is Ala, Gly, or Pro
  SITE (134)..(134): Xaa at position 134 is Leu, Ala, Val, Gly, or Ile
  SITE (158)..(158): Xaa at position 158 is Leu, Ala, Val, Gly, or Ile
  SITE (161)..(161): Xaa at position 161 is Phe, Tyr, Met, His, Ile, Leu, Val Ala, or Gly
  SITE (176)..(176): Xaa at position 176 is Cys, Ala, Val, Gly, Ser, or Thr
  SITE (184)..(184): Xaa at position 184 is Cys, Ala, Val, Gly, Ser, or Thr
  SITE (191)..(191): Xaa at position 191 is Met, Ile, Leu, Val, Ala, or Gly
  SITE (193)..(193): Xaa at position 193 is Val, Ala, Gly, Leu, or Ile
  SITE (194)..(194): Xaa at position 194 is Cys, Ala, Val, Gly, Ser, or Thr
  SITE (195)..(195): Xaa at position 195 is Met, Ile, Leu, Val, Ala, or Gly
  SITE (202)..(202): Xaa at position 202 is Ala, Gly, or Pro
  SITE (204)..(204): Xaa at position 204 is Ala, Gly, or Pro
  SITE (206)..(206): Xaa at position 206 is Ile, Ala, Val, Leu, or Gly
  SITE (208)..(208): Xaa at position 208 is Tyr, Phe, Met, His, Ile, Leu, Val Ala, or Gly
  SITE (224)..(224): Xaa at position 224 is Leu, Ala, Val, Gly, or Ile
  SITE (231)..(231): Xaa at position 231 is Cys, Ala, Val, Gly, Ser, or Thr
  SITE (233)..(233): Xaa at position 233 is Cys, Ala, Val, Gly, Ser, or Thr
  SITE (240)..(240): Xaa at position 240 is Val, Ala, Gly, Leu, or Ile
  SITE (241)..(241): Xaa at position 241 is Ala, Gly, or Pro
  SITE (242)..(242): Xaa at position 242 is Val, Ala, Gly, Leu, or Ile
  SITE (255)..(255): Xaa at position 255 is Val, Ala, Gly, Leu, or Ile
  SITE (256)..(256): Xaa at position 256 is Tyr, Phe, Met, His, Ile, Leu, Val Ala, or Gly
  SITE (257)..(257): Xaa at position 257 is Trp, Tyr, Phe, Met, His, Ile, Leu Val, Ala, or Gly
  SITE (258)..(258): Xaa at position 258 is Ile, Ala, Val, Leu, or Gly
  SITE (277)..(277): Xaa at position 277 is Leu, Ala, Val, Gly, or Ile
  SITE (280)..(280): Xaa at position 280 is Cys, Ala, Val, Gly, Ser, or Thr
  SITE (282)..(282): Xaa at position 282 is Cys, Ala, Val, Gly, Ser, or Thr
  SITE (286)..(286): Xaa at position 286 is Ile, Ala, Val, Leu, or Gly
  SITE (288)..(288): Xaa at position 288 is Val, Ala, Gly, Leu, or Ile
  SITE (290)..(290): Xaa at position 290 is Cys, Ala, Val, Gly, Ser, or Thr
  SITE (291)..(291): Xaa at position 291 is Ile, Ala, Val, Leu, or Gly
  SITE (292)..(292): Xaa at position 292 is Cys, Ala, Val, Gly, Ser, or Thr
  SITE (303)..(303): Xaa at position 303 is Trp, Tyr, Phe, Met, His, Ile, Leu Val, Ala, or Gly
  SITE (304)..(304): Xaa at position 304 is Met, Ile, Leu, Val, Ala, or Gly
  SITE (306)..(306): Xaa at position 306 is Ile, Ala, Val, Leu, or Gly
  SITE (316)..(316): Xaa at position 316 is Tyr, Phe, Met, His, Ile, Leu, Val Ala, or Gly
  SITE (317)..(317): Xaa at position 317 is Val, Ala, Gly, Leu, or Ile
  SITE (318)..(318): Xaa at position 318 is Cys, Ala, Val, Gly, Ser, or Thr
  SITE (322)..(322): Xaa at position 322 is His, Phe, Tyr, Lys, Arg, Gly, Ser Thr, Ala, Val, Leu, Ile, Asn, Met, or Gln
  SITE (348)..(348): Xaa at position 348 is Val, Ala, Gly, Leu, or Ile
  SITE (351)..(351): Xaa at position 351 is Phe, Tyr, Met, His, Ile, Leu, Val Ala, or Gly
  SITE (353)..(353): Xaa at position 353 is Phe, Tyr, Met, His, Ile, Leu, Val Ala, or Gly
  SITE (360)..(360): Xaa at position 360 is Trp, Tyr, Phe, Met, His, Ile, Leu Val, Ala, or Gly
  SITE (361)..(361): Xaa at position 361 is Leu, Ala, Val, Gly, or Ile
  SITE (373)..(373): Xaa at position 373 is Phe, Tyr, Met, His, Ile, Leu, Val Ala, or Gly
  SITE (375)..(375): Xaa at position 375 is Ile, Ala, Val, Leu, or Gly
  SITE (378)..(378): Xaa at position 378 is Val, Ala, Gly, Leu, or Ile
  SITE (396)..(396): Xaa at position 396 is Leu, Ala, Val, Gly, or Ile
  SITE (397)..(397): Xaa at position 397 is Val, Ala, Gly, Leu, or Ile
  SITE (409)..(409): Xaa at position 409 is Phe, Tyr, Met, His, Ile, Leu, Val Ala, or Gly
  SITE (410)..(410): Xaa at position 410 is Ile, Ala, Val, Leu, or Gly
  SITE (417)..(417): Xaa at position 417 is Phe, Tyr, Met, His, Ile, Leu, Val Ala, or Gly
  SITE (421)..(421): Xaa at position 421 is Phe, Tyr, Met, His, Ile, Leu, Val Ala, or Gly
  SITE (422)..(422): Xaa at position 422 is Tyr, Phe, Met, His, Ile, Leu, Val Ala, or Gly
  SITE (423)..(423): Xaa at position 423 is Val, Ala, Gly, Leu, or Ile
  SITE (425)..(425): Xaa at position 425 is Leu, Ala, Val, Gly, or Ile
  SITE (436)..(436): Xaa at position 436 is Val, Ala, Gly, Leu, or Ile
  SITE (443)..(443): Xaa at position 443 is Ile, Ala, Val, Leu, or Gly
  SITE (444)..(444): Xaa at position 444 is Val, Ala, Gly, Leu, or Ile
  SITE (446)..(446): Xaa at position 446 is Phe, Tyr, Met, His, Ile, Leu, Val Ala, or Gly
  SITE (464)..(464): Xaa at position 464 is Ile, Ala, Val, Leu, or Gly
MNPNQKIITIGVVNTTLSTIALLIGVGNLVFNTVIHEKIGNHQTVIHPTITTPAVPNCSDTIITYNNTVINNITTTIITEAERLFKPPLPLCPXRGFFPFHKDNAXRLGENKDVIXTREPXXSXDNDNCWSXXXAQGALLGTKHSNGTIKDRTPYRSXIRXPIGTAPVLGNYKEIXIAWSSSSXFDGKEWXHXXXTGNDNDXSXQXIXAGRMTDSIKSWRKDIXRTQESEXQXIGGTCVXXXTDGPAANSADHRXXXXREGRIVKYENVPKTKIQHXEEXSXYVDXDXYXXXRDNWKGSNRPXXRXNNETILETGXXXSKFXSDTPRPADPSTVSCDSPSNINGGPGXKGXGXKAGNDVXXGRTVSTSGRSGXEXIKXTDGWINSPNHAKSVTQTXXSNNDWSGYSGSXXVKTKGCXQPCXXXEXIRGRPNKNDDXSWTSNSXXTXCGLDNEPGSGNWPDGSNXGFMPK

SEQ ID NO: 167 - protein, 470 aa, Influenza A virus
  strain A/Turkey/Ontario/6118/1968 H8N4
  SITE (105)..(105): Xaa at position 105 is Ile, Ala, Val, Leu, or Gly
  SITE (113)..(113): Xaa at position 113 is Val, Ala, Gly, Leu, or Ile
  SITE (115)..(115): Xaa at position 115 is Val, Ala, Gly, Leu, or Ile
  SITE (120)..(120): Xaa at position 120 is Phe, Tyr, Met, His, Ile, Leu, Val Ala, or Gly
  SITE (121)..(121): Xaa at position 121 is Ile, Ala, Val, Leu, or Gly
  SITE (131)..(131): Xaa at position 131 is Phe, Tyr, Met, His, Ile, Leu, Val Ala, or Gly
  SITE (132)..(132): Xaa at position 132 is Phe, Tyr, Met, His, Ile, Leu, Val Ala, or Gly
  SITE (133)..(133): Xaa at position 133 is Leu, Ala, Val, Gly, or Ile
  SITE (157)..(157): Xaa at position 157 is Leu, Ala, Val, Gly, or Ile
  SITE (160)..(160): Xaa at position 160 is Cys, Ala, Val, Gly, Ser, or Thr
  SITE (177)..(177): Xaa at position 177 is Ala, Gly, or Pro
  SITE (178)..(178): Xaa at position 178 is Trp, Tyr, Phe, Met, His, Ile, Leu Val, Ala, or Gly
  SITE (180)..(180): Xaa at position 180 is Ala, Gly, or Pro
  SITE (182)..(182): Xaa at position 182 is Ala, Gly, or Pro
  SITE (183)..(183): Xaa at position 183 is Cys, Ala, Val, Gly, Ser, or Thr
  SITE (190)..(190): Xaa at position 190 is Leu, Ala, Val, Gly, or Ile
  SITE (192)..(192): Xaa at position 192 is Leu, Ala, Val, Gly, or Ile
  SITE (194)..(194): Xaa at position 194 is Ile, Ala, Val, Leu, or Gly
  SITE (201)..(201): Xaa at position 201 is Ala, Gly, or Pro
  SITE (202)..(202): Xaa at position 202 is Val, Ala, Gly, Leu, or Ile
  SITE (203)..(203): Xaa at position 203 is Ala, Gly, or Pro
  SITE (205)..(205): Xaa at position 205 is Leu, Ala, Val, Gly, or Ile
  SITE (223)..(223): Xaa at position 223 is Met, Ile, Leu, Val, Ala, or Gly
  SITE (231)..(231): Xaa at position 231 is Val, Ala, Gly, Leu, or Ile
  SITE (232)..(232): Xaa at position 232 is Cys, Ala, Val, Gly, Ser, or Thr
  SITE (238)..(238): Xaa at position 238 is Tyr, Phe, Met, His, Ile, Leu, Val Ala, or Gly
  SITE (240)..(240): Xaa at position 240 is Leu, Ala, Val, Gly, or Ile
  SITE (241)..(241): Xaa at position 241 is Ile, Ala, Val, Leu, or Gly
  SITE (250)..(250): Xaa at position 250 is Ala, Gly, or Pro
  SITE (252)..(252): Xaa at position 252 is Tyr, Phe, Met, His, Ile, Leu, Val Ala, or Gly
  SITE (254)..(254): Xaa at position 254 is Ile, Ala, Val, Leu, or Gly
  SITE (257)..(257): Xaa at position 257 is Ile, Ala, Val, Leu, or Gly
  SITE (262)..(262): Xaa at position 262 is Ile, Ala, Val, Leu, or Gly
  SITE (274)..(274): Xaa at position 274 is His, Phe, Tyr, Lys, Arg, Gly, Ser Thr, Ala, Val, Leu, Ile, Asn, Met, or Gln
  SITE (275)..(275): Xaa at position 275 is Phe, Tyr, Met, His, Ile, Leu, Val Ala, or Gly
  SITE (278)..(278): Xaa at position 278 is Cys, Ala, Val, Gly, Ser, or Thr
  SITE (280)..(280): Xaa at position 280 is Cys, Ala, Val, Gly, Ser, or Thr
  SITE (281)..(281): Xaa at position 281 is Tyr, Phe, Met, His, Ile, Leu, Val Ala, or Gly
  SITE (287)..(287): Xaa at position 287 is Val, Ala, Gly, Leu, or Ile
  SITE (289)..(289): Xaa at position 289 is Cys, Ala, Val, Gly, Ser, or Thr
  SITE (290)..(290): Xaa at position 290 is Val, Ala, Gly, Leu, or Ile
  SITE (291)..(291): Xaa at position 291 is Cys, Ala, Val, Gly, Ser, or Thr
  SITE (303)..(303): Xaa at position 303 is Ile, Ala, Val, Leu, or Gly
  SITE (305)..(305): Xaa at position 305 is Phe, Tyr, Met, His, Ile, Leu, Val Ala, or Gly
  SITE (313)..(313): Xaa at position 313 is Ile, Ala, Val, Leu, or Gly
  SITE (317)..(317): Xaa at position 317 is Cys, Ala, Val, Gly, Ser, or Thr
  SITE (320)..(320): Xaa at position 320 is Ile, Ala, Val, Leu, or Gly
  SITE (321)..(321): Xaa at position 321 is Phe, Tyr, Met, His, Ile, Leu, Val Ala, or Gly
  SITE (350)..(350): Xaa at position 350 is Phe, Tyr, Met, His, Ile, Leu, Val Ala, or Gly
  SITE (352)..(352): Xaa at position 352 is Phe, Tyr, Met, His, Ile, Leu, Val Ala, or Gly
  SITE (354)..(354): Xaa at position 354 is Tyr, Phe, Met, His, Ile, Leu, Val Ala, or Gly
  SITE (358)..(358): Xaa at position 358 is Val, Ala, Gly, Leu, or Ile
  SITE (359)..(359): Xaa at position 359 is Trp, Tyr, Phe, Met, His, Ile, Leu Val, Ala, or Gly
  SITE (360)..(360): Xaa at position 360 is Ile, Ala, Val, Leu, or Gly
  SITE (372)..(372): Xaa at position 372 is Phe, Tyr, Met, His, Ile, Leu, Val Ala, or Gly
  SITE (374)..(374): Xaa at position 374 is Met, Ile, Leu, Val, Ala, or Gly
  SITE (375)..(375): Xaa at position 375 is Val, Ala, Gly, Leu, or Ile
  SITE (382)..(382): Xaa at position 382 is Val, Ala, Gly, Leu, or Ile
  SITE (394)..(394): Xaa at position 394 is Ile, Ala, Val, Leu, or Gly
  SITE (395)..(395): Xaa at position 395 is Ile, Ala, Val, Leu, or Gly
  SITE (407)..(407): Xaa at position 407 is Phe, Tyr, Met, His, Ile, Leu, Val Ala, or Gly
  SITE (422)..(422): Xaa at position 422 is Cys, Ala, Val, Gly, Ser, or Thr
  SITE (423)..(423): Xaa at position 423 is Phe, Tyr, Met, His, Ile, Leu, Val Ala, or Gly
  SITE (424)..(424): Xaa at position 424 is Trp, Tyr, Phe, Met, His, Ile, Leu Val, Ala, or Gly
  SITE (425)..(425): Xaa at position 425 is Val, Ala, Gly, Leu, or Ile
  SITE (427)..(427): Xaa at position 427 is Met, Ile, Leu, Val, Ala, or Gly
  SITE (438)..(438): Xaa at position 438 is Trp, Tyr, Phe, Met, His, Ile, Leu Val, Ala, or Gly
  SITE (444)..(444): Xaa at position 444 is Ile, Ala, Val, Leu, or Gly
  SITE (446)..(446): Xaa at position 446 is Phe, Tyr, Met, His, Ile, Leu, Val Ala, or Gly
MNPNQKIITIGSASIVLTTIGLLLQITSLCSIWFSHYNQVTQPHEQACSNNTTNYYNETFVNVTNVQNNYTTIIEPSAPNVVHYSSGRDLCPVKGWAPLSKDNGXRIGSRGEXFXIREPXXSCSISECRTXXXTQGALLNDKHSNGTVKDRSPFRTXMSXPMGVAPSPSNSRFESVXXSXTXXSDGPGWXTXGXTGPDATXXXVXKYNGIITDTLKSWKGNIXRTQESECXXQDEFCXTXXTDGPSNAQXFXKXLKXRKGKXVSVKDVNATGFXXEEXSXXPSGTDXEXXXRDNWRGSNRPWXRXNSDLDYQXGYVXSGXXGDNPRPVDGIGSCNSPVNNGKGRYGVKGXSXRXGDGXXXGRTKSLESRSGXEXXWDANGWXSTDKDSNGVQDXXDNNNWSGYSGSXSIRWETTGRNCTVPXXXXEXIRGQPKEKTIXTSGSSXAXCGVNSDTTGWSWPDGALLPFDIDK

SEQ ID NO: 168 - protein, 468 aa, Influenza A virus
  strain A/Shearwater/Australia/1972 H6N5
  SITE (98)..(98): Xaa at position 98 is Ile, Ala, Val, Leu, or Gly
  SITE (106)..(106): Xaa at position 106 is Ile, Ala, Val, Leu, or Gly
  SITE (108)..(108): Xaa at position 108 is Val, Ala, Gly, Leu, or Ile
  SITE (113)..(113): Xaa at position 113 is Phe, Tyr, Met, His, Ile, Leu, Val Ala, or Gly
  SITE (114)..(114): Xaa at position 114 is Val, Ala, Gly, Leu, or Ile
  SITE (124)..(124): Xaa at position 124 is Phe, Tyr, Met, His, Ile, Leu, Val Ala, or Gly
  SITE (125)..(125): Xaa at position 125 is Phe, Tyr, Met, His, Ile, Leu, Val Ala, or Gly
  SITE (126)..(126): Xaa at position 126 is Leu, Ala, Val, Gly, or Ile
  SITE (150)..(150): Xaa at position 150 is Leu, Ala, Val, Gly, or Ile
  SITE (153)..(153): Xaa at position 153 is Val, Ala, Gly, Leu, or Ile
  SITE (171)..(171): Xaa at position 171 is Trp, Tyr, Phe, Met, His, Ile, Leu Val, Ala, or Gly
  SITE (173)..(173): Xaa at position 173 is Ala, Gly, or Pro
  SITE (175)..(175): Xaa at position 175 is Ala, Gly, or Pro
  SITE (176)..(176): Xaa at position 176 is Cys, Ala, Val, Gly, Ser, or Thr
  SITE (183)..(183): Xaa at position 183 is Met, Ile, Leu, Val, Ala, or Gly
  SITE (185)..(185): Xaa at position 185 is Ile, Ala, Val, Leu, or Gly
  SITE (187)..(187): Xaa at position 187 is Val, Ala, Gly, Leu, or Ile
  SITE (194)..(194): Xaa at position 194 is Ala, Gly, or Pro
  SITE (195)..(195): Xaa at position 195 is Tyr, Phe, Met, His, Ile, Leu, Val Ala, or Gly
  SITE (196)..(196): Xaa at position 196 is Ala, Gly, or Pro
  SITE (198)..(198): Xaa at position 198 is Ile, Ala, Val, Leu, or Gly
  SITE (216)..(216): Xaa at position 216 is Leu, Ala, Val, Gly, or Ile
  SITE (224)..(224): Xaa at position 224 is Val, Ala, Gly, Leu, or Ile
  SITE (225)..(225): Xaa at position 225 is Cys, Ala, Val, Gly, Ser, or Thr
  SITE (226)..(226): Xaa at position 226 is Ile, Ala, Val, Leu, or Gly
  SITE (231)..(231): Xaa at position 231 is Tyr, Phe, Met, His, Ile, Leu, Val Ala, or Gly
  SITE (233)..(233): Xaa at position 233 is Val, Ala, Gly, Leu, or Ile
  SITE (234)..(234): Xaa at position 234 is Met, Ile, Leu, Val, Ala, or Gly
  SITE (243)..(243): Xaa at position 243 is Ala, Gly, or Pro
  SITE (245)..(245): Xaa at position 245 is Tyr, Phe, Met, His, Ile, Leu, Val Ala, or Gly
  SITE (247)..(247): Xaa at position 247 is Ile, Ala, Val, Leu, or Gly
  SITE (255)..(255): Xaa at position 255 is Val, Ala, Gly, Leu, or Ile
  SITE (267)..(267): Xaa at position 267 is His, Phe, Tyr, Lys, Arg, Gly, Ser Thr, Ala, Val, Leu, Ile, Asn, Met, or Gln
  SITE (268)..(268): Xaa at position 268 is Ile, Ala, Val, Leu, or Gly
  SITE (271)..(271): Xaa at position 271 is Cys, Ala, Val, Gly, Ser, or Thr
  SITE (273)..(273): Xaa at position 273 is Cys, Ala, Val, Gly, Ser, or Thr
  SITE (274)..(274): Xaa at position 274 is Tyr, Phe, Met, His, Ile, Leu, Val Ala, or Gly
  SITE (277)..(277): Xaa at position 277 is Met, Ile, Leu, Val, Ala, or Gly
  SITE (280)..(280): Xaa at position 280 is Val, Ala, Gly, Leu, or Ile
  SITE (282)..(282): Xaa at position 282 is Cys, Ala, Val, Gly, Ser, or Thr
  SITE (283)..(283): Xaa at position 283 is Val, Ala, Gly, Leu, or Ile
  SITE (284)..(284): Xaa at position 284 is Cys, Ala, Val, Gly, Ser, or Thr
  SITE (296)..(296): Xaa at position 296 is Leu, Ala, Val, Gly, or Ile
  SITE (298)..(298): Xaa at position 298 is Phe, Tyr, Met, His, Ile, Leu, Val Ala, or Gly
  SITE (310)..(310): Xaa at position 310 is Cys, Ala, Val, Gly, Ser, or Thr
  SITE (313)..(313): Xaa at position 313 is Ile, Ala, Val, Leu, or Gly
  SITE (346)..(346): Xaa at position 346 is Phe, Tyr, Met, His, Ile, Leu, Val Ala, or Gly
  SITE (348)..(348): Xaa at position 348 is Phe, Tyr, Met, His, Ile, Leu, Val Ala, or Gly
  SITE (354)..(354): Xaa at position 354 is Val, Ala, Gly, Leu, or Ile
  SITE (355)..(355): Xaa at position 355 is Trp, Tyr, Phe, Met, His, Ile, Leu Val, Ala, or Gly
  SITE (356)..(356): Xaa at position 356 is Ala, Gly, or Pro
  SITE (360)..(360): Xaa at position 360 is Ile, Ala, Val, Leu, or Gly
  SITE (368)..(368): Xaa at position 368 is Phe, Tyr, Met, His, Ile, Leu, Val Ala, or Gly
  SITE (370)..(370): Xaa at position 370 is Val, Ala, Gly, Leu, or Ile
  SITE (371)..(371): Xaa at position 371 is Leu, Ala, Val, Gly, or Ile
  SITE (378)..(378): Xaa at position 378 is Ile, Ala, Val, Leu, or Gly
  SITE (384)..(384): Xaa at position 384 is Ile, Ala, Val, Leu, or Gly
  SITE (390)..(390): Xaa at position 390 is Val, Ala, Gly, Leu, or Ile
  SITE (391)..(391): Xaa at position 391 is Leu, Ala, Val, Gly, or Ile
  SITE (403)..(403): Xaa at position 403 is Phe, Tyr, Met, His, Ile, Leu, Val Ala, or Gly
  SITE (415)..(415): Xaa at position 415 is Ile, Ala, Val, Leu, or Gly
  SITE (418)..(418): Xaa at position 418 is Cys, Ala, Val, Gly, Ser, or Thr
  SITE (419)..(419): Xaa at position 419 is Phe, Tyr, Met, His, Ile, Leu, Val Ala, or Gly
  SITE (420)..(420): Xaa at position 420 is Trp, Tyr, Phe, Met, His, Ile, Leu Val, Ala, or Gly
  SITE (421)..(421): Xaa at position 421 is Leu, Ala, Val, Gly, or Ile
  SITE (423)..(423): Xaa at position 423 is Met, Ile, Leu, Val, Ala, or Gly
  SITE (435)..(435): Xaa at position 435 is Trp, Tyr, Phe, Met, His, Ile, Leu Val, Ala, or Gly
  SITE (443)..(443): Xaa at position 443 is Phe, Tyr, Met, His, Ile, Leu, Val Ala, or Gly
MNPNQKIITIGSASLGLVIFNILLHVASITLGIISVTKDNKVHICNTTEVYNETVRVETVVIPVNNTIYLNHEPEFLNNTEPLCDVSGFAIVSKDNGXRIGSRGHXFXIREPXXSCGPSECRTXXXTQGALLNDKHSNNTVKDRSPYRAXMSXPLGSSPNAYQAKFESVGXSXTXXHDGKKWXAXGXSGADDDXXXVXHYGGVPTDVIRSWRKQIXRTQESSCXXXKGECXWXXTDGPANNQXSXKXFKSQKGMXVDEKEISFQGGXXEEXSXXPNXGKXEXXXRDNWNGMNRPIXIXDEKLEYEVGYLXAGXPTDTPRVQDSSFTGSCTNAVGRSGTNNYGVKGXGXRQGNSXXXGRTXSVSSRSGXEXXLIEDGWXRPSKTXSKKVEXXNNKNWSGYSGAXTIPTAMTSKNCXVPXXXXEXIRGKPEERTSIXTSSSSTVXCGVSSEVPGWSWDDGAILPFDIDKM

SEQ ID NO: 169 - protein, 318 aa, Homo sapiens
  SITE (43)..(43): Xaa at position 43 is Tyr, Phe, Met, His, Ile, Leu, Val Ala, or Gly
  SITE (50)..(50): Xaa at position 50 is Ala, Gly, or Pro
  SITE (52)..(52): Xaa at position 52 is Ala, Gly, or Pro
  SITE (53)..(53): Xaa at position 53 is Met, Ile, Leu, Val, Ala, or Gly
  SITE (56)..(56): Xaa at position 56 is Phe, Tyr, Met, His, Ile, Leu, Val Ala, or Gly
MPMANLLLLIVPILIAMAFLMLTERKILGYMQLRKGPNVVGPXGLLQPFXDXXKLXTKEPLKPATSTITLYITAPTLALTIALLLWTPLPMPNPLVNLNLGLLFILATSSLAVYSILWSGWASNSNYALIGALRAVAQTISYEVTLAIILLSTLLMSGSFNLSTLITTQEHLWLLLPSWPLAMMWFISTLAETNRTPFDLAEGESELVSGFNIEYAAGPFALFFMAEYTNIIMMNTLTTTIFLGTTYDALSPELYTTYFVTKTLLLTSLFLWIRTAYPRFRYDQLMHLLWKNFLPLTLALLMWYVSMPITISSIPPQT

SEQ ID NO: 170 - protein, 147 aa, Homo sapiens
  SITE (33)..(33): Xaa at position 33 is Phe, Tyr, Met, His, Ile, Leu, Val Ala, or Gly
  SITE (50)..(50): Xaa at position 50 is Cys, Ala, Val, Gly, Ser, or Thr
  SITE (53)..(53): Xaa at position 53 is Ile, Ala, Val, Leu, or Gly
  SITE (54)..(54): Xaa at position 54 is Met, Ile, Leu, Val, Ala, or Gly
  SITE (63)..(63): Xaa at position 63 is Cys, Ala, Val, Gly, Ser, or Thr
  SITE (66)..(66): Xaa at position 66 is Ile, Ala, Val, Leu, or Gly
  SITE (69)..(69): Xaa at position 69 is Phe, Tyr, Met, His, Ile, Leu, Val Ala, or Gly
  SITE (70)..(70): Xaa at position 70 is Ile, Ala, Val, Leu, or Gly
  SITE (71)..(71): Xaa at position 71 is His, Phe, Tyr, Lys, Arg, Gly, Ser Thr, Ala, Val, Leu, Ile, Asn, Met, or Gln
  SITE (77)..(77): Xaa at position 77 is Ile, Ala, Val, Leu, or Gly
  SITE (79)..(79): Xaa at position 79 is Ala, Gly, or Pro
  SITE (80)..(80): Xaa at position 80 is Ile, Ala, Val, Leu, or Gly
  SITE (93)..(93): Xaa at position 93 is Leu, Ala, Val, Gly, or Ile
  SITE (102)..(102): Xaa at position 102 is Val, Ala, Gly, Leu, or Ile
  SITE (105)..(105): Xaa at position 105 is Cys, Ala, Val, Gly, Ser, or Thr
  SITE (116)..(116): Xaa at position 116 is Cys, Ala, Val, Gly, Ser, or Thr
  SITE (118)..(118): Xaa at position 118 is Tyr, Phe, Met, His, Ile, Leu, Val Ala, or Gly
  SITE (127)..(127): Xaa at position 127 is Val, Ala, Gly, Leu, or Ile
  SITE (128)..(128): Xaa at position 128 is Val, Ala, Gly, Leu, or Ile
  SITE (129)..(129): Xaa at position 129 is Val, Ala, Gly, Leu, or Ile
  SITE (136)..(136): Xaa at position 136 is Pro, Met, Leu, Ile, Val, Ala or Gly
  SITE (139)..(139): Xaa at position 139 is Leu, Ala, Val, Gly, or Ile
MVMGLGVLLLVFVLGLGLTPPTLAQDNSRYTHXLTQHYDAKPQGRDDRYXESXXRRRGLTSPXKDXNTXXXGNKRSXKXXCENKNGNPHRENXRISKSSFQXTTXKLHGGSPWPPXQXRATAGFRNXXXACENGLXVHXDQSIFRRP

SEQ ID NO: 171 - protein, 625 aa, Homo sapiens
  SITE (30)..(30): Xaa at position 30 is Phe, Tyr, Met, His, Ile, Leu, Val Ala, or Gly
  SITE (46)..(46): Xaa at position 46 is Cys, Ala, Val, Gly, Ser, or Thr
  SITE (50)..(50): Xaa at position 50 is Cys, Ala, Val, Gly, Ser, or Thr
  SITE (56)..(56): Xaa at position 56 is Cys, Ala, Val, Gly, Ser, or Thr
  SITE (57)..(57): Xaa at position 57 is Leu, Ala, Val, Gly, or Ile
  SITE (58)..(58): Xaa at position 58 is Leu, Ala, Val, Gly, or Ile
  SITE (59)..(59): Xaa at position 59 is Phe, Tyr, Met, His, Ile, Leu, Val Ala, or Gly
  SITE (76)..(76): Xaa at position 76 is Cys, Ala, Val, Gly, Ser, or Thr
  SITE (78)..(78): Xaa at position 78 is Leu, Ala, Val, Gly, or Ile
  SITE (120)..(120): Xaa at position 120 is Met, Ile, Leu, Val, Ala, or Gly
  SITE (130)..(130): Xaa at position 130 is Ala, Gly, or Pro
  SITE (136)..(136): Xaa at position 136 is Cys, Ala, Val, Gly, Ser, or Thr
  SITE (140)..(140): Xaa at position 140 is Cys, Ala, Val, Gly, Ser, or Thr
  SITE (148)..(148): Xaa at position 148 is Phe, Tyr, Met, His, Ile, Leu, Val Ala, or Gly
  SITE (149)..(149): Xaa at position 149 is Phe, Tyr, Met, His, Ile, Leu, Val Ala, or Gly
  SITE (165)..(165): Xaa at position 165 is Cys, Ala, Val, Gly, Ser, or Thr
  SITE (167)..(167): Xaa at position 167 is Leu, Ala, Val, Gly, or Ile
  SITE (220)..(220): Xaa at position 220 is Ala, Gly, or Pro
  SITE (225)..(225): Xaa at position 225 is Val, Ala, Gly, Leu, or Ile
  SITE (226)..(226): Xaa at position 226 is Cys, Ala, Val, Gly, Ser, or Thr
  SITE (230)..(230): Xaa at position 230 is Cys, Ala, Val, Gly, Ser, or Thr
  SITE (236)..(236): Xaa at position 236 is Cys, Ala, Val, Gly, Ser, or Thr
  SITE (238)..(238): Xaa at position 238 is Phe, Tyr, Met, His, Ile, Leu, Val Ala, or Gly
  SITE (239)..(239): Xaa at position 239 is Phe, Tyr, Met, His, Ile, Leu, Val Ala, or Gly
  SITE (255)..(255): Xaa at position 255 is Cys, Ala, Val, Gly, Ser, or Thr
  SITE (257)..(257): Xaa at position 257 is Leu, Ala, Val, Gly, or Ile
  SITE (274)..(274): Xaa at position 274 is Ala, Gly, or Pro
  SITE (283)..(283): Xaa at position 283 is Cys, Ala, Val, Gly, Ser, or Thr
  SITE (289)..(289): Xaa at position 289 is Val, Ala, Gly, Leu, or Ile
  SITE (301)..(301): Xaa at position 301 is Phe, Tyr, Met, His, Ile, Leu, Val Ala, or Gly
  SITE (317)..(317): Xaa at position 317 is Cys, Ala, Val, Gly, Ser, or Thr
  SITE (321)..(321): Xaa at position 321 is Cys, Ala, Val, Gly, Ser, or Thr
  SITE (327)..(327): Xaa at position 327 is Cys, Ala, Val, Gly, Ser, or Thr
  SITE (329)..(329): Xaa at position 329 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (337)..(337): Xaa at position 337 is Ala, Gly, or Pro
  SITE (346)..(346): Xaa at position 346 is Cys, Ala, Val, Gly, Ser, or Thr
  SITE (366)..(366): Xaa at position 366 is Ile, Ala, Val, Leu, or Gly
  SITE (388)..(388): Xaa at position 388 is Ile, Ala, Val, Leu, or Gly
  SITE (401)..(401): Xaa at position 401 is Trp, Tyr, Phe, Met, His, Ile, Leu Val, Ala, or Gly
  SITE (403)..(403): Xaa at position 403 is Val, Ala, Gly, Leu, or Ile
  SITE (405)..(405): Xaa at position 405 is Leu, Ala, Val, Gly, or Ile
  SITE (416)..(416): Xaa at position 416 is Cys, Ala, Val, Gly, Ser, or Thr
  SITE (420)..(420): Xaa at position 420 is Ile, Ala, Val, Leu, or Gly
  SITE (421)..(421): Xaa at position 421 is Ile, Ala, Val, Leu, or Gly
  SITE (426)..(426): Xaa at position 426 is Ile, Ala, Val, Leu, or Gly
  SITE (427)..(427): Xaa at position 427 is Leu, Ala, Val, Gly, or Ile
  SITE (429)..(429): Xaa at position 429 is Ala, Gly, or Pro
  SITE (430)..(430): Xaa at position 430 is Ala, Gly, or Pro
  SITE (444)..(444): Xaa at position 444 is Val, Ala, Gly, Leu, or Ile
  SITE (445)..(445): Xaa at position 445 is Tyr, Phe, Met, His, Ile, Leu, Val Ala, or Gly
  SITE (463)..(463): Xaa at position 463 is Val, Ala, Gly, Leu, or Ile
  SITE (481)..(481): Xaa at position 481 is Ile, Ala, Val, Leu, or Gly
  SITE (482)..(482): Xaa at position 482 is Ala, Gly, or Pro
  SITE (483)..(483): Xaa at position 483 is Leu, Ala, Val, Gly, or Ile
  SITE (484)..(484): Xaa at position 484 is Leu, Ala, Val, Gly, or Ile
  SITE (486)..(486): Xaa at position 486 is Leu, Ala, Val, Gly, or Ile
  SITE (490)..(490): Xaa at position 490 is Val, Ala, Gly, Leu, or Ile
  SITE (500)..(500): Xaa at position 500 is Cys, Ala, Val, Gly, Ser, or Thr
  SITE (514)..(514): Xaa at position 514 is Cys, Ala, Val, Gly, Ser, or Thr
  SITE (516)..(516): Xaa at position 516 is Val, Ala, Gly, Leu, or Ile
  SITE (519)..(519): Xaa at position 519 is Trp, Tyr, Phe, Met, His, Ile, Leu Val, Ala, or Gly
  SITE (535)..(535): Xaa at position 535 is Ala, Gly, or Pro
  SITE (537)..(537): Xaa at position 537 is Ile, Ala, Val, Leu, or Gly
  SITE (545)..(545): Xaa at position 545 is Cys, Ala, Val, Gly, Ser, or Thr
  SITE (549)..(549): Xaa at position 549 is Tyr, Phe, Met, His, Ile, Leu, Val Ala, or Gly
  SITE (554)..(554): Xaa at position 554 is Ile, Ala, Val, Leu, or Gly
  SITE (560)..(560): Xaa at position 560 is Cys, Ala, Val, Gly, Ser, or Thr
  SITE (561)..(561): Xaa at position 561 is Ala, Gly, or Pro
  SITE (570)..(570): Xaa at position 570 is Ala, Gly, or Pro
  SITE (579)..(579): Xaa at position 579 is Leu, Ala, Val, Gly, or Ile
  SITE (581)..(581): Xaa at position 581 is Cys, Ala, Val, Gly, Ser, or Thr
  SITE (586)..(586): Xaa at position 586 is Val, Ala, Gly, Leu, or Ile
  SITE (588)..(588): Xaa at position 588 is His, Phe, Tyr, Lys, Arg, Gly, Ser Thr, Ala, Val, Leu, Ile, Asn, Met, or Gln
  SITE (589)..(589): Xaa at position 589 is Leu, Ala, Val, Gly, or Ile
  SITE (590)..(590): Xaa at position 590 is Val, Ala, Gly, Leu, or Ile
  SITE (592)..(592): Xaa at position 592 is Ile, Ala, Val, Leu, or Gly
  SITE (607)..(607): Xaa at position 607 is Val, Ala, Gly, Leu, or Ile
  SITE (608)..(608): Xaa at position 608 is Tyr, Phe, Met, His, Ile, Leu, Val Ala, or Gly
  SITE (611)..(611): Xaa at position 611 is Val, Ala, Gly, Leu, or Ile
  SITE (612)..(612): Xaa at position 612 is Val, Ala, Gly, Leu, or Ile
  SITE (614)..(614): Xaa at position 614 is Tyr, Phe, Met, His, Ile, Leu, Val Ala, or Gly
  SITE (618)..(618): Xaa at position 618 is Ile, Ala, Val, Leu, or Gly
MIFLYQVVHFILFTSVSGECVTQLLKDTCXEGGDITTVFTPSAKYXQVVXTYHPRXXXXTFTAESPSEDPTRWFTXVXKDSVTETLPRVNRTAAISGYSFKQCSHQISACNKDIYVDLDXKGINYNSSVXKSAQEXQERXTDDVHCHXXTYATRQFPSLEHRNIXLXKHTQTGTPTRITKLDKVVSGFSLKSCALSNLACIRDIFPNTVFADSNIDSVMXPDAFXXGRIXTHHPGXLXXTFFSQEWPKESQRNLXLXKTSESGLPSTRIKKSKXLSGFSLQSXRHSIPXFCHSSFYHDTDXLGEELDIVAAKSHEAXQKLXTNAVRXQXXTYTPAQXSCNEGKGKXYLKLSSNGSPTKILHGRGGXSGYTLRLCKMDNECTTKIKPRXVGGTASVRGEWPXQXTXHTTSPTQRHLXGGSXXGNQWXXTXXHCFYGVESPKILRXXSGILNQSEIKEDTSFFGXQEIIIHDQYKMAESGYDXXXXKXETTXNYTDSQRPIXLPSKGDRNVIYTDXWXTGXGYRKLRDKIQNTLQKXKXPLVTNEEXQKRXRGHKXTHKMIXXGYREGGKDXCKGDSGGPXSXKHNEXWXXXGXTSWGEGCAQRERPGXXTNXXEXVDWXLEKTQAV

SEQ ID NO: 172 - protein, 527 aa, Homo sapiens
  SITE (76)..(76): Xaa at position 76 is Ala, Gly, or Pro
  SITE (79)..(79): Xaa at position 79 is Ala, Gly, or Pro
  SITE (81)..(81): Xaa at position 81 is Ala, Gly, or Pro
  SITE (85)..(85): Xaa at position 85 is Phe, Tyr, Met, His, Ile, Leu, Val Ala, or Gly
  SITE (87)..(87): Xaa at position 87 is Val, Ala, Gly, Leu, or Ile
  SITE (91)..(91): Xaa at position 91 is Ile, Ala, Val, Leu, or Gly
  SITE (97)..(97): Xaa at position 97 is Ala, Gly, or Pro
  SITE (99)..(99): Xaa at position 99 is Val, Ala, Gly, Leu, or Ile
  SITE (100)..(100): Xaa at position 100 is Phe, Tyr, Met, His, Ile, Leu, Val Ala, or Gly
  SITE (109)..(109): Xaa at position 109 is Ile, Ala, Val, Leu, or Gly
  SITE (110)..(110): Xaa at position 110 is Ala, Gly, or Pro
  SITE (111)..(111): Xaa at position 111 is Val, Ala, Gly, Leu, or Ile
  SITE (113)..(113): Xaa at position 113 is Phe, Tyr, Met, His, Ile, Leu, Val Ala, or Gly
  SITE (117)..(117): Xaa at position 117 is Ala, Gly, or Pro
  SITE (132)..(132): Xaa at position 132 is Phe, Tyr, Met, His, Ile, Leu, Val Ala, or Gly
  SITE (134)..(134): Xaa at position 134 is Val, Ala, Gly, Leu, or Ile
  SITE (136)..(136): Xaa at position 136 is Phe, Tyr, Met, His, Ile, Leu, Val Ala, or Gly
  SITE (143)..(143): Xaa at position 143 is Trp, Tyr, Phe, Met, His, Ile, Leu Val, Ala, or Gly
  SITE (145)..(145): Xaa at position 145 is Leu, Ala, Val, Gly, or Ile
  SITE (152)..(152): Xaa at position 152 is Ile, Ala, Val, Leu, or Gly
  SITE (153)..(153): Xaa at position 153 is Phe, Tyr, Met, His, Ile, Leu, Val Ala, or Gly
  SITE (154)..(154): Xaa at position 154 is Phe, Tyr, Met, His, Ile, Leu, Val Ala, or Gly
  SITE (155)..(155): Xaa at position 155 is Ile, Ala, Val, Leu, or Gly
  SITE (159)..(159): Xaa at position 159 is Ile, Ala, Val, Leu, or Gly
  SITE (164)..(164): Xaa at position 164 is Phe, Tyr, Met, His, Ile, Leu, Val Ala, or Gly
  SITE (183)..(183): Xaa at position 183 is Trp, Tyr, Phe, Met, His, Ile, Leu Val, Ala, or Gly
  SITE (186)..(186): Xaa at position 186 is Trp, Tyr, Phe, Met, His, Ile, Leu Val, Ala, or Gly
  SITE (193)..(193): Xaa at position 193 is Leu, Ala, Val, Gly, or Ile
  SITE (196)..(196): Xaa at position 196 is Val, Ala, Gly, Leu, or Ile
  SITE (200)..(200): Xaa at position 200 is Phe, Tyr, Met, His, Ile, Leu, Val Ala, or Gly
  SITE (205)..(205): Xaa at position 205 is Ile, Ala, Val, Leu, or Gly
  SITE (209)..(209): Xaa at position 209 is His, Phe, Tyr, Lys, Arg, Gly, Ser Thr, Ala, Val, Leu, Ile, Asn, Met, or Gln
  SITE (212)..(212): Xaa at position 212 is Met, Ile, Leu, Val, Ala, or Gly
  SITE (222)..(222): Xaa at position 222 is Leu, Ala, Val, Gly, or Ile
  SITE (230)..(230): Xaa at position 230 is Val, Ala, Gly, Leu, or Ile
  SITE (232)..(232): Xaa at position 232 is Cys, Ala, Val, Gly, Ser, or Thr
  SITE (234)..(234): Xaa at position 234 is Phe, Tyr, Met, His, Ile, Leu, Val Ala, or Gly
  SITE (236)..(236): Xaa at position 236 is Tyr, Phe, Met, His, Ile, Leu, Val Ala, or Gly
  SITE (250)..(250): Xaa at position 250 is Ala, Gly, or Pro
  SITE (265)..(265): Xaa at position 265 is Leu, Ala, Val, Gly, or Ile
  SITE (266)..(266): Xaa at position 266 is Phe, Tyr, Met, His, Ile, Leu, Val Ala, or Gly
  SITE (268)..(268): Xaa at position 268 is Ala, Gly, or Pro
  SITE (277)..(277): Xaa at position 277 is Trp, Tyr, Phe, Met, His, Ile, Leu Val, Ala, or Gly
  SITE (279)..(279): Xaa at position 279 is Phe, Tyr, Met, His, Ile, Leu, Val Ala, or Gly
  SITE (281)..(281): Xaa at position 281 is Ile, Ala, Val, Leu, or Gly
  SITE (284)..(284): Xaa at position 284 is Met, Ile, Leu, Val, Ala, or Gly
  SITE (289)..(289): Xaa at position 289 is Ala, Gly, or Pro
  SITE (294)..(294): Xaa at position 294 is Phe, Tyr, Met, His, Ile, Leu, Val Ala, or Gly
  SITE (299)..(299): Xaa at position 299 is Leu, Ala, Val, Gly, or Ile
  SITE (313)..(313): Xaa at position 313 is Val, Ala, Gly, Leu, or Ile
  SITE (316)..(316): Xaa at position 316 is Leu, Ala, Val, Gly, or Ile
  SITE (317)..(317): Xaa at position 317 is Val, Ala, Gly, Leu, or Ile
  SITE (318)..(318): Xaa at position 318 is Leu, Ala, Val, Gly, or Ile
  SITE (329)..(329): Xaa at position 329 is Val, Ala, Gly, Leu, or Ile
  SITE (332)..(332): Xaa at position 332 is Ile, Ala, Val, Leu, or Gly
  SITE (333)..(333): Xaa at position 333 is Ala, Gly, or Pro
  SITE (343)..(343): Xaa at position 343 is Ile, Ala, Val, Leu, or Gly
  SITE (351)..(351): Xaa at position 351 is Leu, Ala, Val, Gly, or Ile
  SITE (355)..(355): Xaa at position 355 is Leu, Ala, Val, Gly, or Ile
  SITE (375)..(375): Xaa at position 375 is Val, Ala, Gly, Leu, or Ile
  SITE (443)..(443): Xaa at position 443 is Val, Ala, Gly, Leu, or Ile
  SITE (447)..(447): Xaa at position 447 is Tyr, Phe, Met, His, Ile, Leu, Val Ala, or Gly
  SITE (459)..(459): Xaa at position 459 is Leu, Ala, Val, Gly, or Ile
  SITE (460)..(460): Xaa at position 460 is Cys, Ala, Val, Gly, Ser, or Thr
  SITE (463)..(463): Xaa at position 463 is Ile, Ala, Val, Leu, or Gly
  SITE (464)..(464): Xaa at position 464 is Ala, Gly, or Pro
  SITE (467)..(467): Xaa at position 467 is Leu, Ala, Val, Gly, or Ile
  SITE (478)..(478): Xaa at position 478 is Ala, Gly, or Pro
  SITE (479)..(479): Xaa at position 479 is Val, Ala, Gly, Leu, or Ile
  SITE (482)..(482): Xaa at position 482 is Phe, Tyr, Met, His, Ile, Leu, Val Ala, or Gly
  SITE (485)..(485): Xaa at position 485 is Val, Ala, Gly, Leu, or Ile
  SITE (489)..(489): Xaa at position 489 is Tyr, Phe, Met, His, Ile, Leu, Val Ala, or Gly
  SITE (493)..(493): Xaa at position 493 is Ile, Ala, Val, Leu, or Gly
  SITE (496)..(496): Xaa at position 496 is Leu, Ala, Val, Gly, or Ile
  SITE (497)..(497): Xaa at position 497 is Leu, Ala, Val, Gly, or Ile
MADSRDPASDQMQHWKEQRAAQKADVLTTGAGNPVGDKLNVITVGPRGPLLVQDVVFTDEMAHFDRERIPERVVHXKGXGXFGYXEXTHDXTKYSKXKXXEHIGKKTPXXXRXSTVXGESGSADTVRDPRGXAXKXYTEDGNXDXVGNNTPXXXXRDPXLFPSXIHSQKRNPQTHLKDPDMVXDFXSLRPESXHQXSFLXSDRGXPDGXRHXNGYGSHTFKXVNANGEAXYXKXHXKTDQGIKNLSVEDXARLSQEDPDYGIRDXXNXIATGKYPSXTXYXQVXTFNQXETFPXNPFDXTKVWPHKDYPLIPXGKXXXNRNPVNYFAEXEQXXFDPSNMPPGXEASPDKMXQGRXFAYPDTHRHRLGPNYLHIPXNCPYRARVANYQRDGPMCMQDNQGGAPNYYPNSFGAPEQQPSALEHSIQYSGEVRRFNTANDDNVTQXRAFXVNVLNEEQRKRXXENXXGHXKDAQIFIQKKXXKNXTEXHPDXGSHXQAXXDKYNAEKPKNAIHTFVQSGSHLAAREKANL

SEQ ID NO: 173 - protein, 648 aa, Homo sapiens
  SITE (58)..(58): Xaa at position 58 is Ile, Ala, Val, Leu, or Gly
  SITE (60)..(60): Xaa at position 60 is Val, Ala, Gly, Leu, or Ile
  SITE (62)..(62): Xaa at position 62 is Leu, Ala, Val, Gly, or Ile
  SITE (72)..(72): Xaa at position 72 is Val, Ala, Gly, Leu, or Ile
  SITE (78)..(78): Xaa at position 78 is Leu, Ala, Val, Gly, or Ile
  SITE (81)..(81): Xaa at position 81 is Cys, Ala, Val, Gly, Ser, or Thr
  SITE (82)..(82): Xaa at position 82 is Leu, Ala, Val, Gly, or Ile
  SITE (86)..(86): Xaa at position 86 is Leu, Ala, Val, Gly, or Ile
  SITE (97)..(97): Xaa at position 97 is Ala, Gly, or Pro
  SITE (98)..(98): Xaa at position 98 is Val, Ala, Gly, Leu, or Ile
  SITE (118)..(118): Xaa at position 118 is Ala, Gly, or Pro
  SITE (126)..(126): Xaa at position 126 is Leu, Ala, Val, Gly, or Ile
  SITE (128)..(128): Xaa at position 128 is Val, Ala, Gly, Leu, or Ile
  SITE (152)..(152): Xaa at position 152 is Cys, Ala, Val, Gly, Ser, or Thr
  SITE (165)..(165): Xaa at position 165 is Cys, Ala, Val, Gly, Ser, or Thr
  SITE (176)..(176): Xaa at position 176 is Cys, Ala, Val, Gly, Ser, or Thr
  SITE (180)..(180): Xaa at position 180 is Val, Ala, Gly, Leu, or Ile
  SITE (184)..(184): Xaa at position 184 is Cys, Ala, Val, Gly, Ser, or Thr
  SITE (372)..(372): Xaa at position 372 is Val, Ala, Gly, Leu, or Ile
  SITE (405)..(405): Xaa at position 405 is Ile, Ala, Val, Leu, or Gly
  SITE (420)..(420): Xaa at position 420 is Val, Ala, Gly, Leu, or Ile
  SITE (446)..(446): Xaa at position 446 is Ile, Ala, Val, Leu, or Gly
  SITE (449)..(449): Xaa at position 449 is Ala, Gly, or Pro
  SITE (453)..(453): Xaa at position 453 is Ala, Gly, or Pro
  SITE (456)..(456): Xaa at position 456 is Met, Ile, Leu, Val, Ala, or Gly
  SITE (459)..(459): Xaa at position 459 is Leu, Ala, Val, Gly, or Ile
  SITE (466)..(466): Xaa at position 466 is His, Phe, Tyr, Lys, Arg, Gly, Ser Thr, Ala, Val, Leu, Ile, Asn, Met, or Gln
  SITE (469)..(469): Xaa at position 469 is Met, Ile, Leu, Val, Ala, or Gly
  SITE (476)..(476): Xaa at position 476 is Leu, Ala, Val, Gly, or Ile
  SITE (482)..(482): Xaa at position 482 is Val, Ala, Gly, Leu, or Ile
  SITE (484)..(484): Xaa at position 484 is Ile, Ala, Val, Leu, or Gly
  SITE (487)..(487): Xaa at position 487 is Phe, Tyr, Met, His, Ile, Leu, Val Ala, or Gly
  SITE (513)..(513): Xaa at position 513 is Ala, Gly, or Pro
  SITE (516)..(516): Xaa at position 516 is Val, Ala, Gly, Leu, or Ile
  SITE (531)..(531): Xaa at position 531 is Val, Ala, Gly, Leu, or Ile
  SITE (534)..(534): Xaa at position 534 is Tyr, Phe, Met, His, Ile, Leu, Val Ala, or Gly
  SITE (537)..(537): Xaa at position 537 is Val, Ala, Gly, Leu, or Ile
  SITE (538)..(538): Xaa at position 538 is Leu, Ala, Val, Gly, or Ile
  SITE (542)..(542): Xaa at position 542 is Met, Ile, Leu, Val, Ala, or Gly
  SITE (581)..(581): Xaa at position 581 is Met, Ile, Leu, Val, Ala, or Gly
  SITE (585)..(585): Xaa at position 585 is Val, Ala, Gly, Leu, or Ile
  SITE (588)..(588): Xaa at position 588 is Cys, Ala, Val, Gly, Ser, or Thr
  SITE (599)..(599): Xaa at position 599 is Phe, Tyr, Met, His, Ile, Leu, Val Ala, or Gly
  SITE (606)..(606): Xaa at position 606 is Ile, Ala, Val, Leu, or Gly
MEHIQGAWKTISNGFGFKDAVFDGSSCISPTIVQQFGYQRRASDDGKLTDPSKTSNTXRXFXPNKQRTVVNXRNGMSXHDXXMKAXKVRGLQPECCXXFRLLHEHKGKKARLDWNTDXASLIGEEXQXDFLDHVPLTTHNFARKTFLKLAFXDICQKFLLNGFRXQTCGYKFHEHXSTKXPTMXVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDXAVKILKVVDPTPEQFQAFRNEVAVLRKTRHVNXLLFMGYMTKDNLAIXTQWCEGSSLYKHLHVQETKFQMFQLXDIXRQTXQGXDYXHAKNIIXRDXKSNNIFXHEGLTXKXGDXGLATVKSRWSGSQQVEQPTGSVLWMXPEXIRMQDNNPFSFQSDXYSXGIXXYELXTGELPYSHINNRDQIIFMVGRGYASPDLSKLYKNCPKAXKRLXADXVKKVKEERPLXPQILSSXELLQHSLPKINRSASEPSLHRAAHTEDINACTLTTSPRLPVF

SEQ ID NO: 174 - protein, 536 aa, Homo sapiens
  SITE (54)..(54): Xaa at position 54 is Val, Ala, Gly, Leu, or Ile
  SITE (55)..(55): Xaa at position 55 is Cys, Ala, Val, Gly, Ser, or Thr
  SITE (57)..(57): Xaa at position 57 is Cys, Ala, Val, Gly, Ser, or Thr
  SITE (76)..(76): Xaa at position 76 is Phe, Tyr, Met, His, Ile, Leu, Val Ala, or Gly
  SITE (108)..(108): Xaa at position 108 is Leu, Ala, Val, Gly, or Ile
  SITE (120)..(120): Xaa at position 120 is Phe, Tyr, Met, His, Ile, Leu, Val Ala, or Gly
  SITE (123)..(123): Xaa at position 123 is Ala, Gly, or Pro
  SITE (124)..(124): Xaa at position 124 is Met, Ile, Leu, Val, Ala, or Gly
  SITE (127)..(127): Xaa at position 127 is Ala, Gly, or Pro
  SITE (128)..(128): Xaa at position 128 is Ala, Gly, or Pro
  SITE (129)..(129): Xaa at position 129 is Ala, Gly, or Pro
  SITE (132)..(132): Xaa at position 132 is Ile, Ala, Val, Leu, or Gly
  SITE (139)..(139): Xaa at position 139 is Ala, Gly, or Pro
  SITE (142)..(142): Xaa at position 142 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (147)..(147): Xaa at position 147 is Tyr, Phe, Met, His, Ile, Leu, Val Ala, or Gly
  SITE (148)..(148): Xaa at position 148 is Phe, Tyr, Met, His, Ile, Leu, Val Ala, or Gly
  SITE (153)..(153): Xaa at position 153 is Ile, Ala, Val, Leu, or Gly
  SITE (155)..(155): Xaa at position 155 is Tyr, Phe, Met, His, Ile, Leu, Val Ala, or Gly
  SITE (157)..(157): Xaa at position 157 is Ile, Ala, Val, Leu, or Gly
  SITE (158)..(158): Xaa at position 158 is Ile, Ala, Val, Leu, or Gly
  SITE (160)..(160): Xaa at position 160 is Val, Ala, Gly, Leu, or Ile
  SITE (162)..(162): Xaa at position 162 is Met, Ile, Leu, Val, Ala, or Gly
  SITE (163)..(163): Xaa at position 163 is Ala, Gly, or Pro
  SITE (165)..(165): Xaa at position 165 is Cys, Ala, Val, Gly, Ser, or Thr
  SITE (167)..(167): Xaa at position 167 is Phe, Tyr, Met, His, Ile, Leu, Val Ala, or Gly
  SITE (175)..(175): Xaa at position 175 is Ala, Gly, or Pro
  SITE (183)..(183): Xaa at position 183 is Leu, Ala, Val, Gly, or Ile
  SITE (199)..(199): Xaa at position 199 is Leu, Ala, Val, Gly, or Ile
  SITE (200)..(200): Xaa at position 200 is Ile, Ala, Val, Leu, or Gly
  SITE (203)..(203): Xaa at position 203 is Ala, Gly, or Pro
  SITE (213)..(213): Xaa at position 213 is Leu, Ala, Val, Gly, or Ile
  SITE (214)..(214): Xaa at position 214 is Leu, Ala, Val, Gly, or Ile
  SITE (215)..(215): Xaa at position 215 is Ala, Gly, or Pro
  SITE (224)..(224): Xaa at position 224 is Leu, Ala, Val, Gly, or Ile
  SITE (245)..(245): Xaa at position 245 is His, Phe, Tyr, Lys, Arg, Gly, Ser Thr, Ala, Val, Leu, Ile, Asn, Met, or Gln
  SITE (248)..(248): Xaa at position 248 is Trp, Tyr, Phe, Met, His, Ile, Leu Val, Ala, or Gly
  SITE (249)..(249): Xaa at position 249 is Ala, Gly, or Pro
  SITE (251)..(251): Xaa at position 251 is Tyr, Phe, Met, His, Ile, Leu, Val Ala, or Gly
  SITE (252)..(252): Xaa at position 252 is Phe, Tyr, Met, His, Ile, Leu, Val Ala, or Gly
  SITE (255)..(255): Xaa at position 255 is Phe, Tyr, Met, His, Ile, Leu, Val Ala, or Gly
  SITE (256)..(256): Xaa at position 256 is Leu, Ala, Val, Gly, or Ile
  SITE (259)..(259): Xaa at position 259 is Tyr, Phe, Met, His, Ile, Leu, Val Ala, or Gly
  SITE (264)..(264): Xaa at position 264 is Leu, Ala, Val, Gly, or Ile
  SITE (268)..(268): Xaa at position 268 is Ala, Gly, or Pro
  SITE (269)..(269): Xaa at position 269 is Val, Ala, Gly, Leu, or Ile
  SITE (271)..(271): Xaa at position 271 is Ala, Gly, or Pro
  SITE (287)..(287): Xaa at position 287 is Cys, Ala, Val, Gly, Ser, or Thr
  SITE (288)..(288): Xaa at position 288 is Leu, Ala, Val, Gly, or Ile
  SITE (290)..(290): Xaa at position 290 is Phe, Tyr, Met, His, Ile, Leu, Val Ala, or Gly
  SITE (298)..(298): Xaa at position 298 is Phe, Tyr, Met, His, Ile, Leu, Val Ala, or Gly
  SITE (299)..(299): Xaa at position 299 is Ile, Ala, Val, Leu, or Gly
  SITE (303)..(303): Xaa at position 303 is Leu, Ala, Val, Gly, or Ile
  SITE (318)..(318): Xaa at position 318 is Leu, Ala, Val, Gly, or Ile
  SITE (319)..(319): Xaa at position 319 is Met, Ile, Leu, Val, Ala, or Gly
  SITE (320)..(320): Xaa at position 320 is Leu, Ala, Val, Gly, or Ile
  SITE (331)..(331): Xaa at position 331 is Ala, Gly, or Pro
  SITE (334)..(334): Xaa at position 334 is Val, Ala, Gly, Leu, or Ile
  SITE (340)..(340): Xaa at position 340 is Ala, Gly, or Pro
  SITE (347)..(347): Xaa at position 347 is Ile, Ala, Val, Leu, or Gly
  SITE (348)..(348): Xaa at position 348 is Ala, Gly, or Pro
  SITE (349)..(349): Xaa at position 349 is Val, Ala, Gly, Leu, or Ile
  SITE (350)..(350): Xaa at position 350 is His, Phe, Tyr, Lys, Arg, Gly, Ser Thr, Ala, Val, Leu, Ile, Asn, Met, or Gln
  SITE (357)..(357): Xaa at position 357 is Ala, Gly, or Pro
  SITE (363)..(363): Xaa at position 363 is Leu, Ala, Val, Gly, or Ile
  SITE (375)..(375): Xaa at position 375 is Leu, Ala, Val, Gly, or Ile
  SITE (376)..(376): Xaa at position 376 is Phe, Tyr, Met, His, Ile, Leu, Val Ala, or Gly
  SITE (377)..(377): Xaa at position 377 is Ala, Gly, or Pro
  SITE (380)..(380): Xaa at position 380 is Ala, Gly, or Pro
  SITE (381)..(381): Xaa at position 381 is Cys, Ala, Val, Gly, Ser, or Thr
  SITE (382)..(382): Xaa at position 382 is Val, Ala, Gly, Leu, or Ile
  SITE (396)..(396): Xaa at position 396 is Trp, Tyr, Phe, Met, His, Ile, Leu Val, Ala, or Gly
  SITE (402)..(402): Xaa at position 402 is Tyr, Phe, Met, His, Ile, Leu, Val Ala, or Gly
  SITE (406)..(406): Xaa at position 406 is Ile, Ala, Val, Leu, or Gly
  SITE (407)..(407): Xaa at position 407 is Ile, Ala, Val, Leu, or Gly
  SITE (414)..(414): Xaa at position 414 is Val, Ala, Gly, Leu, or Ile
  SITE (417)..(417): Xaa at position 417 is Trp, Tyr, Phe, Met, His, Ile, Leu Val, Ala, or Gly
  SITE (422)..(422): Xaa at position 422 is Leu, Ala, Val, Gly, or Ile
  SITE (423)..(423): Xaa at position 423 is Ala, Gly, or Pro
  SITE (424)..(424): Xaa at position 424 is Leu, Ala, Val, Gly, or Ile
  SITE (437)..(437): Xaa at position 437 is Val, Ala, Gly, Leu, or Ile
  SITE (441)..(441): Xaa at position 441 is Ile, Ala, Val, Leu, or Gly
  SITE (442)..(442): Xaa at position 442 is Ile, Ala, Val, Leu, or Gly
  SITE (443)..(443): Xaa at position 443 is Val, Ala, Gly, Leu, or Ile
  SITE (450)..(450): Xaa at position 450 is Phe, Tyr, Met, His, Ile, Leu, Val Ala, or Gly
  SITE (455)..(455): Xaa at position 455 is Met, Ile, Leu, Val, Ala, or Gly
  SITE (456)..(456): Xaa at position 456 is Phe, Tyr, Met, His, Ile, Leu, Val Ala, or Gly
  SITE (458)..(458): Xaa at position 458 is His, Phe, Tyr, Lys, Arg, Gly, Ser Thr, Ala, Val, Leu, Ile, Asn, Met, or Gln
  SITE (459)..(459): Xaa at position 459 is Leu, Ala, Val, Gly, or Ile
  SITE (461)..(461): Xaa at position 461 is His, Phe, Tyr, Lys, Arg, Gly, Ser Thr, Ala, Val, Leu, Ile, Asn, Met, or Gln
  SITE (462)..(462): Xaa at position 462 is Phe, Tyr, Met, His, Ile, Leu, Val Ala, or Gly
  SITE (466)..(466): Xaa at position 466 is Ile, Ala, Val, Leu, or Gly
  SITE (473)..(473): Xaa at position 473 is Val, Ala, Gly, Leu, or Ile
  SITE (485)..(485): Xaa at position 485 is Ala, Gly, or Pro
  SITE (486)..(486): Xaa at position 486 is Val, Ala, Gly, Leu, or Ile
  SITE (487)..(487): Xaa at position 487 is Ala, Gly, or Pro
  SITE (488)..(488): Xaa at position 488 is Leu, Ala, Val, Gly, or Ile
  SITE (495)..(495): Xaa at position 495 is Ala, Gly, or Pro
  SITE (496)..(496): Xaa at position 496 is Val, Ala, Gly, Leu, or Ile
  SITE (497)..(497): Xaa at position 497 is Val, Ala, Gly, Leu, or Ile
  SITE (498)..(498): Xaa at position 498 is Val, Ala, Gly, Leu, or Ile
  SITE (499)..(499): Xaa at position 499 is Val, Ala, Gly, Leu, or Ile
  SITE (500)..(500): Xaa at position 500 is Leu, Ala, Val, Gly, or Ile
  SITE (509)..(509): Xaa at position 509 is Leu, Ala, Val, Gly, or Ile
  SITE (511)..(511): Xaa at position 511 is Ile, Ala, Val, Leu, or Gly
  SITE (519)..(519): Xaa at position 519 is Leu, Ala, Val, Gly, or Ile
  SITE (528)..(528): Xaa at position 528 is Ile, Ala, Val, Leu, or Gly
  SITE (529)..(529): Xaa at position 529 is His, Phe, Tyr, Lys, Arg, Gly, Ser Thr, Ala, Val, Leu, Ile, Asn, Met, or Gln
  SITE (531)..(531): Xaa at position 531 is Tyr, Phe, Met, His, Ile, Leu, Val Ala, or Gly
  SITE (533)..(533): Xaa at position 533 is Trp, Tyr, Phe, Met, His, Ile, Leu Val, Ala, or Gly
MEFSSPSREECPKPLSRVSIMAGSLTGLLLLQAVSWASGARPCIPKSFGYSSVXXVXNATYCDSFDPPTFPALGTXSRYESTRSGRRMELSMGPIQANHTGTGLLLTXQPEQKFQKVKGXGGXXTDXXXLNXLALSPPXQNXXXKSXXSEEGXGXNXXRXPXXSXDXSIRTYTYXDTPDDFQXHNFSLPEEDTKLKIPXXHRXLQLAQRPVSXXXSPWTSPTWXKTNGAVNGKGSLKGQPGDIYXQTXXRXXVKXXDAXAEHKXQFWXXTXENEPSAGLLSGYPFQXXGXTPEHQRDXXARDXGPTLANSTHHNVRLXXXDDQRLLLPHWXKVXLTDPEXAKYVHGXXXXWYLDFLXPAKATXGETHRLFPNTMXXXSEXXXGSKFWEQSVRLGSXDRGMQXSHSXXTNLLYHXVGXTDWNXXXNPEGGPNWVRNFXDSPXXXDITKDTXYKQPXXYXXGXXSKFXPEGSQRXGLVASQKNDLDXXXXMHPDGSXXXXXXNRSSKDVPXTXKDPAVGFXETISPGYSXXTXLXRRQ

SEQ ID NO: 175 - protein, 461 aa, Homo sapiens
  SITE (105)..(105): Xaa at position 105 is Cys, Ala, Val, Gly, Ser, or Thr
  SITE (131)..(131): Xaa at position 131 is Cys, Ala, Val, Gly, Ser, or Thr
  SITE (212)..(212): Xaa at position 212 is Leu, Ala, Val, Gly, or Ile
  SITE (227)..(227): Xaa at position 227 is Val, Ala, Gly, Leu, or Ile
  SITE (228)..(228): Xaa at position 228 is Val, Ala, Gly, Leu, or Ile
  SITE (229)..(229): Xaa at position 229 is Leu, Ala, Val, Gly, or Ile
  SITE (240)..(240): Xaa at position 240 is Ala, Gly, or Pro
  SITE (241)..(241): Xaa at position 241 is Val, Ala, Gly, Leu, or Ile
  SITE (242)..(242): Xaa at position 242 is Leu, Ala, Val, Gly, or Ile
  SITE (248)..(248): Xaa at position 248 is Val, Ala, Gly, Leu, or Ile
  SITE (249)..(249): Xaa at position 249 is Leu, Ala, Val, Gly, or Ile
  SITE (251)..(251): Xaa at position 251 is Ala, Gly, or Pro
  SITE (254)..(254): Xaa at position 254 is Cys, Ala, Val, Gly, Ser, or Thr
  SITE (263)..(263): Xaa at position 263 is Val, Ala, Gly, Leu, or Ile
  SITE (265)..(265): Xaa at position 265 is Leu, Ala, Val, Gly, or Ile
  SITE (280)..(280): Xaa at position 280 is Leu, Ala, Val, Gly, or Ile
  SITE (300)..(300): Xaa at position 300 is Ile, Ala, Val, Leu, or Gly
  SITE (301)..(301): Xaa at position 301 is Ala, Gly, or Pro
  SITE (302)..(302): Xaa at position 302 is Leu, Ala, Val, Gly, or Ile
  SITE (303)..(303): Xaa at position 303 is Leu, Ala, Val, Gly, or Ile
  SITE (339)..(339): Xaa at position 339 is Val, Ala, Gly, Leu, or Ile
  SITE (363)..(363): Xaa at position 363 is Ile, Ala, Val, Leu, or Gly
  SITE (365)..(365): Xaa at position 365 is Ile, Ala, Val, Leu, or Gly
  SITE (373)..(373): Xaa at position 373 is Cys, Ala, Val, Gly, Ser, or Thr
  SITE (388)..(388): Xaa at position 388 is Ala, Gly, or Pro
  SITE (406)..(406): Xaa at position 406 is Met, Ile, Leu, Val, Ala, or Gly
  SITE (408)..(408): Xaa at position 408 is Ala, Gly, or Pro
  SITE (417)..(417): Xaa at position 417 is Val, Ala, Gly, Leu, or Ile
  SITE (419)..(419): Xaa at position 419 is Leu, Ala, Val, Gly, or Ile
  SITE (434)..(434): Xaa at position 434 is Val, Ala, Gly, Leu, or Ile
  SITE (435)..(435): Xaa at position 435 is Tyr, Phe, Met, His, Ile, Leu, Val Ala, or Gly
  SITE (438)..(438): Xaa at position 438 is Val, Ala, Gly, Leu, or Ile
  SITE (445)..(445): Xaa at position 445 is Ile, Ala, Val, Leu, or Gly
  SITE (449)..(449): Xaa at position 449 is Ile, Ala, Val, Leu, or Gly
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLXCGHGTCIDGIGSFSCDCRSGWEGRFXQREVSFLNCSLDNGGCTHYCLEEVGWRRCSCAPGYKLGDDLLQCHPAVKFPCGRPWKRMEKKRSHLKRDTEDQEDQVDPRXIDGKMTRRGDSPWQXXXLDSKKKLACGXXXIHPSWXXTXAHXMDESKKLLXRXGEYDLRRWEKWELDXDIKEVFVHPNYSKSTTDNDXXXXHLAQPATLSQTIVPICLPDSGLAERELNQAGQETLXTGWGYHSSREKEAKRNRTFVLNFXKXPVVPHNEXSEVMSNMVSENMLCXGILGDRQDACEGDSGGPXVXSFHGTWFLXGXVSWGEGCGLLHNYGXXTKXSRYLDWXHGHXRDKEAPQKSWAP

SEQ ID NO: 176 - protein, 98 aa, Homo sapiens
  SITE (20)..(20): Xaa at position 20 is Ala, Gly, or Pro
  SITE (23)..(23): Xaa at position 23 is Val, Ala, Gly, Leu, or Ile
  SITE (27)..(27): Xaa at position 27 is Leu, Ala, Val, Gly, or Ile
  SITE (54)..(54): Xaa at position 54 is Phe, Tyr, Met, His, Ile, Leu, Val Ala, or Gly
  SITE (55)..(55): Xaa at position 55 is Ile, Ala, Val, Leu, or Gly
  SITE (57)..(57): Xaa at position 57 is Val, Ala, Gly, Leu, or Ile
  SITE (65)..(65): Xaa at position 65 is Val, Ala, Gly, Leu, or Ile
  SITE (66)..(66): Xaa at position 66 is His, Phe, Tyr, Lys, Arg, Gly, Ser Thr, Ala, Val, Leu, Ile, Asn, Met, or Gln
  SITE (67)..(67): Xaa at position 67 is Leu, Ala, Val, Gly, or Ile
  SITE (69)..(69): Xaa at position 69 is Val, Ala, Gly, Leu, or Ile
  SITE (82)..(82): Xaa at position 82 is Leu, Ala, Val, Gly, or Ile
MMCGAPSATQPATAETQHIXDQXRSQXEEKENKKFPVFKAVSFKSQVVAGTNYXXKXHVGDEDFXXXRXFQSLPHENKPLTXSNYQTNKAKHDELTYF

SEQ ID NO: 177 - protein, 84 aa, Homo sapiens
  SITE (51)..(51): Xaa at position 51 is Cys, Ala, Val, Gly, Ser, or Thr
  SITE (57)..(57): Xaa at position 57 is Cys, Ala, Val, Gly, Ser, or Thr
  SITE (68)..(68): Xaa at position 68 is Cys, Ala, Val, Gly, Ser, or Thr
  SITE (69)..(69): Xaa at position 69 is Phe, Tyr, Met, His, Ile, Leu, Val Ala, or Gly
MATMENKVICALVLVSMLALGTLAEAQTETCTVAPRERQNCGFPGVTPSQXANKGCXFDDTVRGVPWXXYPNTIDVPPEEECEF

SEQ ID NO: 178 - protein, 253 aa, Homo sapiens
  SITE (139)..(139): Xaa at position 139 is Ile, Ala, Val, Leu, or Gly
  SITE (150)..(150): Xaa at position 150 is Tyr, Phe, Met, His, Ile, Leu, Val Ala, or Gly
  SITE (157)..(157): Xaa at position 157 is Tyr, Phe, Met, His, Ile, Leu, Val Ala, or Gly
  SITE (161)..(161): Xaa at position 161 is Val, Ala, Gly, Leu, or Ile
  SITE (163)..(163): Xaa at position 163 is Tyr, Phe, Met, His, Ile, Leu, Val Ala, or Gly
  SITE (175)..(175): Xaa at position 175 is Phe, Tyr, Met, His, Ile, Leu, Val Ala, or Gly
  SITE (176)..(176): Xaa at position 176 is Val, Ala, Gly, Leu, or Ile
  SITE (179)..(179): Xaa at position 179 is Cys, Ala, Val, Gly, Ser, or Thr
  SITE (180)..(180): Xaa at position 180 is Val, Ala, Gly, Leu, or Ile
  SITE (182)..(182): Xaa at position 182 is Ile, Ala, Val, Leu, or Gly
  SITE (184)..(184): Xaa at position 184 is Ile, Ala, Val, Leu, or Gly
  SITE (205)..(205): Xaa at position 205 is Met, Ile, Leu, Val, Ala, or Gly
  SITE (206)..(206): Xaa at position 206 is Met, Ile, Leu, Val, Ala, or Gly
  SITE (209)..(209): Xaa at position 209 is Val, Ala, Gly, Leu, or Ile
  SITE (210)..(210): Xaa at position 210 is Val, Ala, Gly, Leu, or Ile
  SITE (213)..(213): Xaa at position 213 is Met, Ile, Leu, Val, Ala, or Gly
  SITE (214)..(214): Xaa at position 214 is Cys, Ala, Val, Gly, Ser, or Thr
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIXHFGSDYEDRYXRENMHRXPNQXYXRPMDEYSNQNNXXHDXXNXTXKQHTVTTTTKGENFTETDVKXXERXXEQXXITQYERESQAYYQRGSSMVLFSSPPVILLISFLIFLIVG

SEQ ID NO: 179 - protein, 222 aa, Homo sapiens
  SITE (38)..(38): Xaa at position 38 is Leu, Ala, Val, Gly, or Ile
  SITE (42)..(42): Xaa at position 42 is Ile, Ala, Val, Leu, or Gly
  SITE (46)..(46): Xaa at position 46 is Ile, Ala, Val, Leu, or Gly
  SITE (47)..(47): Xaa at position 47 is Met, Ile, Leu, Val, Ala, or Gly
  SITE (50)..(50): Xaa at position 50 is His, Phe, Tyr, Lys, Arg, Gly, Ser Thr, Ala, Val, Leu, Ile, Asn, Met, or Gln
  SITE (54)..(54): Xaa at position 54 is His, Phe, Tyr, Lys, Arg, Gly, Ser Thr, Ala, Val, Leu, Ile, Asn, Met, or Gln
  SITE (55)..(55): Xaa at position 55 is His, Phe, Tyr, Lys, Arg, Gly, Ser Thr, Ala, Val, Leu, Ile, Asn, Met, or Gln
  SITE (59)..(59): Xaa at position 59 is Val, Ala, Gly, Leu, or Ile
  SITE (62)..(62): Xaa at position 62 is Leu, Ala, Val, Gly, or Ile
  SITE (72)..(72): Xaa at position 72 is Ala, Gly, or Pro
  SITE (82)..(82): Xaa at position 82 is Ile, Ala, Val, Leu, or Gly
  SITE (88)..(88): Xaa at position 88 is Leu, Ala, Val, Gly, or Ile
  SITE (98)..(98): Xaa at position 98 is His, Phe, Tyr, Lys, Arg, Gly, Ser Thr, Ala, Val, Leu, Ile, Asn, Met, or Gln
  SITE (101)..(101): Xaa at position 101 is Phe, Tyr, Met, His, Ile, Leu, Val Ala, or Gly
  SITE (102)..(102): Xaa at position 102 is Trp, Tyr, Phe, Met, His, Ile, Leu Val, Ala, or Gly
  SITE (105)..(105): Xaa at position 105 is Leu, Ala, Val, Gly, or Ile
  SITE (117)..(117): Xaa at position 117 is Leu, Ala, Val, Gly, or Ile
  SITE (120)..(120): Xaa at position 120 is Ala, Gly, or Pro
  SITE (121)..(121): Xaa at position 121 is Ile, Ala, Val, Leu, or Gly
  SITE (131)..(131): Xaa at position 131 is Phe, Tyr, Met, His, Ile, Leu, Val Ala, or Gly
  SITE (135)..(135): Xaa at position 135 is Leu, Ala, Val, Gly, or Ile
  SITE (147)..(147): Xaa at position 147 is Trp, Tyr, Phe, Met, His, Ile, Leu Val, Ala, or Gly
  SITE (149)..(149): Xaa at position 149 is Trp, Tyr, Phe, Met, His, Ile, Leu Val, Ala, or Gly
  SITE (150)..(150): Xaa at position 150 is Leu, Ala, Val, Gly, or Ile
  SITE (164)..(164): Xaa at position 164 is Cys, Ala, Val, Gly, Ser, or Thr
  SITE (170)..(170): Xaa at position 170 is Leu, Ala, Val, Gly, or Ile
  SITE (179)..(179): Xaa at position 179 is Leu, Ala, Val, Gly, or Ile
  SITE (180)..(180): Xaa at position 180 is Leu, Ala, Val, Gly, or Ile
  SITE (182)..(182): Xaa at position 182 is Ile, Ala, Val, Leu, or Gly
  SITE (184)..(184): Xaa at position 184 is Val, Ala, Gly, Leu, or Ile
  SITE (185)..(185): Xaa at position 185 is Trp, Tyr, Phe, Met, His, Ile, Leu Val, Ala, or Gly
  SITE (188)..(188): Xaa at position 188 is Ala, Gly, or Pro
  SITE (189)..(189): Xaa at position 189 is Tyr, Phe, Met, His, Ile, Leu, Val Ala, or Gly
  SITE (200)..(200): Xaa at position 200 is Tyr, Phe, Met, His, Ile, Leu, Val Ala, or Gly
  SITE (201)..(201): Xaa at position 201 is Leu, Ala, Val, Gly, or Ile
  SITE (204)..(204): Xaa at position 204 is Ile, Ala, Val, Leu, or Gly
  SITE (207)..(207): Xaa at position 207 is Val, Ala, Gly, Leu, or Ile
  SITE (208)..(208): Xaa at position 208 is Ile, Ala, Val, Leu, or Gly
  SITE (210)..(210): Xaa at position 210 is Trp, Tyr, Phe, Met, His, Ile, Leu Val, Ala, or Gly
  SITE (213)..(213): Xaa at position 213 is Val, Ala, Gly, Leu, or Ile
  SITE (217)..(217): Xaa at position 217 is Tyr, Phe, Met, His, Ile, Leu, Val Ala, or Gly
MLSRAVCGTSRQLAPALGYLGSRQKHSLPDLPYDYGAXEPHXNAQXXQLXHSKXXAAYXNNXNVTEEKYQEXLAKGDVTAQXALQPAXKFNGGGHINXSIXXTNXSPNGGGEPKGEXLEXXKRDFGSFDKXKEKXTAASVGVQGSGXGXXGFNKERGHLQIAAXPNQDPXQGTTGLIPXXGXDXXEHXXYLQYKNVRPDXXKAXWNXXNXENXTERXMACKK

SEQ ID NO: 180 - protein, 440 aa, Homo sapiens
  SITE (49)..(49): Xaa at position 49 is Val, Ala, Gly, Leu, or Ile
  SITE (50)..(50): Xaa at position 50 is Ile, Ala, Val, Leu, or Gly
  SITE (51)..(51): Xaa at position 51 is Leu, Ala, Val, Gly, or Ile
  SITE (52)..(52): Xaa at position 52 is Val, Ala, Gly, Leu, or Ile
  SITE (60)..(60): Xaa at position 60 is Leu, Ala, Val, Gly, or Ile
  SITE (62)..(62): Xaa at position 62 is Ala, Gly, or Pro
  SITE (117)..(117): Xaa at position 117 is Ala, Gly, or Pro
  SITE (133)..(133): Xaa at position 133 is Val, Ala, Gly, Leu, or Ile
  SITE (149)..(149): Xaa at position 149 is Val, Ala, Gly, Leu, or Ile
  SITE (152)..(152): Xaa at position 152 is Leu, Ala, Val, Gly, or Ile
  SITE (163)..(163): Xaa at position 163 is Val, Ala, Gly, Leu, or Ile
  SITE (165)..(165): Xaa at position 165 is Ala, Gly, or Pro
  SITE (166)..(166): Xaa at position 166 is Ala, Gly, or Pro
  SITE (168)..(168): Xaa at position 168 is Tyr, Phe, Met, His, Ile, Leu, Val Ala, or Gly
  SITE (184)..(184): Xaa at position 184 is Leu, Ala, Val, Gly, or Ile
  SITE (188)..(188): Xaa at position 188 is Val, Ala, Gly, Leu, or Ile
  SITE (191)..(191): Xaa at position 191 is Met, Ile, Leu, Val, Ala, or Gly
  SITE (199)..(199): Xaa at position 199 is Val, Ala, Gly, Leu, or Ile
  SITE (200)..(200): Xaa at position 200 is Phe, Tyr, Met, His, Ile, Leu, Val Ala, or Gly
  SITE (201)..(201): Xaa at position 201 is Leu, Ala, Val, Gly, or Ile
  SITE (202)..(202): Xaa at position 202 is Ile, Ala, Val, Leu, or Gly
  SITE (206)..(206): Xaa at position 206 is Leu, Ala, Val, Gly, or Ile
  SITE (208)..(208): Xaa at position 208 is Cys, Ala, Val, Gly, Ser, or Thr
  SITE (209)..(209): Xaa at position 209 is Leu, Ala, Val, Gly, or Ile
  SITE (210)..(210): Xaa at position 210 is His, Phe, Tyr, Lys, Arg, Gly, Ser Thr, Ala, Val, Leu, Ile, Asn, Met, or Gln
  SITE (211)..(211): Xaa at position 211 is Leu, Ala, Val, Gly, or Ile
  SITE (212)..(212): Xaa at position 212 is Leu, Ala, Val, Gly, or Ile
  SITE (214)..(214): Xaa at position 214 is Phe, Tyr, Met, His, Ile, Leu, Val Ala, or Gly
  SITE (215)..(215): Xaa at position 215 is Leu, Ala, Val, Gly, or Ile
  SITE (230)..(230): Xaa at position 230 is Phe, Tyr, Met, His, Ile, Leu, Val Ala, or Gly
  SITE (231)..(231): Xaa at position 231 is Ile, Ala, Val, Leu, or Gly
  SITE (235)..(235): Xaa at position 235 is Ala, Gly, or Pro
  SITE (241)..(241): Xaa at position 241 is Ile, Ala, Val, Leu, or Gly
  SITE (244)..(244): Xaa at position 244 is Met, Ile, Leu, Val, Ala, or Gly
  SITE (248)..(248): Xaa at position 248 is Ala, Gly, or Pro
  SITE (261)..(261): Xaa at position 261 is Ile, Ala, Val, Leu, or Gly
  SITE (289)..(289): Xaa at position 289 is Phe, Tyr, Met, His, Ile, Leu, Val Ala, or Gly
  SITE (290)..(290): Xaa at position 290 is Ile, Ala, Val, Leu, or Gly
  SITE (305)..(305): Xaa at position 305 is Phe, Tyr, Met, His, Ile, Leu, Val Ala, or Gly
  SITE (306)..(306): Xaa at position 306 is Phe, Tyr, Met, His, Ile, Leu, Val Ala, or Gly
  SITE (309)..(309): Xaa at position 309 is Leu, Ala, Val, Gly, or Ile
  SITE (328)..(328): Xaa at position 328 is Leu, Ala, Val, Gly, or Ile
  SITE (333)..(333): Xaa at position 333 is Val, Ala, Gly, Leu, or Ile
  SITE (335)..(335): Xaa at position 335 is Val, Ala, Gly, Leu, or Ile
  SITE (337)..(337): Xaa at position 337 is Cys, Ala, Val, Gly, Ser, or Thr
  SITE (338)..(338): Xaa at position 338 is Leu, Ala, Val, Gly, or Ile
  SITE (339)..(339): Xaa at position 339 is Tyr, Phe, Met, His, Ile, Leu, Val Ala, or Gly
  SITE (372)..(372): Xaa at position 372 is Val, Ala, Gly, Leu, or Ile
  SITE (373)..(373): Xaa at position 373 is Ala, Gly, or Pro
  SITE (380)..(380): Xaa at position 380 is Cys, Ala, Val, Gly, Ser, or Thr
  SITE (383)..(383): Xaa at position 383 is Trp, Tyr, Phe, Met, His, Ile, Leu Val, Ala, or Gly
  SITE (396)..(396): Xaa at position 396 is Leu, Ala, Val, Gly, or Ile
  SITE (404)..(404): Xaa at position 404 is Met, Ile, Leu, Val, Ala, or Gly
  SITE (405)..(405): Xaa at position 405 is Val, Ala, Gly, Leu, or Ile
  SITE (414)..(414): Xaa at position 414 is Ile, Ala, Val, Leu, or Gly
  SITE (418)..(418): Xaa at position 418 is Leu, Ala, Val, Gly, or Ile
MGPPGSPWQWVTLLLGLLLPPAAPFWLLNVLFPPHTTPKAELSNHTRPXXXXPGCLGNQXEXKLDKPDVVNWMCYRKTEDFFTIWLDLNMFLPLGVDCWIDNTRVVYNRSSGLVSNXPGVQIRVPGFGKTYSXEYLDSSKLAGYLHTLXQNXVNNGYVRDETXRXXPXDWRLEPGQQEEYYRKXAGLXEEXHAAYGKPXXXXGHSXGXXXXXYXXLRQPQAWKDRFIDGXXSLGXPWGGSXKPXLVLXSGDNQGIPIMSSXKLKEEQRITTTSPWMFPSRMAWPEDHVXXSTPSFNYTGRDFQRXXADXHFEEGWYMWLQSRDLLAGXPAPGXEXYXXXGVGLPTPRTYIYDHGFPYTDPVGVLYEDGDDTXXTRSTELXGLXQGRQPQPVHLLPXHGIQHLNXXFSNLTLEHXNAIXLGAYRQGPPASPTASPEPPPPE

SEQ ID NO: 181 - protein, 296 aa, Homo sapiens
  SITE (213)..(213): Xaa at position 213 is Cys, Ala, Val, Gly, Ser, or Thr
  SITE (253)..(253): Xaa at position 253 is Val, Ala, Gly, Leu, or Ile
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKXQEEVSHIPAVHPGSFRPKCDENGNYLPLQCYGSIGYCWCXFPNGTEVPNTRSRGHHNCSESLELEDPSSGLGVTKQDLGPVPM

SEQ ID NO: 182 - protein, 171 aa, Homo sapiens
  SITE (33)..(33): Xaa at position 33 is Val, Ala, Gly, Leu, or Ile
  SITE (35)..(35): Xaa at position 35 is Val, Ala, Gly, Leu, or Ile
  SITE (37)..(37): Xaa at position 37 is Cys, Ala, Val, Gly, Ser, or Thr
  SITE (71)..(71): Xaa at position 71 is Tyr, Phe, Met, His, Ile, Leu, Val Ala, or Gly
MEHSTFLSGLVLATLLSQVSPFKIPIEELEDRXFXNXNTSITWVEGTVGTLLSDITRLDLGKRILDPRGIXRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 183 - protein, 2813 aa, Homo sapiens
  SITE (815)..(815): Xaa at position 815 is Val, Ala, Gly, Leu, or Ile
  SITE (827)..(827): Xaa at position 827 is Cys, Ala, Val, Gly, Ser, or Thr
  SITE (829)..(829): Xaa at position 829 is Cys, Ala, Val, Gly, Ser, or Thr
  SITE (849)..(849): Xaa at position 849 is Cys, Ala, Val, Gly, Ser, or Thr
  SITE (851)..(851): Xaa at position 851 is Cys, Ala, Val, Gly, Ser, or Thr
  SITE (1272)..(1272): Xaa at position 1272 is Cys, Ala, Val, Gly, Ser, or Thr
  SITE (1276)..(1276): Xaa at position 1276 is Leu, Ala, Val, Gly, or Ile
  SITE (1278)..(1278): Xaa at position 1278 is Leu, Ala, Val, Gly, or Ile
  SITE (1279)..(1279): Xaa at position 1279 is Val, Ala, Gly, Leu, or Ile
  SITE (1280)..(1280): Xaa at position 1280 is Phe, Tyr, Met, His, Ile, Leu Val, Ala, or Gly
  SITE (1281)..(1281): Xaa at position 1281 is Leu, Ala, Val, Gly, or Ile
  SITE (1282)..(1282): Xaa at position 1282 is Leu, Ala, Val, Gly, or Ile
  SITE (1293)..(1293): Xaa at position 1293 is Phe, Tyr, Met, His, Ile, Leu Val, Ala, or Gly
  SITE (1296)..(1296): Xaa at position 1296 is Leu, Ala, Val, Gly, or Ile
  SITE (1299)..(1299): Xaa at position 1299 is Phe, Tyr, Met, His, Ile, Leu Val, Ala, or Gly
  SITE (1300)..(1300): Xaa at position 1300 is Val, Ala, Gly, Leu, or Ile
  SITE (1303)..(1303): Xaa at position 1303 is Met, Ile, Leu, Val, Ala, or Gly
  SITE (1304)..(1304): Xaa at position 1304 is Met, Ile, Leu, Val, Ala, or Gly
  SITE (1307)..(1307): Xaa at position 1307 is Leu, Ala, Val, Gly, or Ile
  SITE (1314)..(1314): Xaa at position 1314 is Val, Ala, Gly, Leu, or Ile
  SITE (1316)..(1316): Xaa at position 1316 is Val, Ala, Gly, Leu, or Ile
  SITE (1317)..(1317): Xaa at position 1317 is Ala, Gly, or Pro
  SITE (1318)..(1318): Xaa at position 1318 is Val, Ala, Gly, Leu, or Ile
  SITE (1319)..(1319): Xaa at position 1319 is Val, Ala, Gly, Leu, or Ile
  SITE (1321)..(1321): Xaa at position 1321 is Tyr, Phe, Met, His, Ile, Leu Val, Ala, or Gly
  SITE (1329)..(1329): Xaa at position 1329 is Ile, Ala, Val, Leu, or Gly
  SITE (1340)..(1340): Xaa at position 1340 is Leu, Ala, Val, Gly, or Ile
  SITE (1344)..(1344): Xaa at position 1344 is Ala, Gly, or Pro
  SITE (1347)..(1347): Xaa at position 1347 is Val, Ala, Gly, Leu, or Ile
  SITE (1355)..(1355): Xaa at position 1355 is Ala, Gly, or Pro
  SITE (1360)..(1360): Xaa at position 1360 is Val, Ala, Gly, Leu, or Ile
  SITE (1361)..(1361): Xaa at position 1361 is Leu, Ala, Val, Gly, or Ile
  SITE (1369)..(1369): Xaa at position 1369 is Phe, Tyr, Met, His, Ile, Leu Val, Ala, or Gly
  SITE (1377)..(1377): Xaa at position 1377 is Ala, Gly, or Pro
  SITE (1380)..(1380): Xaa at position 1380 is Ile, Ala, Val, Leu, or Gly
  SITE (1382)..(1382): Xaa at position 1382 is Leu, Ala, Val, Gly, or Ile
  SITE (1383)..(1383): Xaa at position 1383 is Leu, Ala, Val, Gly, or Ile
  SITE (1384)..(1384): Xaa at position 1384 is Leu, Ala, Val, Gly, or Ile
  SITE (1385)..(1385): Xaa at position 1385 is Met, Ile, Leu, Val, Ala, or Gly
  SITE (1386)..(1386): Xaa at position 1386 is Ala, Gly, or Pro
  SITE (1397)..(1397): Xaa at position 1397 is Phe, Tyr, Met, His, Ile, Leu Val, Ala, or Gly
  SITE (1401)..(1401): Xaa at position 1401 is Val, Ala, Gly, Leu, or Ile
  SITE (1404)..(1404): Xaa at position 1404 is Leu, Ala, Val, Gly, or Ile
  SITE (1410)..(1410): Xaa at position 1410 is Ile, Ala, Val, Leu, or Gly
  SITE (1411)..(1411): Xaa at position 1411 is Val, Ala, Gly, Leu, or Ile
  SITE (1412)..(1412): Xaa at position 1412 is Ile, Ala, Val, Leu, or Gly
  SITE (1414)..(1414): Xaa at position 1414 is Val, Ala, Gly, Leu, or Ile
  SITE (1416)..(1416): Xaa at position 1416 is Ile, Ala, Val, Leu, or Gly
  SITE (1420)..(1420): Xaa at position 1420 is Ala, Gly, or Pro
  SITE (1425)..(1425): Xaa at position 1425 is Ile, Ala, Val, Leu, or Gly
  SITE (1428)..(1428): Xaa at position 1428 is Ile, Ala, Val, Leu, or Gly
  SITE (1438)..(1438): Xaa at position 1438 is Phe, Tyr, Met, His, Ile, Leu Val, Ala, or Gly
  SITE (1440)..(1440): Xaa at position 1440 is Leu, Ala, Val, Gly, or Ile
  SITE (1443)..(1443): Xaa at position 1443 is Val, Ala, Gly, Leu, or Ile
  SITE (1446)..(1446): Xaa at position 1446 is Leu, Ala, Val, Gly, or Ile
  SITE (1453)..(1453): Xaa at position 1453 is Ile, Ala, Val, Leu, or Gly
  SITE (1454)..(1454): Xaa at position 1454 is Val, Ala, Gly, Leu, or Ile
  SITE (1457)..(1457): Xaa at position 1457 is Leu, Ala, Val, Gly, or Ile
  SITE (1497)..(1497): Xaa at position 1497 is Leu, Ala, Val, Gly, or Ile
  SITE (1499)..(1499): Xaa at position 1499 is Val, Ala, Gly, Leu, or Ile
  SITE (1500)..(1500): Xaa at position 1500 is Ala, Gly, or Pro
  SITE (1501)..(1501): Xaa at position 1501 is Phe, Tyr, Met, His, Ile, Leu Val, Ala, or Gly
  SITE (1502)..(1502): Xaa at position 1502 is Val, Ala, Gly, Leu, or Ile
  SITE (1503)..(1503): Xaa at position 1503 is Leu, Ala, Val, Gly, or Ile
  SITE (1514)..(1514): Xaa at position 1514 is Phe, Tyr, Met, His, Ile, Leu Val, Ala, or Gly
  SITE (1520)..(1520): Xaa at position 1520 is Phe, Tyr, Met, His, Ile, Leu Val, Ala, or Gly
  SITE (1521)..(1521): Xaa at position 1521 is Met, Ile, Leu, Val, Ala, or Gly
  SITE (1524)..(1524): Xaa at position 1524 is Val, Ala, Gly, Leu, or Ile
  SITE (1525)..(1525): Xaa at position 1525 is Ile, Ala, Val, Leu, or Gly
  SITE (1528)..(1528): Xaa at position 1528 is Met, Ile, Leu, Val, Ala, or Gly
  SITE (1535)..(1535): Xaa at position 1535 is Ile, Ala, Val, Leu, or Gly
  SITE (1537)..(1537): Xaa at position 1537 is Val, Ala, Gly, Leu, or Ile
  SITE (1539)..(1539): Xaa at position 1539 is Val, Ala, Gly, Leu, or Ile
  SITE (1540)..(1540): Xaa at position 1540 is Leu, Ala, Val, Gly, or Ile
  SITE (1542)..(1542): Xaa at position 1542 is Tyr, Phe, Met, His, Ile, Leu Val, Ala, or Gly
  SITE (1550)..(1550): Xaa at position 1550 is Tyr, Phe, Met, His, Ile, Leu Val, Ala, or Gly
  SITE (1561)..(1561): Xaa at position 1561 is Ile, Ala, Val, Leu, or Gly
  SITE (1565)..(1565): Xaa at position 1565 is Val, Ala, Gly, Leu, or Ile
  SITE (1581)..(1581): Xaa at position 1581 is Ala, Gly, or Pro
  SITE (1582)..(1582): Xaa at position 1582 is Leu, Ala, Val, Gly, or Ile
  SITE (1585)..(1585): Xaa at position 1585 is Leu, Ala, Val, Gly, or Ile
  SITE (1600)..(1600): Xaa at position 1600 is Ala, Gly, or Pro
  SITE (1604)..(1604): Xaa at position 1604 is Val, Ala, Gly, Leu, or Ile
  SITE (1605)..(1605): Xaa at position 1605 is Tyr, Phe, Met, His, Ile, Leu Val, Ala, or Gly
  SITE (1606)..(1606): Xaa at position 1606 is Met, Ile, Leu, Val, Ala, or Gly
  SITE (1607)..(1607): Xaa at position 1607 is Val, Ala, Gly, Leu, or Ile
  SITE (1625)..(1625): Xaa at position 1625 is Val, Ala, Gly, Leu, or Ile
  SITE (1626)..(1626): Xaa at position 1626 is Val, Ala, Gly, Leu, or Ile
  SITE (1628)..(1628): Xaa at position 1628 is Ile, Ala, Val, Leu, or Gly
  SITE (1630)..(1630): Xaa at position 1630 is Val, Ala, Gly, Leu, or Ile
  SITE (1642)..(1642): Xaa at position 1642 is Ile, Ala, Val, Leu, or Gly
  SITE (1657)..(1657): Xaa at position 1657 is Leu, Ala, Val, Gly, or Ile
  SITE (1661)..(1661): Xaa at position 1661 is Ala, Gly, or Pro
  SITE (1665)..(1665): Xaa at position 1665 is Val, Ala, Gly, Leu, or Ile
  SITE (1666)..(1666): Xaa at position 1666 is Leu, Ala, Val, Gly, or Ile
  SITE (1670)..(1670): Xaa at position 1670 is Cys, Ala, Val, Gly, Ser, or Thr
  SITE (1690)..(1690): Xaa at position 1690 is Leu, Ala, Val, Gly, or Ile
  SITE (1692)..(1692): Xaa at position 1692 is Val, Ala, Gly, Leu, or Ile
  SITE (1693)..(1693): Xaa at position 1693 is Ile, Ala, Val, Leu, or Gly
  SITE (1694)..(1694): Xaa at position 1694 is Leu, Ala, Val, Gly, or Ile
  SITE (1695)..(1695): Xaa at position 1695 is Leu, Ala, Val, Gly, or Ile
  SITE (1696)..(1696): Xaa at position 1696 is Leu, Ala, Val, Gly, or Ile
  SITE (1707)..(1707): Xaa at position 1707 is Phe, Tyr, Met, His, Ile, Leu Val, Ala, or Gly
  SITE (1713)..(1713): Xaa at position 1713 is Phe, Tyr, Met, His, Ile, Leu Val, Ala, or Gly
  SITE (1714)..(1714): Xaa at position 1714 is Ala, Gly, or Pro
  SITE (1717)..(1717): Xaa at position 1717 is Phe, Tyr, Met, His, Ile, Leu Val, Ala, or Gly
  SITE (1718)..(1718): Xaa at position 1718 is Ile, Ala, Val, Leu, or Gly
  SITE (1721)..(1721): Xaa at position 1721 is Ala, Gly, or Pro
  SITE (1732)..(1732): Xaa at position 1732 is Val, Ala, Gly, Leu, or Ile
  SITE (1733)..(1733): Xaa at position 1733 is Leu, Ala, Val, Gly, or Ile
  SITE (1735)..(1735): Xaa at position 1735 is Tyr, Phe, Met, His, Ile, Leu Val, Ala, or Gly
  SITE (1743)..(1743): Xaa at position 1743 is Val, Ala, Gly, Leu, or Ile
  SITE (1754)..(1754): Xaa at position 1754 is Leu, Ala, Val, Gly, or Ile
  SITE (1758)..(1758): Xaa at position 1758 is Val, Ala, Gly, Leu, or Ile
  SITE (1761)..(1761): Xaa at position 1761 is Met, Ile, Leu, Val, Ala, or Gly
  SITE (1770)..(1770): Xaa at position 1770 is Ile, Ala, Val, Leu, or Gly
  SITE (1773)..(1773): Xaa at position 1773 is Ala, Gly, or Pro
  SITE (1774)..(1774): Xaa at position 1774 is Leu, Ala, Val, Gly, or Ile
  SITE (1777)..(1777): Xaa at position 1777 is Ala, Gly, or Pro
  SITE (1781)..(1781): Xaa at position 1781 is Leu, Ala, Val, Gly, or Ile
  SITE (1795)..(1795): Xaa at position 1795 is Ala, Gly, or Pro
  SITE (1796)..(1796): Xaa at position 1796 is Val, Ala, Gly, Leu, or Ile
  SITE (1797)..(1797): Xaa at position 1797 is Val, Ala, Gly, Leu, or Ile
  SITE (1798)..(1798): Xaa at position 1798 is Ile, Ala, Val, Leu, or Gly
  SITE (1799)..(1799): Xaa at position 1799 is Leu, Ala, Val, Gly, or Ile
  SITE (1800)..(1800): Xaa at position 1800 is Val, Ala, Gly, Leu, or Ile
  SITE (1808)..(1808): Xaa at position 1808 is Val, Ala, Gly, Leu, or Ile
  SITE (1812)..(1812): Xaa at position 1812 is Ala, Gly, or Pro
  SITE (1815)..(1815): Xaa at position 1815 is Ala, Gly, or Pro
  SITE (1822)..(1822): Xaa at position 1822 is Val, Ala, Gly, Leu, or Ile
  SITE (1825)..(1825): Xaa at position 1825 is Ile, Ala, Val, Leu, or Gly
  SITE (1827)..(1827): Xaa at position 1827 is Ile, Ala, Val, Leu, or Gly
  SITE (1836)..(1836): Xaa at position 1836 is Leu, Ala, Val, Gly, or Ile
  SITE (1839)..(1839): Xaa at position 1839 is Leu, Ala, Val, Gly, or Ile
  SITE (1857)..(1857): Xaa at position 1857 is Leu, Ala, Val, Gly, or Ile
  SITE (1861)..(1861): Xaa at position 1861 is Val, Ala, Gly, Leu, or Ile
  SITE (1871)..(1871): Xaa at position 1871 is Leu, Ala, Val, Gly, or Ile
  SITE (2724)..(2724): Xaa at position 2724 is Cys, Ala, Val, Gly, Ser, or Thr
  SITE (2786)..(2786): Xaa at position 2786 is Leu, Ala, Val, Gly, or Ile
  SITE (2804)..(2804): Xaa at position 2804 is Cys, Ala, Val, Gly, Ser, or Thr
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMXRHENRCVALERXPXFHQGKEYAPGETVKIGCNTXVXQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYXSRLXDXXXXXDGSSRLSEAEXEVXKAXXVDXXERXRISQKWXRXXXXEXHDGSHAYXGLKDRKRPSEXRRIXSQXKYAGSQVXSTSEXXKYTLFQIXSKIDRPEXSRXTXXXXXSQEPQRMSRNXVRYXQGXKKKKVXXXPXGXGPHXNLKQXRLXEKQAPENKAXVXSSXDEXEQQRDEXXSYXCDLAPEAPPPTLPPDMAQVTVGPGLLGVSTLGPKRNSMVXDXXXXXEGSDKIGEADXNRSKEXXEEXXQRXDVGQDSXHXTXXQXSYMVTVEXPFSEAQSKGDXLQRXREIRYQGGNRTNTGLXXRYXSDHSFLVSQGDREQXPNLXXXXTGNPASDEIKRLPGDIQXXPXGXGPNANVQELERXGWPNAPILIQDFETXPREXPDLXXQRCXSGEGLQIPTLSPAPDCSQPXDXXXXXDGSSSFPASYXDEMKSXXKAXXSKXNIGPRLTQVSXXQXGSITTIDXPWNVVPEKAHXLSLXDVXQREGGPSQXGDXXGFXVRYXTSEMHGARPGASKXXXXXXTDVSVDSXDAAXDAXRSNRVTXFPXGXGDRYDAAQXRIXAGPAGDSNVVKLQRIEDXPTMXTLGNSFLHKXCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPEXNDITARLQYVKVGSCKSEVEVDIHYCQGKCASKAMYSIDINDVQDQCSCCSPTRTEPMQVAXHCTNGSVVYHEVLNAMEXKCSPRKCSK

SEQ ID NO: 184 - protein, 464 aa, Homo sapiens
  SITE (34)..(34): Xaa at position 34 is Leu, Ala, Val, Gly, or Ile
  SITE (39)..(39): Xaa at position 39 is Val, Ala, Gly, Leu, or Ile
  SITE (44)..(44): Xaa at position 44 is Ala, Gly, or Pro
  SITE (45)..(45): Xaa at position 45 is Tyr, Phe, Met, His, Ile, Leu, Val Ala, or Gly
  SITE (49)..(49): Xaa at position 49 is Leu, Ala, Val, Gly, or Ile
  SITE (63)..(63): Xaa at position 63 is Ile, Ala, Val, Leu, or Gly
  SITE (67)..(67): Xaa at position 67 is Leu, Ala, Val, Gly, or Ile
  SITE (70)..(70): Xaa at position 70 is Val, Ala, Gly, Leu, or Ile
  SITE (88)..(88): Xaa at position 88 is Ile, Ala, Val, Leu, or Gly
  SITE (89)..(89): Xaa at position 89 is His, Phe, Tyr, Lys, Arg, Gly, Ser Thr, Ala, Val, Leu, Ile, Asn, Met, or Gln
  SITE (91)..(91): Xaa at position 91 is Ala, Gly, or Pro
  SITE (96)..(96): Xaa at position 96 is Leu, Ala, Val, Gly, or Ile
  SITE (104)..(104): Xaa at position 104 is Ala, Gly, or Pro
  SITE (107)..(107): Xaa at position 107 is Leu, Ala, Val, Gly, or Ile
  SITE (118)..(118): Xaa at position 118 is Val, Ala, Gly, Leu, or Ile
  SITE (121)..(121): Xaa at position 121 is Leu, Ala, Val, Gly, or Ile
  SITE (125)..(125): Xaa at position 125 is Met, Ile, Leu, Val, Ala, or Gly
  SITE (129)..(129): Xaa at position 129 is Cys, Ala, Val, Gly, Ser, or Thr
  SITE (132)..(132): Xaa at position 132 is Leu, Ala, Val, Gly, or Ile
  SITE (136)..(136): Xaa at position 136 is Leu, Ala, Val, Gly, or Ile
  SITE (137)..(137): Xaa at position 137 is Trp, Tyr, Phe, Met, His, Ile, Leu Val, Ala, or Gly
  SITE (139)..(139): Xaa at position 139 is Leu, Ala, Val, Gly, or Ile
  SITE (140)..(140): Xaa at position 140 is Ile, Ala, Val, Leu, or Gly
  SITE (143)..(143): Xaa at position 143 is Met, Ile, Leu, Val, Ala, or Gly
  SITE (144)..(144): Xaa at position 144 is Val, Ala, Gly, Leu, or Ile
  SITE (147)..(147): Xaa at position 147 is Ala, Gly, or Pro
  SITE (155)..(155): Xaa at position 155 is Phe, Tyr, Met, His, Ile, Leu, Val Ala, or Gly
  SITE (161)..(161): Xaa at position 161 is Leu, Ala, Val, Gly, or Ile
  SITE (169)..(169): Xaa at position 169 is Trp, Tyr, Phe, Met, His, Ile, Leu Val, Ala, or Gly
  SITE (173)..(173): Xaa at position 173 is Ile, Ala, Val, Leu, or Gly
  SITE (174)..(174): Xaa at position 174 is Leu, Ala, Val, Gly, or Ile
  SITE (177)..(177): Xaa at position 177 is Ala, Gly, or Pro
  SITE (180)..(180): Xaa at position 180 is Leu, Ala, Val, Gly, or Ile
  SITE (187)..(187): Xaa at position 187 is Leu, Ala, Val, Gly, or Ile
  SITE (190)..(190): Xaa at position 190 is Val, Ala, Gly, Leu, or Ile
  SITE (194)..(194): Xaa at position 194 is Ile, Ala, Val, Leu, or Gly
  SITE (197)..(197): Xaa at position 197 is Leu, Ala, Val, Gly, or Ile
  SITE (199)..(199): Xaa at position 199 is Leu, Ala, Val, Gly, or Ile
  SITE (216)..(216): Xaa at position 216 is Leu, Ala, Val, Gly, or Ile
  SITE (220)..(220): Xaa at position 220 is Leu, Ala, Val, Gly, or Ile
  SITE (222)..(222): Xaa at position 222 is Phe, Tyr, Met, His, Ile, Leu, Val Ala, or Gly
  SITE (232)..(232): Xaa at position 232 is Ala, Gly, or Pro
  SITE (238)..(238): Xaa at position 238 is Phe, Tyr, Met, His, Ile, Leu, Val Ala, or Gly
  SITE (239)..(239): Xaa at position 239 is Val, Ala, Gly, Leu, or Ile
  SITE (240)..(240): Xaa at position 240 is Ala, Gly, or Pro
  SITE (242)..(242): Xaa at position 242 is Phe, Tyr, Met, His, Ile, Leu, Val Ala, or Gly
  SITE (243)..(243): Xaa at position 243 is Leu, Ala, Val, Gly, or Ile
  SITE (245)..(245): Xaa at position 245 is Trp, Tyr, Phe, Met, His, Ile, Leu Val, Ala, or Gly
  SITE (246)..(246): Xaa at position 246 is Ala, Gly, or Pro
  SITE (249)..(249): Xaa at position 249 is Cys, Ala, Val, Gly, Ser, or Thr
  SITE (250)..(250): Xaa at position 250 is Met, Ile, Leu, Val, Ala, or Gly
  SITE (253)..(253): Xaa at position 253 is Leu, Ala, Val, Gly, or Ile
  SITE (256)..(256): Xaa at position 256 is Met, Ile, Leu, Val, Ala, or Gly
  SITE (257)..(257): Xaa at position 257 is Ala, Gly, or Pro
  SITE (260)..(260): Xaa at position 260 is Leu, Ala, Val, Gly, or Ile
  SITE (268)..(268): Xaa at position 268 is Phe, Tyr, Met, His, Ile, Leu, Val Ala, or Gly
  SITE (270)..(270): Xaa at position 270 is Phe, Tyr, Met, His, Ile, Leu, Val Ala, or Gly
  SITE (271)..(271): Xaa at position 271 is Val, Ala, Gly, Leu, or Ile
  SITE (273)..(273): Xaa at position 273 is Leu, Ala, Val, Gly, or Ile
  SITE (293)..(293): Xaa at position 293 is Leu, Ala, Val, Gly, or Ile
  SITE (296)..(296): Xaa at position 296 is Ile, Ala, Val, Leu, or Gly
  SITE (303)..(303): Xaa at position 303 is Val, Ala, Gly, Leu, or Ile
  SITE (310)..(310): Xaa at position 310 is Leu, Ala, Val, Gly, or Ile
  SITE (325)..(325): Xaa at position 325 is Leu, Ala, Val, Gly, or Ile
  SITE (331)..(331): Xaa at position 331 is Ala, Gly, or Pro
  SITE (332)..(332): Xaa at position 332 is Val, Ala, Gly, Leu, or Ile
  SITE (335)..(335): Xaa at position 335 is Val, Ala, Gly, Leu, or Ile
  SITE (339)..(339): Xaa at position 339 is Met, Ile, Leu, Val, Ala, or Gly
  SITE (343)..(343): Xaa at position 343 is Leu, Ala, Val, Gly, or Ile
  SITE (346)..(346): Xaa at position 346 is Ala, Gly, or Pro
  SITE (349)..(349): Xaa at position 349 is Val, Ala, Gly, Leu, or Ile
  SITE (350)..(350): Xaa at position 350 is Ile, Ala, Val, Leu, or Gly
  SITE (353)..(353): Xaa at position 353 is Leu, Ala, Val, Gly, or Ile
  SITE (360)..(360): Xaa at position 360 is Met, Ile, Leu, Val, Ala, or Gly
  SITE (363)..(363): Xaa at position 363 is Ala, Gly, or Pro
  SITE (368)..(368): Xaa at position 368 is Met, Ile, Leu, Val, Ala, or Gly
  SITE (369)..(369): Xaa at position 369 is Leu, Ala, Val, Gly, or Ile
  SITE (373)..(373): Xaa at position 373 is Leu, Ala, Val, Gly, or Ile
  SITE (374)..(374): Xaa at position 374 is Ala, Gly, or Pro
  SITE (375)..(375): Xaa at position 375 is Tyr, Phe, Met, His, Ile, Leu, Val Ala, or Gly
  SITE (377)..(377): Xaa at position 377 is Leu, Ala, Val, Gly, or Ile
  SITE (387)..(387): Xaa at position 387 is Ala, Gly, or Pro
  SITE (390)..(390): Xaa at position 390 is Ala, Gly, or Pro
  SITE (394)..(394): Xaa at position 394 is Ala, Gly, or Pro
  SITE (398)..(398): Xaa at position 398 is Ala, Gly, or Pro
  SITE (405)..(405): Xaa at position 405 is Leu, Ala, Val, Gly, or Ile
  SITE (413)..(413): Xaa at position 413 is Leu, Ala, Val, Gly, or Ile
  SITE (420)..(420): Xaa at position 420 is Phe, Tyr, Met, His, Ile, Leu, Val Ala, or Gly
  SITE (424)..(424): Xaa at position 424 is Val, Ala, Gly, Leu, or Ile
  SITE (434)..(434): Xaa at position 434 is Val, Ala, Gly, Leu, or Ile
  SITE (444)..(444): Xaa at position 444 is Ala, Gly, or Pro
  SITE (448)..(448): Xaa at position 448 is Val, Ala, Gly, Leu, or Ile
MASESGKLWGGRFVGAVDPIMEKFNASIAYDRHXWEVDXQGSKXXSRGXEKAGLLTKAEMDQXLHGXDKXAEEWAQGTFKLNSNDEDXXTXNERRXKELIGATXGKXHTGRSRNDQVXTDXRLWXRQTXSTXSGLXXEXXRTXXDRXEAERDVLXPGYTHXQRAQPIRXSHWXXSHXVAXTRDSERXLEXRKRXNVXPXGSGAIAGNPLGVDRELXRAEXNXGAITLNSMDXTSERDXXXEXXFXXSLXXTHXSRXXEDXILYCTKEXSXXQXSDAYSTGSSLMPQKKNPDSXELXRSKAGRXFGRCAGXLMTLKGLPSTYNKDXQEDKEXXFEXSDTXSAVXQVXTGXXSTXQIHQENXGQXLSPDXXATDXXXYXVRKGMPFRQXHEXSGKXVFMXETKGVAXNQLSLQEXQTISPLXSGDXICVWDYGHSXEQYGALGGTXRSSXDWQIRQVRALLQAQQA

SEQ ID NO: 185 - protein, 258 aa, Homo sapiens
  SITE (36)..(36): Xaa at position 36 is Tyr, Phe, Met, His, Ile, Leu, Val Ala, or Gly
  SITE (46)..(46): Xaa at position 46 is Ala, Gly, or Pro
  SITE (47)..(47): Xaa at position 47 is Phe, Tyr, Met, His, Ile, Leu, Val Ala, or Gly
  SITE (53)..(53): Xaa at position 53 is Phe, Tyr, Met, His, Ile, Leu, Val Ala, or Gly
  SITE (54)..(54): Xaa at position 54 is Leu, Ala, Val, Gly, or Ile
  SITE (57)..(57): Xaa at position 57 is Tyr, Phe, Met, His, Ile, Leu, Val Ala, or Gly
  SITE (65)..(65): Xaa at position 65 is Ala, Gly, or Pro
  SITE (67)..(67): Xaa at position 67 is Phe, Tyr, Met, His, Ile, Leu, Val Ala, or Gly
  SITE (74)..(74): Xaa at position 74 is Phe, Tyr, Met, His, Ile, Leu, Val Ala, or Gly
  SITE (88)..(88): Xaa at position 88 is Trp, Tyr, Phe, Met, His, Ile, Leu Val, Ala, or Gly
  SITE (95)..(95): Xaa at position 95 is Leu, Ala, Val, Gly, or Ile
  SITE (101)..(101): Xaa at position 101 is Val, Ala, Gly, Leu, or Ile
  SITE (106)..(106): Xaa at position 106 is Cys, Ala, Val, Gly, Ser, or Thr
  SITE (118)..(118): Xaa at position 118 is Leu, Ala, Val, Gly, or Ile
  SITE (126)..(126): Xaa at position 126 is Val, Ala, Gly, Leu, or Ile
  SITE (136)..(136): Xaa at position 136 is Leu, Ala, Val, Gly, or Ile
  SITE (141)..(141): Xaa at position 141 is Leu, Ala, Val, Gly, or Ile
  SITE (142)..(142): Xaa at position 142 is Leu, Ala, Val, Gly, or Ile
  SITE (143)..(143): Xaa at position 143 is Val, Ala, Gly, Leu, or Ile
  SITE (144)..(144): Xaa at position 144 is Cys, Ala, Val, Gly, Ser, or Thr
  SITE (146)..(146): Xaa at position 146 is Val, Ala, Gly, Leu, or Ile
  SITE (149)..(149): Xaa at position 149 is Phe, Tyr, Met, His, Ile, Leu, Val Ala, or Gly
  SITE (158)..(158): Xaa at position 158 is Trp, Tyr, Phe, Met, His, Ile, Leu Val, Ala, or Gly
  SITE (169)..(169): Xaa at position 169 is Val, Ala, Gly, Leu, or Ile
  SITE (186)..(186): Xaa at position 186 is Val, Ala, Gly, Leu, or Ile
  SITE (188)..(188): Xaa at position 188 is Leu, Ala, Val, Gly, or Ile
  SITE (197)..(197): Xaa at position 197 is Val, Ala, Gly, Leu, or Ile
  SITE (198)..(198): Xaa at position 198 is Tyr, Phe, Met, His, Ile, Leu, Val Ala, or Gly
  SITE (200)..(200): Xaa at position 200 is Cys, Ala, Val, Gly, Ser, or Thr
  SITE (202)..(202): Xaa at position 202 is Val, Ala, Gly, Leu, or Ile
MMVLQVSAAPRTVALTALLMVLLTSVVQGRATPENXLFQGRQECYXXNGTQRXXERXIYNREEFXRXDSDVGEXRAVTELGRPAAEYXNSQKDIXEEKRAXPDRMXRHNYELGGPMTXQRRVQPRXNVSPSKKGPXQHHNXXXXHXTDXYPGSIQVRXFLNGQEETAGXVSTNLIRNGDWTFQILXMXEMTPQQGDXXTXQXEHTSLDSPVTVEWKAQSDSARSKTLTGAGGFVLGLIICGVGIFMHRRSKKVQRGSA

SEQ ID NO: 186 - protein, 856 aa, Human immunodeficiency virus 1
  group M subtype B (isolate HXB2) (HIV-1)
  SITE (55)..(55): Xaa at position 55 is Ala, Gly, or Pro
  SITE (65)..(65): Xaa at position 65 is Val, Ala, Gly, Leu, or Ile
  SITE (70)..(70): Xaa at position 70 is Ala, Gly, or Pro
  SITE (95)..(95): Xaa at position 95 is Met, Ile, Leu, Val, Ala, or Gly
  SITE (101)..(101): Xaa at position 101 is Val, Ala, Gly, Leu, or Ile
  SITE (104)..(104): Xaa at position 104 is Met, Ile, Leu, Val, Ala, or Gly
  SITE (108)..(108): Xaa at position 108 is Ile, Ala, Val, Leu, or Gly
  SITE (112)..(112): Xaa at position 112 is Trp, Tyr, Phe, Met, His, Ile, Leu Val, Ala, or Gly
  SITE (120)..(120): Xaa at position 120 is Val, Ala, Gly, Leu, or Ile
  SITE (131)..(131): Xaa at position 131 is Cys, Ala, Val, Gly, Ser, or Thr
  SITE (154)..(154): Xaa at position 154 is Ile, Ala, Val, Leu, or Gly
  SITE (165)..(165): Xaa at position 165 is Ile, Ala, Val, Leu, or Gly
  SITE (193)..(193): Xaa at position 193 is Leu, Ala, Val, Gly, or Ile
  SITE (216)..(216): Xaa at position 216 is His, Phe, Tyr, Lys, Arg, Gly, Ser Thr, Ala, Val, Leu, Ile, Asn, Met, or Gln
  SITE (221)..(221): Xaa at position 221 is Ala, Gly, or Pro
  SITE (224)..(224): Xaa at position 224 is Ala, Gly, or Pro
  SITE (225)..(225): Xaa at position 225 is Ile, Ala, Val, Leu, or Gly
  SITE (235)..(235): Xaa at position 235 is Gly, Ala, or Pro
  SITE (239)..(239): Xaa at position 239 is Cys, Ala, Val, Gly, Ser, or Thr
  SITE (242)..(242): Xaa at position 242 is Val, Ala, Gly, Leu, or Ile
  SITE (251)..(251): Xaa at position 251 is Ile, Ala, Val, Leu, or Gly
  SITE (259)..(259): Xaa at position 259 is Leu, Ala, Val, Gly, or Ile
  SITE (260)..(260): Xaa at position 260 is Leu, Ala, Val, Gly, or Ile
  SITE (270)..(270): Xaa at position 270 is Val, Ala, Gly, Leu, or Ile
  SITE (284)..(284): Xaa at position 284 is Ile, Ala, Val, Leu, or Gly
  SITE (285)..(285): Xaa at position 285 is Ile, Ala, Val, Leu, or Gly
  SITE (286)..(286): Xaa at position 286 is Val, Ala, Gly, Leu, or Ile
  SITE (288)..(288): Xaa at position 288 is Leu, Ala, Val, Gly, or Ile
  SITE (292)..(292): Xaa at position 292 is Val, Ala, Gly, Leu, or Ile
  SITE (294)..(294): Xaa at position 294 is Ile, Ala, Val, Leu, or Gly
  SITE (296)..(296): Xaa at position 296 is Cys, Ala, Val, Gly, Ser, or Thr
  SITE (326)..(326): Xaa at position 326 is Met, Ile, Leu, Val, Ala, or Gly
  SITE (331)..(331): Xaa at position 331 is Cys, Ala, Val, Gly, Ser, or Thr
  SITE (333)..(333): Xaa at position 333 is Ile, Ala, Val, Leu, or Gly
  SITE (338)..(338): Xaa at position 338 is Trp, Tyr, Phe, Met, His, Ile, Leu Val, Ala, or Gly
  SITE (342)..(342): Xaa at position 342 is Leu, Ala, Val, Gly, or Ile
  SITE (345)..(345): Xaa at position 345 is Ile, Ala, Val, Leu, or Gly
  SITE (346)..(346): Xaa at position 346 is Ala, Gly, or Pro
  SITE (349)..(349): Xaa at position 349 is Leu, Ala, Val, Gly, or Ile
  SITE (359)..(359): Xaa at position 359 is Ile, Ala, Val, Leu, or Gly
  SITE (360)..(360): Xaa at position 360 is Ile, Ala, Val, Leu, or Gly
  SITE (361)..(361): Xaa at position 361 is Phe, Tyr, Met, His, Ile, Leu, Val Ala, or Gly
  SITE (374)..(374): Xaa at position 374 is His, Phe, Tyr, Lys, Arg, Gly, Ser Thr, Ala, Val, Leu, Ile, Asn, Met, or Gln
  SITE (376)..(376): Xaa at position 376 is Phe, Tyr, Met, His, Ile, Leu, Val Ala, or Gly
  SITE (378)..(378): Xaa at position 378 is Cys, Ala, Val, Gly, Ser, or Thr
  SITE (383)..(383): Xaa at position 383 is Phe, Tyr, Met, His, Ile, Leu, Val Ala, or Gly
  SITE (385)..(385): Xaa at position 385 is Cys, Ala, Val, Gly, Ser, or Thr
  SITE (390)..(390): Xaa at position 390 is Leu, Ala, Val, Gly, or Ile
  SITE (391)..(391): Xaa at position 391 is Phe, Tyr, Met, His, Ile, Leu, Val Ala, or Gly
  SITE (416)..(416): Xaa at position 416 is Leu, Ala, Val, Gly, or Ile
  SITE (418)..(418): Xaa at position 418 is Cys, Ala, Val, Gly, Ser, or Thr
  SITE (423)..(423): Xaa at position 423 is Ile, Ala, Val, Leu, or Gly
  SITE (424)..(424): Xaa at position 424 is Ile, Ala, Val, Leu, or Gly
  SITE (430)..(430): Xaa at position 430 is Val, Ala, Gly, Leu, or Ile
  SITE (433)..(433): Xaa at position 433 is Ala, Gly, or Pro
  SITE (434)..(434): Xaa at position 434 is Met, Ile, Leu, Val, Ala, or Gly
  SITE (449)..(449): Xaa at position 449 is Ile, Ala, Val, Leu, or Gly
  SITE (452)..(452): Xaa at position 452 is Leu, Ala, Val, Gly, or Ile
  SITE (453)..(453): Xaa at position 453 is Leu, Ala, Val, Gly, or Ile
  SITE (454)..(454): Xaa at position 454 is Leu, Ala, Val, Gly, or Ile
  SITE (467)..(467): Xaa at position 467 is Ile, Ala, Val, Leu, or Gly
  SITE (468)..(468): Xaa at position 468 is Phe, Tyr, Met, His, Ile, Leu, Val Ala, or Gly
  SITE (479)..(479): Xaa at position 479 is Trp, Tyr, Phe, Met, His, Ile, Leu Val, Ala, or Gly
  SITE (483)..(483): Xaa at position 483 is Leu, Ala, Val, Gly, or Ile
  SITE (486)..(486): Xaa at position 486 is Tyr, Phe, Met, His, Ile, Leu, Val Ala, or Gly
  SITE (489)..(489): Xaa at position 489 is Val, Ala, Gly, Leu, or Ile
  SITE (491)..(491): Xaa at position 491 is Ile, Ala, Val, Leu, or Gly
  SITE (505)..(505): Xaa at position 505 is Val, Ala, Gly, Leu, or Ile
  SITE (548)..(548): Xaa at position 548 is Ile, Ala, Val, Leu, or Gly
  SITE (549)..(549): Xaa at position 549 is Val, Ala, Gly, Leu, or Ile
  SITE (555)..(555): Xaa at position 555 is Leu, Ala, Val, Gly, or Ile
  SITE (556)..(556): Xaa at position 556 is Leu, Ala, Val, Gly, or Ile
  SITE (558)..(558): Xaa at position 558 is Ala, Gly, or Pro
  SITE (559)..(559): Xaa at position 559 is Ile, Ala, Val, Leu, or Gly
  SITE (561)..(561): Xaa at position 561 is Ala, Gly, or Pro
  SITE (565)..(565): Xaa at position 565 is Leu, Ala, Val, Gly, or Ile
  SITE (566)..(566): Xaa at position 566 is Leu, Ala, Val, Gly, or Ile
  SITE (570)..(570): Xaa at position 570 is Val, Ala, Gly, Leu, or Ile
  SITE (573)..(573): Xaa at position 573 is Ile, Ala, Val, Leu, or Gly
  SITE (576)..(576): Xaa at position 576 is Leu, Ala, Val, Gly, or Ile
  SITE (580)..(580): Xaa at position 580 is Ile, Ala, Val, Leu, or Gly
  SITE (602)..(602): Xaa at position 602 is Leu, Ala, Val, Gly, or Ile
  SITE (607)..(607): Xaa at position 607 is Ala, Gly, or Pro
  SITE (635)..(635): Xaa at position 635 is Ile, Ala, Val, Leu, or Gly
  SITE (642)..(642): Xaa at position 642 is Ile, Ala, Val, Leu, or Gly
  SITE (666)..(666): Xaa at position 666 is Trp, Tyr, Phe, Met, His, Ile, Leu Val, Ala, or Gly
  SITE (680)..(680): Xaa at position 680 is Trp, Tyr, Phe, Met, His, Ile, Leu Val, Ala, or Gly
  SITE (687)..(687): Xaa at position 687 is Met, Ile, Leu, Val, Ala, or Gly
  SITE (688)..(688): Xaa at position 688 is Ile, Ala, Val, Leu, or Gly
  SITE (698)..(698): Xaa at position 698 is Val, Ala, Gly, Leu, or Ile
MRVKEKYQHLWRWGWRWGTMLLGMLMICSATEKLWVTVYYGVPVWKEATTTLFCXSDAKAYDTEXHNVWXTHACVPTDPNPQEVVLVNVTENFNXWKNDMXEQXHEDXISLXDQSLKPCXKLTPLCVSLKXTDLKNDTNTNSSSGRMIMEKGEXKNCSFNISTSXRGKVQKEYAFFYKLDIIPIDNDTTSYKXTSCNTSVITQACPKVSFEPIPIXYCAPXGFXXLKCNNKTFNXTGPXTNXSTVQCTHGXRPVVSTQXXLNGSLAEEEXVIRSVNFTDNAKTXXXQXNTSXEXNXTRPNNNTRKRIRIQRGPGRAFVTIGKIGNXRQAHXNXSRAKXNNTXKQXXSKXREQFGNNKTXXXKQSSGGDPEIVTXSXNXGGEFXYXNSTQXXNSTWFNSTWSTEGSNNTEGSDTITXPXRIKQXXNMWQKXGKXXYAPPISGQIRCSSNXTGXXXTRDGGNSNNESEXXRPGGGDMRDNXRSEXYKXKVXKXEPLGVAPTKAKRRXVQREKRAVGIGALFLGFLGAAGSTMGAASMTLTVQARQLLSGXXQQQNNXXRXXEXQQHXXQLTXWGXKQXQARXLAVERYLKDQQLLGIWGCSGKXICTTXVPWNASWSNKSLEQIWNHTTWMEWDREXNNYTSLXHSLIEESQNQQEKNEQELLELDKXASLWNWFNITNWLXYIKLFIXXVGGLVGLRIXFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 187 - protein, 1255 aa, Homo sapiens
  SITE (42)..(42): Xaa at position 42 is His, Phe, Tyr, Lys, Arg, Gly, Ser Thr, Ala, Val, Leu, Ile, Asn, Met, or Gln
  SITE (45)..(45): Xaa at position 45 is Met, Ile, Leu, Val, Ala, or Gly
  SITE (46)..(46): Xaa at position 46 is Leu, Ala, Val, Gly, or Ile
  SITE (50)..(50): Xaa at position 50 is Tyr, Phe, Met, His, Ile, Leu, Val Ala, or Gly
  SITE (53)..(53): Xaa at position 53 is Cys, Ala, Val, Gly, Ser, or Thr
  SITE (56)..(56): Xaa at position 56 is Val, Ala, Gly, Leu, or Ile
  SITE (60)..(60): Xaa at position 60 is Leu, Ala, Val, Gly, or Ile
  SITE (62)..(62): Xaa at position 62 is Leu, Ala, Val, Gly, or Ile
  SITE (65)..(65): Xaa at position 65 is Leu, Ala, Val, Gly, or Ile
  SITE (73)..(73): Xaa at position 73 is Phe, Tyr, Met, His, Ile, Leu, Val Ala, or Gly
  SITE (74)..(74): Xaa at position 74 is Leu, Ala, Val, Gly, or Ile
  SITE (77)..(77): Xaa at position 77 is Ile, Ala, Val, Leu, or Gly
  SITE (80)..(80): Xaa at position 80 is Val, Ala, Gly, Leu, or Ile
  SITE (83)..(83): Xaa at position 83 is Tyr, Phe, Met, His, Ile, Leu, Val Ala, or Gly
  SITE (84)..(84): Xaa at position 84 is Val, Ala, Gly, Leu, or Ile
  SITE (85)..(85): Xaa at position 85 is Leu, Ala, Val, Gly, or Ile
  SITE (86)..(86): Xaa at position 86 is Ile, Ala, Val, Leu, or Gly
  SITE (87)..(87): Xaa at position 87 is Ala, Gly, or Pro
  SITE (91)..(91): Xaa at position 91 is Val, Ala, Gly, Leu, or Ile
  SITE (94)..(94): Xaa at position 94 is Val, Ala, Gly, Leu, or Ile
  SITE (96)..(96): Xaa at position 96 is Leu, Ala, Val, Gly, or Ile
  SITE (99)..(99): Xaa at position 99 is Leu, Ala, Val, Gly, or Ile
  SITE (101)..(101): Xaa at position 101 is Ile, Ala, Val, Leu, or Gly
  SITE (102)..(102): Xaa at position 102 is Val, Ala, Gly, Leu, or Ile
  SITE (113)..(113): Xaa at position 113 is Ala, Gly, or Pro
  SITE (114)..(114): Xaa at position 114 is Leu, Ala, Val, Gly, or Ile
  SITE (115)..(115): Xaa at position 115 is Ala, Gly, or Pro
  SITE (116)..(116): Xaa at position 116 is Val, Ala, Gly, Leu, or Ile
  SITE (137)..(137): Xaa at position 137 is Leu, Ala, Val, Gly, or Ile
  SITE (140)..(140): Xaa at position 140 is Leu, Ala, Val, Gly, or Ile
  SITE (142)..(142): Xaa at position 142 is Leu, Ala, Val, Gly, or Ile
  SITE (145)..(145): Xaa at position 145 is Leu, Ala, Val, Gly, or Ile
  SITE (148)..(148): Xaa at position 148 is Ile, Ala, Val, Leu, or Gly
  SITE (153)..(153): Xaa at position 153 is Val, Ala, Gly, Leu, or Ile
  SITE (155)..(155): Xaa at position 155 is Ile, Ala, Val, Leu, or Gly
  SITE (161)..(161): Xaa at position 161 is Leu, Ala, Val, Gly, or Ile
  SITE (162)..(162): Xaa at position 162 is Cys, Ala, Val, Gly, Ser, or Thr
  SITE (163)..(163): Xaa at position 163 is Tyr, Phe, Met, His, Ile, Leu, Val Ala, or Gly
  SITE (172)..(172): Xaa at position 172 is Ile, Ala, Val, Leu, or Gly
  SITE (173)..(173): Xaa at position 173 is Phe, Tyr, Met, His, Ile, Leu, Val Ala, or Gly
  SITE (204)..(204): Xaa at position 204 is Cys, Ala, Val, Gly, Ser, or Thr
  SITE (205)..(205): Xaa at position 205 is Trp, Tyr, Phe, Met, His, Ile, Leu Val, Ala, or Gly
  SITE (227)..(227): Xaa at position 227 is Cys, Ala, Val, Gly, Ser, or Thr
  SITE (240)..(240): Xaa at position 240 is Cys, Ala, Val, Gly, Ser, or Thr
  SITE (241)..(241): Xaa at position 241 is Ala, Gly, or Pro
  SITE (242)..(242): Xaa at position 242 is Ala, Gly, or Pro
  SITE (304)..(304): Xaa at position 304 is Leu, Ala, Val, Gly, or Ile
  SITE (331)..(331): Xaa at position 331 is Cys, Ala, Val, Gly, Ser, or Thr
  SITE (345)..(345): Xaa at position 345 is Leu, Ala, Val, Gly, or Ile
  SITE (355)..(355): Xaa at position 355 is Ala, Gly, or Pro
  SITE (356)..(356): Xaa at position 356 is Val, Ala, Gly, Leu, or Ile
  SITE (361)..(361): Xaa at position 361 is Ile, Ala, Val, Leu, or Gly
  SITE (364)..(364): Xaa at position 364 is Phe, Tyr, Met, His, Ile, Leu, Val Ala, or Gly
  SITE (367)..(367): Xaa at position 367 is Cys, Ala, Val, Gly, Ser, or Thr
  SITE (370)..(370): Xaa at position 370 is Ile, Ala, Val, Leu, or Gly
  SITE (374)..(374): Xaa at position 374 is Leu, Ala, Val, Gly, or Ile
  SITE (375)..(375): Xaa at position 375 is Ala, Gly, or Pro
  SITE (376)..(376): Xaa at position 376 is Phe, Tyr, Met, His, Ile, Leu, Val Ala, or Gly
  SITE (397)..(397): Xaa at position 397 is Leu, Ala, Val, Gly, or Ile
  SITE (400)..(400): Xaa at position 400 is Phe, Tyr, Met, His, Ile, Leu, Val Ala, or Gly
  SITE (403)..(403): Xaa at position 403 is Leu, Ala, Val, Gly, or Ile
  SITE (406)..(406): Xaa at position 406 is Ile, Ala, Val, Leu, or Gly
  SITE (410)..(410): Xaa at position 410 is Leu, Ala, Val, Gly, or Ile
  SITE (412)..(412): Xaa at position 412 is Ile, Ala, Val, Leu, or Gly
  SITE (422)..(422): Xaa at position 422 is Leu, Ala, Val, Gly, or Ile
  SITE (425)..(425): Xaa at position 425 is Phe, Tyr, Met, His, Ile, Leu, Val Ala, or Gly
  SITE (428)..(428): Xaa at position 428 is Leu, Ala, Val, Gly, or Ile
  SITE (430)..(430): Xaa at position 430 is Val, Ala, Gly, Leu, or Ile
  SITE (431)..(431): Xaa at position 431 is Ile, Ala, Val, Leu, or Gly
  SITE (440)..(440): Xaa at position 440 is Ala, Gly, or Pro
  SITE (443)..(443): Xaa at position 443 is Leu, Ala, Val, Gly, or Ile
  SITE (445)..(445): Xaa at position 445 is Leu, Ala, Val, Gly, or Ile
  SITE (448)..(448): Xaa at position 448 is Leu, Ala, Val, Gly, or Ile
  SITE (450)..(450): Xaa at position 450 is Ile, Ala, Val, Leu, or Gly
  SITE (453)..(453): Xaa at position 453 is Leu, Ala, Val, Gly, or Ile
  SITE (455)..(455): Xaa at position 455 is Leu, Ala, Val, Gly, or Ile
  SITE (461)..(461): Xaa at position 461 is Leu, Ala, Val, Gly, or Ile
  SITE (465)..(465): Xaa at position 465 is Leu, Ala, Val, Gly, or Ile
  SITE (466)..(466): Xaa at position 466 is Ala, Gly, or Pro
  SITE (467)..(467): Xaa at position 467 is Leu, Ala, Val, Gly, or Ile
  SITE (468)..(468): Xaa at position 468 is Ile, Ala, Val, Leu, or Gly
  SITE (469)..(469): Xaa at position 469 is His, Phe, Tyr, Lys, Arg, Gly, Ser Thr, Ala, Val, Leu, Ile, Asn, Met, or Gln
  SITE (474)..(474): Xaa at position 474 is Leu, Ala, Val, Gly, or Ile
  SITE (475)..(475): Xaa at position 475 is Cys, Ala, Val, Gly, Ser, or Thr
  SITE (476)..(476): Xaa at position 476 is Phe, Tyr, Met, His, Ile, Leu, Val Ala, or Gly
  SITE (477)..(477): Xaa at position 477 is Val, Ala, Gly, Leu, or Ile
  SITE (494)..(494): Xaa at position 494 is Leu, Ala, Val, Gly, or Ile
  SITE (504)..(504): Xaa at position 504 is Cys, Ala, Val, Gly, Ser, or Thr
  SITE (520)..(520): Xaa at position 520 is Cys, Ala, Val, Gly, Ser, or Thr
  SITE (521)..(521): Xaa at position 521 is Trp, Tyr, Phe, Met, His, Ile, Leu Val, Ala, or Gly
  SITE (540)..(540): Xaa at position 540 is Cys, Ala, Val, Gly, Ser, or Thr
  SITE (576)..(576): Xaa at position 576 is Cys, Ala, Val, Gly, Ser, or Thr
MELAALCRWGLLLALLPPGAASTQVCTGTDMKLRLPASPETXLDXXRHLXQGXQVXQGNXEXTYXPTNASLSXXQDXQEXQGXXXXXHNQXRQXPXQRXRXXRGTQLFEDNYXXXXLDNGDPLNNTTPVTGASPGGXREXQXRSXTEXLKGGXLXQRNPQXXXQDTILWKDXXHKNNQLALTLIDTNRSRACHPCSPMCKGSRXXGESSEDCQSLTRTVCAGGCARXKGPLPTDCCHEQXXXGCTGPKHSDCLACLHFNHSGICELHCPALVTYNTDTFESMPNPEGRYTFGASCVTACPYNYXSTDVGSCTLVCPLHNQEVTAEDGTQRXEKCSKPCARVCYGXGMEHLREVRXXTSANXQEXAGXKKXFGSXXXLPESFDGDPASNTAPLQPEQXQVXETXEEXTGYXYXSAWPDSLPDXSVXQNXQXXRGRILHNGXYSXTXQGXGXSWXGXRSLREXGSGXXXXXHNTHXXXXHTVPWDQLFRNPHQALXHTANRPEDEXVGEGLACHQLCARGHXXGPGPTQCVNCSQFLRGQEXVEECRVLQGLPREYVNARHCLPCHPECQPQNGSVTXFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 188 - protein, 796 aa, Homo sapiens
  SITE (103)..(103): Xaa at position 103 is Leu, Ala, Val, Gly, or Ile
  SITE (110)..(110): Xaa at position 110 is Ala, Gly, or Pro
  SITE (117)..(117): Xaa at position 117 is Leu, Ala, Val, Gly, or Ile
  SITE (122)..(122): Xaa at position 122 is Leu, Ala, Val, Gly, or Ile
  SITE (138)..(138): Xaa at position 138 is Leu, Ala, Val, Gly, or Ile
  SITE (215)..(215): Xaa at position 215 is Cys, Ala, Val, Gly, Ser, or Thr
  SITE (249)..(249): Xaa at position 249 is Leu, Ala, Val, Gly, or Ile
  SITE (251)..(251): Xaa at position 251 is Leu, Ala, Val, Gly, or Ile
  SITE (254)..(254): Xaa at position 254 is Val, Ala, Gly, Leu, or Ile
  SITE (258)..(258): Xaa at position 258 is Leu, Ala, Val, Gly, or Ile
  SITE (265)..(265): Xaa at position 265 is Cys, Ala, Val, Gly, Ser, or Thr
  SITE (267)..(267): Xaa at position 267 is Ala, Gly, or Pro
  SITE (282)..(282): Xaa at position 282 is Val, Ala, Gly, Leu, or Ile
  SITE (300)..(300): Xaa at position 300 is Cys, Ala, Val, Gly, Ser, or Thr
  SITE (301)..(301): Xaa at position 301 is Ile, Ala, Val, Leu, or Gly
  SITE (346)..(346): Xaa at position 346 is Leu, Ala, Val, Gly, or Ile
  SITE (348)..(348): Xaa at position 348 is Leu, Ala, Val, Gly, or Ile
  SITE (361)..(361): Xaa at position 361 is Leu, Ala, Val, Gly, or Ile
  SITE (363)..(363): Xaa at position 363 is Ala, Gly, or Pro
  SITE (376)..(376): Xaa at position 376 is Ala, Gly, or Pro
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGXRFVAPDXFHFTPRXSRLNXSFNALESLSWKTVQGXSLQELVLSGNPLHCSCALRWLQRWEEEGLGGVPEQKLQCHGQGPLAHMPNASCGVPTLKVQVPNASVDVGDDVLLRXQVEGRGLEQAGWILTELEQSATVMKSGGLPSLGXTXANXTSDXNRKNVTXWXENDVGRAEVSVQVNXSFPASVQLHTAVEMHHWXXPFSVDGQPAPSLRWLFNGSVLNETSFIFTEFLEPAANETVRHGCXRXNQPTHVNNGNYTXLXANPFGQASASIMXAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 189 - protein, 565 aa, Influenza A virus
  strain A/Duck/England/1/1956 H11N6
  SITE (19)..(19): Xaa at position 19 is Ile, Ala, Val, Leu, or Gly
  SITE (20)..(20): Xaa at position 20 is Cys, Ala, Val, Gly, Ser, or Thr
  SITE (21)..(21): Xaa at position 21 is Ile, Ala, Val, Leu, or Gly
  SITE (32)..(32): Xaa at position 32 is Val, Ala, Gly, Leu, or Ile
  SITE (42)..(42): Xaa at position 42 is Val, Ala, Gly, Leu, or Ile
  SITE (49)..(49): Xaa at position 49 is Val, Ala, Gly, Leu, or Ile
  SITE (57)..(57): Xaa at position 57 is Phe, Tyr, Met, His, Ile, Leu, Val Ala, or Gly
  SITE (58)..(58): Xaa at position 58 is Cys, Ala, Val, Gly, Ser, or Thr
  SITE (60)..(60): Xaa at position 60 is Ile, Ala, Val, Leu, or Gly
  SITE (66)..(66): Xaa at position 66 is Ile, Ala, Val, Leu, or Gly
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (73)..(73): Xaa at position 73 is Phe, Tyr, Met, His, Ile, Leu, Val Ala, or Gly
  SITE (74)..(74): Xaa at position 74 is Ala, Gly, or Pro
  SITE (76)..(76): Xaa at position 76 is Trp, Tyr, Phe, Met, His, Ile, Leu Val, Ala, or Gly
  SITE (77)..(77): Xaa at position 77 is Ile, Ala, Val, Leu, or Gly
  SITE (78)..(78): Xaa at position 78 is Leu, Ala, Val, Gly, or Ile
  SITE (83)..(83): Xaa at position 83 is Cys, Ala, Val, Gly, Ser, or Thr
  SITE (86)..(86): Xaa at position 86 is Leu, Ala, Val, Gly, or Ile
  SITE (92)..(92): Xaa at position 92 is Trp, Tyr, Phe, Met, His, Ile, Leu Val, Ala, or Gly
  SITE (94)..(94): Xaa at position 94 is Tyr, Phe, Met, His, Ile, Leu, Val Ala, or Gly
  SITE (95)..(95): Xaa at position 95 is Ile, Ala, Val, Leu, or Gly
  SITE (96)..(96): Xaa at position 96 is Val, Ala, Gly, Leu, or Ile
  SITE (107)..(107): Xaa at position 107 is Tyr, Phe, Met, His, Ile, Leu, Val Ala, or Gly
  SITE (117)..(117): Xaa at position 117 is Leu, Ala, Val, Gly, or Ile
  SITE (121)..(121): Xaa at position 121 is Phe, Tyr, Met, His, Ile, Leu, Val Ala, or Gly
  SITE (124)..(124): Xaa at position 124 is Val, Ala, Gly, Leu, or Ile
  SITE (127)..(127): Xaa at position 127 is Phe, Tyr, Met, His, Ile, Leu, Val Ala, or Gly
  SITE (133)..(133): Xaa at position 133 is Phe, Tyr, Met, His, Ile, Leu, Val Ala, or Gly
  SITE (149)..(149): Xaa at position 149 is Ala, Gly, or Pro
  SITE (151)..(151): Xaa at position 151 is Cys, Ala, Val, Gly, Ser, or Thr
  SITE (153)..(153): Xaa at position 153 is Phe, Tyr, Met, His, Ile, Leu, Val Ala, or Gly
  SITE (163)..(163): Xaa at position 163 is Met, Ile, Leu, Val, Ala, or Gly
  SITE (164)..(164): Xaa at position 164 is Val, Ala, Gly, Leu, or Ile
  SITE (166)..(166): Xaa at position 166 is Leu, Ala, Val, Gly, or Ile
  SITE (176)..(176): Xaa at position 176 is Ile, Ala, Val, Leu, or Gly
  SITE (188)..(188): Xaa at position 188 is Val, Ala, Gly, Leu, or Ile
  SITE (189)..(189): Xaa at position 189 is Leu, Ala, Val, Gly, or Ile
  SITE (190)..(190): Xaa at position 190 is Ile, Ala, Val, Leu, or Gly
  SITE (191)..(191): Xaa at position 191 is Val, Ala, Gly, Leu, or Ile
  SITE (192)..(192): Xaa at position 192 is Trp, Tyr, Phe, Met, His, Ile, Leu Val, Ala, or Gly
  SITE (194)..(194): Xaa at position 194 is Ile, Ala, Val, Leu, or Gly
  SITE (195)..(195): Xaa at position 195 is His, Phe, Tyr, Lys, Arg, Gly, Ser Thr, Ala, Val, Leu, Ile, Asn, Met, or Gln
  SITE (196)..(196): Xaa at position 196 is His, Phe, Tyr, Lys, Arg, Gly, Ser Thr, Ala, Val, Leu, Ile, Asn, Met, or Gln
  SITE (207)..(207): Xaa at position 207 is Tyr, Phe, Met, His, Ile, Leu, Val Ala, or Gly
  SITE (214)..(214): Xaa at position 214 is Val, Ala, Gly, Leu, or Ile
  SITE (216)..(216): Xaa at position 216 is Val, Ala, Gly, Leu, or Ile
  SITE (221)..(221): Xaa at position 221 is Tyr, Phe, Met, His, Ile, Leu, Val Ala, or Gly
  SITE (242)..(242): Xaa at position 242 is Met, Ile, Leu, Val, Ala, or Gly
  SITE (244)..(244): Xaa at position 244 is Phe, Tyr, Met, His, Ile, Leu, Val Ala, or Gly
  SITE (245)..(245): Xaa at position 245 is Tyr, Phe, Met, His, Ile, Leu, Val Ala, or Gly
  SITE (248)..(248): Xaa at position 248 is Ile, Ala, Val, Leu, or Gly
  SITE (249)..(249): Xaa at position 249 is Val, Ala, Gly, Leu, or Ile
  SITE (255)..(255): Xaa at position 255 is Ile, Ala, Val, Leu, or Gly
  SITE (257)..(257): Xaa at position 257 is Phe, Tyr, Met, His, Ile, Leu, Val Ala, or Gly
  SITE (263)..(263): Xaa at position 263 is Phe, Tyr, Met, His, Ile, Leu, Val Ala, or Gly
  SITE (264)..(264): Xaa at position 264 is Leu, Ala, Val, Gly, or Ile
  SITE (265)..(265): Xaa at position 265 is Ala, Gly, or Pro
  SITE (268)..(268): Xaa at position 268 is Tyr, Phe, Met, His, Ile, Leu, Val Ala, or Gly
  SITE (269)..(269): Xaa at position 269 is Ala, Gly, or Pro
  SITE (270)..(270): Xaa at position 270 is Phe, Tyr, Met, His, Ile, Leu, Val Ala, or Gly
  SITE (272)..(272): Xaa at position 272 is Ile, Ala, Val, Leu, or Gly
  SITE (280)..(280): Xaa at position 280 is Leu, Ala, Val, Gly, or Ile
  SITE (294)..(294): Xaa at position 294 is Cys, Ala, Val, Gly, Ser, or Thr
  SITE (308)..(308): Xaa at position 308 is His, Phe, Tyr, Lys, Arg, Gly, Ser Thr, Ala, Val, Leu, Ile, Asn, Met, or Gln
  SITE (311)..(311): Xaa at position 311 is His, Phe, Tyr, Lys, Arg, Gly, Ser Thr, Ala, Val, Leu, Ile, Asn, Met, or Gln
  SITE (315)..(315): Xaa at position 315 is Ile, Ala, Val, Leu, or Gly
  SITE (327)..(327): Xaa at position 327 is Leu, Ala, Val, Gly, or Ile
  SITE (347)..(347): Xaa at position 347 is Ala, Gly, or Pro
  SITE (364)..(364): Xaa at position 364 is Tyr, Phe, Met, His, Ile, Leu, Val Ala, or Gly
  SITE (386)..(386): Xaa at position 386 is Ala, Gly, or Pro
  SITE (460)..(460): Xaa at position 460 is Leu, Ala, Val, Gly, or Ile
  SITE (468)..(468): Xaa at position 468 is Leu, Ala, Val, Gly, or Ile
  SITE (484)..(484): Xaa at position 484 is His, Phe, Tyr, Lys, Arg, Gly, Ser Thr, Ala, Val, Leu, Ile, Asn, Met, or Gln
  SITE (486)..(486): Xaa at position 486 is Cys, Ala, Val, Gly, Ser, or Thr
  SITE (490)..(490): Xaa at position 490 is Cys, Ala, Val, Gly, Ser, or Thr
MEKTLLFAAIFLCVKADEXXXGYLSNNSTDKXDTIIENNVTXTSSVELXETEHTGSXXSXNGKQPXSXGDXSXXGXXXGNPMXDEXIGKTSXSXXXEKPNPTNGICXPGTLESEEEXRLKXSGXLEXNKFEVXTSNGWGAVNSGVGVTXAXKXGGSNSFFRNXXWXIHQSGTYPVXKRTFNNTKGRDXXXXXGXXXPATLTEHQDLXKKDSSYXAXGSETXNRRFTPEINTRPRVNGQAGRXTXXWKXXKPGESXTXESNGAXXXPRXXXEXVSVGNGKXFRSELNIESCSTKXQTEIGGINTNKSFXNVXRNTXGDCPKYVNVKSXKLATGPRNVPAIASRGLFGXIAGFIEGGWPGLINGWXGFQHRNEEGTGIAADKESTQKXIDQITSKVNNIVDRMNTNFESVQHEFSEIEERINQLSKHVDDSVVDIWSYNAQLLVLLENEKTLDLHDSNVRNXHEKVRRMXKDNAKDEGNGCFTFYXKXDNKXIERVRNGTYDHKEFEEESKINRQEIEGVKLDSSGNVYKILSIYSCIASSLVLAALIMGFMFWACSNGSCRCTICI

SEQ ID NO: 190 - protein, 205 aa, Homo sapiens
  SITE (6)..(6): Xaa at position 6 is Val, Ala, Gly, Leu, or Ile
  SITE (8)..(8): Xaa at position 8 is Phe, Tyr, Met, His, Ile, Leu, Val Ala, or Gly
  SITE (10)..(10): Xaa at position 10 is Leu, Ala, Val, Gly, or Ile
  SITE (97)..(97): Xaa at position 97 is Val, Ala, Gly, Leu, or Ile
  SITE (99)..(99): Xaa at position 99 is Leu, Ala, Val, Gly, or Ile
  SITE (101)..(101): Xaa at position 101 is Val, Ala, Gly, Leu, or Ile
  SITE (105)..(105): Xaa at position 105 is Ala, Gly, or Pro
  SITE (118)..(118): Xaa at position 118 is Val, Ala, Gly, Leu, or Ile
  SITE (120)..(120): Xaa at position 120 is Ile, Ala, Val, Leu, or Gly
  SITE (148)..(148): Xaa at position 148 is Val, Ala, Gly, Leu, or Ile
  SITE (163)..(163): Xaa at position 163 is Leu, Ala, Val, Gly, or Ile
  SITE (165)..(165): Xaa at position 165 is Val, Ala, Gly, Leu, or Ile
  SITE (167)..(167): Xaa at position 167 is Ala, Gly, or Pro
MTERRXPXSXLRGPSWDPFRDWYPHSRLFDQAFGLPRLPEEWSQWLGGSSWPGYVRPLPPAAIESPAVAAPAYSRALSRQLSSGVSEIRHTADRWRXSXDXNHFXPDELTVKTKDGVXEXTGKHEERQDEHGYISRCFTRKYTLPPGXDPTQVSSSLSPEGTXTXEXPMPKLATQSNEITIPVTFESRAQLGGPEAAKSDETAAK

SEQ ID NO: 191 - protein, 570 aa, Homo sapiens
  SITE (394)..(394): Xaa at position 394 is Ala, Gly, or Pro
  SITE (398)..(398): Xaa at position 398 is Val, Ala, Gly, Leu, or Ile
  SITE (404)..(404): Xaa at position 404 is Val, Ala, Gly, Leu, or Ile
  SITE (405)..(405): Xaa at position 405 is Met, Ile, Leu, Val, Ala, or Gly
  SITE (406)..(406): Xaa at position 406 is Leu, Ala, Val, Gly, or Ile
  SITE (407)..(407): Xaa at position 407 is Val, Ala, Gly, Leu, or Ile
  SITE (413)..(413): Xaa at position 413 is Val, Ala, Gly, Leu, or Ile
  SITE (416)..(416): Xaa at position 416 is Phe, Tyr, Met, His, Ile, Leu, Val Ala, or Gly
  SITE (419)..(419): Xaa at position 419 is Ile, Ala, Val, Leu, or Gly
  SITE (423)..(423): Xaa at position 423 is Val, Ala, Gly, Leu, or Ile
  SITE (436)..(436): Xaa at position 436 is Leu, Ala, Val, Gly, or Ile
  SITE (441)..(441): Xaa at position 441 is Phe, Tyr, Met, His, Ile, Leu, Val Ala, or Gly
  SITE (442)..(442): Xaa at position 442 is Tyr, Phe, Met, His, Ile, Leu, Val Ala, or Gly
  SITE (454)..(454): Xaa at position 454 is Phe, Tyr, Met, His, Ile, Leu, Val Ala, or Gly
  SITE (458)..(458): Xaa at position 458 is Leu, Ala, Val, Gly, or Ile
  SITE (473)..(473): Xaa at position 473 is Phe, Tyr, Met, His, Ile, Leu, Val Ala, or Gly
  SITE (520)..(520): Xaa at position 520 is Phe, Tyr, Met, His, Ile, Leu, Val Ala, or Gly
  SITE (532)..(532): Xaa at position 532 is Ile, Ala, Val, Leu, or Gly
  SITE (534)..(534): Xaa at position 534 is Val, Ala, Gly, Leu, or Ile
  SITE (535)..(535): Xaa at position 535 is Phe, Tyr, Met, His, Ile, Leu, Val Ala, or Gly
  SITE (546)..(546): Xaa at position 546 is Leu, Ala, Val, Gly, or Ile
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTXSEDXFSYEVXXXXGAGIGXTPXASXLKSXWYKYCNNATNLKXKKIYXXWLCRDTHAFEWXADLXQLLESQMQERNNAGXLSYNIYLTGWDESQANHFAVHHDEEKDVITGLKQKTLYGRPNWDNEXKTIASQHPNTRXGXXLCGPEALAETXSKQSISNSESGPRGVHFIFNKENF

SEQ ID NO: 192 - protein, 195 aa, Homo sapiens
  SITE (58)..(58): Xaa at position 58 is Leu, Ala, Val, Gly, or Ile
  SITE (61)..(61): Xaa at position 61 is Ala, Gly, or Pro
  SITE (62)..(62): Xaa at position 62 is Leu, Ala, Val, Gly, or Ile
  SITE (73)..(73): Xaa at position 73 is Phe, Tyr, Met, His, Ile, Leu, Val Ala, or Gly
  SITE (91)..(91): Xaa at position 91 is Ile, Ala, Val, Leu, or Gly
  SITE (95)..(95): Xaa at position 95 is Cys, Ala, Val, Gly, Ser, or Thr
  SITE (100)..(100): Xaa at position 100 is Cys, Ala, Val, Gly, Ser, or Thr
  SITE (105)..(105): Xaa at position 105 is Leu, Ala, Val, Gly, or Ile
  SITE (108)..(108): Xaa at position 108 is Tyr, Phe, Met, His, Ile, Leu, Val Ala, or Gly
  SITE (109)..(109): Xaa at position 109 is Cys, Ala, Val, Gly, Ser, or Thr
  SITE (110)..(110): Xaa at position 110 is Ala, Gly, or Pro
MGKISSLPTQLFKCCFCDFLKVKMHTMSSSHLFYLALCLLTFTSSATAGPETLCGAEXVDXXQFVCGDRGFYXNKPTGYGSSSRRAPQTGXVDEXCFRSXDLRRXEMXXXPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 193 - protein, 364 aa, Homo sapiens
  SITE (16)..(16): Xaa at position 16 is Leu, Ala, Val, Gly, or Ile
  SITE (19)..(19): Xaa at position 19 is Ile, Ala, Val, Leu, or Gly
  SITE (20)..(20): Xaa at position 20 is Ala, Gly, or Pro
  SITE (23)..(23): Xaa at position 23 is Ile, Ala, Val, Leu, or Gly
  SITE (24)..(24): Xaa at position 24 is Val, Ala, Gly, Leu, or Ile
  SITE (30)..(30): Xaa at position 30 is Ile, Ala, Val, Leu, or Gly
  SITE (31)..(31): Xaa at position 31 is Leu, Ala, Val, Gly, or Ile
  SITE (32)..(32): Xaa at position 32 is Ala, Gly, or Pro
  SITE (33)..(33): Xaa at position 33 is Ala, Gly, or Pro
  SITE (40)..(40): Xaa at position 40 is Met, Ile, Leu, Val, Ala, or Gly
  SITE (44)..(44): Xaa at position 44 is Leu, Ala, Val, Gly, or Ile
  SITE (59)..(59): Xaa at position 59 is Phe, Tyr, Met, His, Ile, Leu, Val Ala, or Gly
  SITE (62)..(62): Xaa at position 62 is Ile, Ala, Val, Leu, or Gly
  SITE (63)..(63): Xaa at position 63 is Leu, Ala, Val, Gly, or Ile
  SITE (64)..(64): Xaa at position 64 is Phe, Tyr, Met, His, Ile, Leu, Val Ala, or Gly
  SITE (66)..(66): Xaa at position 66 is Val, Ala, Gly, Leu, or Ile
  SITE (70)..(70): Xaa at position 70 is Ile, Ala, Val, Leu, or Gly
  SITE (74)..(74): Xaa at position 74 is Ile, Ala, Val, Leu, or Gly
  SITE (77)..(77): Xaa at position 77 is Val, Ala, Gly, Leu, or Ile
  SITE (78)..(78): Xaa at position 78 is Ile, Ala, Val, Leu, or Gly
  SITE (79)..(79): Xaa at position 79 is Leu, Ala, Val, Gly, or Ile
  SITE (84)..(84): Xaa at position 84 is Leu, Ala, Val, Gly, or Ile
  SITE (94)..(94): Xaa at position 94 is Phe, Tyr, Met, His, Ile, Leu, Val Ala, or Gly
  SITE (97)..(97): Xaa at position 97 is Ile, Ala, Val, Leu, or Gly
  SITE (98)..(98): Xaa at position 98 is Leu, Ala, Val, Gly, or Ile
  SITE (104)..(104): Xaa at position 104 is Val, Ala, Gly, Leu, or Ile
  SITE (105)..(105): Xaa at position 105 is Val, Ala, Gly, Leu, or Ile
  SITE (107)..(107): Xaa at position 107 is Ile, Ala, Val, Leu, or Gly
  SITE (109)..(109): Xaa at position 109 is Leu, Ala, Val, Gly, or Ile
  SITE (131)..(131): Xaa at position 131 is Leu, Ala, Val, Gly, or Ile
  SITE (135)..(135): Xaa at position 135 is Cys, Ala, Val, Gly, Ser, or Thr
  SITE (138)..(138): Xaa at position 138 is Tyr, Phe, Met, His, Ile, Leu, Val Ala, or Gly
  SITE (143)..(143): Xaa at position 143 is Val, Ala, Gly, Leu, or Ile
  SITE (145)..(145): Xaa at position 145 is Phe, Tyr, Met, His, Ile, Leu, Val Ala, or Gly
  SITE (148)..(148): Xaa at position 148 is Trp, Tyr, Phe, Met, His, Ile, Leu Val, Ala, or Gly
  SITE (150)..(150): Xaa at position 150 is Ala, Gly, or Pro
  SITE (152)..(152): Xaa at position 152 is Leu, Ala, Val, Gly, or Ile
  SITE (162)..(162): Xaa at position 162 is Leu, Ala, Val, Gly, or Ile
  SITE (163)..(163): Xaa at position 163 is Ala, Gly, or Pro
  SITE (164)..(164): Xaa at position 164 is Ile, Ala, Val, Leu, or Gly
  SITE (168)..(168): Xaa at position 168 is Ala, Gly, or Pro
  SITE (170)..(170): Xaa at position 170 is Ala, Gly, or Pro
  SITE (171)..(171): Xaa at position 171 is Leu, Ala, Val, Gly, or Ile
  SITE (172)..(172): Xaa at position 172 is Ala, Gly, or Pro
  SITE (174)..(174): Xaa at position 174 is Tyr, Phe, Met, His, Ile, Leu, Val Ala, or Gly
  SITE (175)..(175): Xaa at position 175 is Ala, Gly, or Pro
  SITE (178)..(178): Xaa at position 178 is Cys, Ala, Val, Gly, Ser, or Thr
  SITE (183)..(183): Xaa at position 183 is Leu, Ala, Val, Gly, or Ile
  SITE (184)..(184): Xaa at position 184 is Val, Ala, Gly, Leu, or Ile
  SITE (186)..(186): Xaa at position 186 is Ile, Ala, Val, Leu, or Gly
  SITE (187)..(187): Xaa at position 187 is Val, Ala, Gly, Leu, or Ile
  SITE (202)..(202): Xaa at position 202 is Cys, Ala, Val, Gly, Ser, or Thr
  SITE (209)..(209): Xaa at position 209 is Val, Ala, Gly, Leu, or Ile
  SITE (210)..(210): Xaa at position 210 is Leu, Ala, Val, Gly, or Ile
  SITE (213)..(213): Xaa at position 213 is Val, Ala, Gly, Leu, or Ile
  SITE (216)..(216): Xaa at position 216 is Ala, Gly, or Pro
  SITE (217)..(217): Xaa at position 217 is Leu, Ala, Val, Gly, or Ile
  SITE (228)..(228): Xaa at position 228 is Leu, Ala, Val, Gly, or Ile
  SITE (229)..(229): Xaa at position 229 is Leu, Ala, Val, Gly, or Ile
  SITE (234)..(234): Xaa at position 234 is Val, Ala, Gly, Leu, or Ile
  SITE (244)..(244): Xaa at position 244 is Tyr, Phe, Met, His, Ile, Leu, Val Ala, or Gly
  SITE (250)..(250): Xaa at position 250 is Ala, Gly, or Pro
  SITE (252)..(252): Xaa at position 252 is Ala, Gly, or Pro
  SITE (254)..(254): Xaa at position 254 is Val, Ala, Gly, Leu, or Ile
  SITE (256)..(256): Xaa at position 256 is Ala, Gly, or Pro
  SITE (257)..(257): Xaa at position 257 is Leu, Ala, Val, Gly, or Ile
  SITE (261)..(261): Xaa at position 261 is Val, Ala, Gly, Leu, or Ile
  SITE (265)..(265): Xaa at position 265 is Val, Ala, Gly, Leu, or Ile
  SITE (268)..(268): Xaa at position 268 is Ile, Ala, Val, Leu, or Gly
  SITE (269)..(269): Xaa at position 269 is Cys, Ala, Val, Gly, Ser, or Thr
  SITE (270)..(270): Xaa at position 270 is Phe, Tyr, Met, His, Ile, Leu, Val Ala, or Gly
  SITE (280)..(280): Xaa at position 280 is Ala, Gly, or Pro
  SITE (282)..(282): Xaa at position 282 is Leu, Ala, Val, Gly, or Ile
  SITE (284)..(284): Xaa at position 284 is Leu, Ala, Val, Gly, or Ile
  SITE (287)..(287): Xaa at position 287 is Ile, Ala, Val, Leu, or Gly
  SITE (298)..(298): Xaa at position 298 is Leu, Ala, Val, Gly, or Ile
  SITE (300)..(300): Xaa at position 300 is Phe, Tyr, Met, His, Ile, Leu, Val Ala, or Gly
  SITE (302)..(302): Xaa at position 302 is Tyr, Phe, Met, His, Ile, Leu, Val Ala, or Gly
  SITE (305)..(305): Xaa at position 305 is Ala, Gly, or Pro
  SITE (306)..(306): Xaa at position 306 is Leu, Ala, Val, Gly, or Ile
  SITE (308)..(308): Xaa at position 308 is Ala, Gly, or Pro
  SITE (310)..(310): Xaa at position 310 is Ala, Gly, or Pro
  SITE (313)..(313): Xaa at position 313 is Ala, Gly, or Pro
  SITE (314)..(314): Xaa at position 314 is Trp, Tyr, Phe, Met, His, Ile, Leu Val, Ala, or Gly
  SITE (328)..(328): Xaa at position 328 is Phe, Tyr, Met, His, Ile, Leu, Val Ala, or Gly
  SITE (329)..(329): Xaa at position 329 is Met, Ile, Leu, Val, Ala, or Gly
  SITE (332)..(332): Xaa at position 332 is Ala, Gly, or Pro
  SITE (334)..(334): Xaa at position 334 is Ala, Gly, or Pro
  SITE (338)..(338): Xaa at position 338 is Ala, Gly, or Pro
  SITE (357)..(357): Xaa at position 357 is Leu, Ala, Val, Gly, or Ile
MAHRFPALTQEQKKEXSEXXQSXXANGKGXXXXDESVGTXGNRXQRIKVENTEENRRQXREXXXSXDSSXNQSXGGXXXFHETXYQKDSQGKLXRNXXKEKGIXXGXKXDQGGAPLAGTNKETTIQGLDGXSERXAQXKKDGXDXGKXRXVXRIADQCPSSXXXQENXNXXXRXXSIXQQNGXXPXXEPEVIPDGDHDLEHXQYVTEKXXAAXYKXXNDHHVYLEGTXXKPNMXTAGHACTKKXTPEQVXMXTXTXXHRTXPAAXPGXXXLSGGMSEEDXTXNXNAXNLCPLPKPWKXSXSXGRXXQXSXLAXXGGKAANKEATQEAXXKRXMXNCQXAKGQYVHTGSSGAASTQSXFTACYTY

SEQ ID NO: 194 - protein, 770 aa, Homo sapiens
  SITE (34)..(34): Xaa at position 34 is Ile, Ala, Val, Leu, or Gly
  SITE (35)..(35): Xaa at position 35 is Ala, Gly, or Pro
  SITE (41)..(41): Xaa at position 41 is Leu, Ala, Val, Gly, or Ile
  SITE (43)..(43): Xaa at position 43 is Met, Ile, Leu, Val, Ala, or Gly
  SITE (72)..(72): Xaa at position 72 is Tyr, Phe, Met, His, Ile, Leu, Val Ala, or Gly
  SITE (73)..(73): Xaa at position 73 is Cys, Ala, Val, Gly, Ser, or Thr
  SITE (85)..(85): Xaa at position 85 is Val, Ala, Gly, Leu, or Ile
  SITE (94)..(94): Xaa at position 94 is Ile, Ala, Val, Leu, or Gly
  SITE (97)..(97): Xaa at position 97 is Trp, Tyr, Phe, Met, His, Ile, Leu Val, Ala, or Gly
  SITE (117)..(117): Xaa at position 117 is Cys, Ala, Val, Gly, Ser, or Thr
  SITE (133)..(133): Xaa at position 133 is Cys, Ala, Val, Gly, Ser, or Thr
  SITE (150)..(150): Xaa at position 150 is Trp, Tyr, Phe, Met, His, Ile, Leu Val, Ala, or Gly
  SITE (154)..(154): Xaa at position 154 is Ala, Gly, or Pro
  SITE (158)..(158): Xaa at position 158 is Cys, Ala, Val, Gly, Ser, or Thr
  SITE (174)..(174): Xaa at position 174 is Cys, Ala, Val, Gly, Ser, or Thr
  SITE (179)..(179): Xaa at position 179 is Phe, Tyr, Met, His, Ile, Leu, Val Ala, or Gly
  SITE (182)..(182): Xaa at position 182 is Val, Ala, Gly, Leu, or Ile
  SITE (184)..(184): Xaa at position 184 is Phe, Tyr, Met, His, Ile, Leu, Val Ala, or Gly
  SITE (185)..(185): Xaa at position 185 is Val, Ala, Gly, Leu, or Ile
  SITE (186)..(186): Xaa at position 186 is Cys, Ala, Val, Gly, Ser, or Thr
  SITE (291)..(291): Xaa at position 291 is Cys, Ala, Val, Gly, Ser, or Thr
  SITE (316)..(316): Xaa at position 316 is Cys, Ala, Val, Gly, Ser, or Thr
  SITE (337)..(337): Xaa at position 337 is Cys, Ala, Val, Gly, Ser, or Thr
  SITE (375)..(375): Xaa at position 375 is Val, Ala, Gly, Leu, or Ile
  SITE (442)..(442): Xaa at position 442 is Leu, Ala, Val, Gly, or Ile
  SITE (453)..(453): Xaa at position 453 is Leu, Ala, Val, Gly, or Ile
  SITE (476)..(476): Xaa at position 476 is Tyr, Phe, Met, His, Ile, Leu, Val Ala, or Gly
  SITE (479)..(479): Xaa at position 479 is Ala, Gly, or Pro
  SITE (490)..(490): Xaa at position 490 is Val, Ala, Gly, Leu, or Ile
  SITE (494)..(494): Xaa at position 494 is Leu, Ala, Val, Gly, or Ile
  SITE (497)..(497): Xaa at position 497 is Tyr, Phe, Met, His, Ile, Leu, Val Ala, or Gly
  SITE (498)..(498): Xaa at position 498 is Val, Ala, Gly, Leu, or Ile
  SITE (500)..(500): Xaa at position 500 is Ala, Gly, or Pro
  SITE (523)..(523): Xaa at position 523 is Ala, Gly, or Pro
  SITE (537)..(537): Xaa at position 537 is Ile, Ala, Val, Leu, or Gly
  SITE (548)..(548): Xaa at position 548 is Leu, Ala, Val, Gly, or Ile
  SITE (555)..(555): Xaa at position 555 is Ala, Gly, or Pro
  SITE (558)..(558): Xaa at position 558 is Ile, Ala, Val, Leu, or Gly
  SITE (666)..(666): Xaa at position 666 is Ile, Ala, Val, Leu, or Gly
  SITE (669)..(669): Xaa at position 669 is Val, Ala, Gly, Leu, or Ile
  SITE (684)..(684): Xaa at position 684 is His, Phe, Tyr, Lys, Arg, Gly, Ser Thr, Ala, Val, Leu, Ile, Asn, Met, or Gln
  SITE (688)..(688): Xaa at position 688 is Leu, Ala, Val, Gly, or Ile
  SITE (689)..(689): Xaa at position 689 is Val, Ala, Gly, Leu, or Ile
MLPGLALLLLAAWTARALEVPTDGNAGLLAEPQXXMFCGRXNXHMNVQNGKWDSDPSGTKTCIDTKEGILQXXQEVYPELQITNXVEANQPVTXQNXCKRGRKQCKTHPHFVIPYRXLVGEFVSDALLVPDKXKFLHQERMDVCETHLHXHTVXKETXSEKSTNLHDYGMLLPXGIDKXRGXEXXXCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVXSEQAETGPCRAMISRWYFDVTEGKXAPFFYGGCGGNRNNFDTEEYXMAVCGSAMSQSLLKTTQEPLARDPVKLPTTAASTPDAXDKYLETPGDENEHAHFQKAKERLEAKHRERMSQVMREWEEAERQAKNLPKADKKAVIQHFQEKVESXEQEAANERQQXVETHMARVEAMLNDRRRLALENXITXLQAVPPRPRHXFNMXKKXXRXEQKDRQHTLKHFEHVRMVDPKKXAQIRSQVMTHLRVXYERMNQSLSLXYNVPAVXEEXQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEXSEXKMDAEFRHDSGYEVXHQKXXFFAEDVGSNKGAIIGLMVGGVVIATVIVITLVMLKKKQYTSIHHGVVEVDAAVTPEERHLSKMQQNGYENPTYKFFEQMQN

SEQ ID NO: 195 - protein, 322 aa, Homo sapiens
  SITE (8)..(8): Xaa at position 8 is Ile, Ala, Val, Leu, or Gly
  SITE (10)..(10): Xaa at position 10 is Ile, Ala, Val, Leu, or Gly
  SITE (11)..(11): Xaa at position 11 is Ile, Ala, Val, Leu, or Gly
  SITE (13)..(13): Xaa at position 13 is Ala, Gly, or Pro
  SITE (15)..(15): Xaa at position 15 is Phe, Tyr, Met, His, Ile, Leu, Val Ala, or Gly
  SITE (24)..(24): Xaa at position 24 is Val, Ala, Gly, Leu, or Ile
  SITE (30)..(30): Xaa at position 30 is Val, Ala, Gly, Leu, or Ile
  SITE (31)..(31): Xaa at position 31 is Leu, Ala, Val, Gly, or Ile
  SITE (36)..(36): Xaa at position 36 is Leu, Ala, Val, Gly, or Ile
  SITE (40)..(40): Xaa at position 40 is Leu, Ala, Val, Gly, or Ile
  SITE (67)..(67): Xaa at position 67 is Val, Ala, Gly, Leu, or Ile
  SITE (73)..(73): Xaa at position 73 is Val, Ala, Gly, Leu, or Ile
  SITE (76)..(76): Xaa at position 76 is Ala, Gly, or Pro
  SITE (80)..(80): Xaa at position 80 is Leu, Ala, Val, Gly, or Ile
  SITE (81)..(81): Xaa at position 81 is Ala, Gly, or Pro
  SITE (84)..(84): Xaa at position 84 is Val, Ala, Gly, Leu, or Ile
  SITE (85)..(85): Xaa at position 85 is Ala, Gly, or Pro
  SITE (87)..(87): Xaa at position 87 is Val, Ala, Gly, Leu, or Ile
  SITE (95)..(95): Xaa at position 95 is Leu, Ala, Val, Gly, or Ile
  SITE (96)..(96): Xaa at position 96 is Val, Ala, Gly, Leu, or Ile
  SITE (97)..(97): Xaa at position 97 is Leu, Ala, Val, Gly, or Ile
  SITE (101)..(101): Xaa at position 101 is His, Phe, Tyr, Lys, Arg, Gly, Ser Thr, Ala, Val, Leu, Ile, Asn, Met, or Gln
  SITE (103)..(103): Xaa at position 103 is Leu, Ala, Val, Gly, or Ile
  SITE (104)..(104): Xaa at position 104 is Ala, Gly, or Pro
  SITE (105)..(105): Xaa at position 105 is Ile, Ala, Val, Leu, or Gly
  SITE (108)..(108): Xaa at position 108 is Ile, Ala, Val, Leu, or Gly
  SITE (111)..(111): Xaa at position 111 is His, Phe, Tyr, Lys, Arg, Gly, Ser Thr, Ala, Val, Leu, Ile, Asn, Met, or Gln
  SITE (115)..(115): Xaa at position 115 is His, Phe, Tyr, Lys, Arg, Gly, Ser Thr, Ala, Val, Leu, Ile, Asn, Met, or Gln
  SITE (118)..(118): Xaa at position 118 is Leu, Ala, Val, Gly, or Ile
  SITE (120)..(120): Xaa at position 120 is Val, Ala, Gly, Leu, or Ile
  SITE (121)..(121): Xaa at position 121 is Ile, Ala, Val, Leu, or Gly
  SITE (122)..(122): Xaa at position 122 is Trp, Tyr, Phe, Met, His, Ile, Leu Val, Ala, or Gly
  SITE (123)..(123): Xaa at position 123 is Val, Ala, Gly, Leu, or Ile
  SITE (125)..(125): Xaa at position 125 is Ala, Gly, or Pro
  SITE (129)..(129): Xaa at position 129 is Ile, Ala, Val, Leu, or Gly
  SITE (140)..(140): Xaa at position 140 is Leu, Ala, Val, Gly, or Ile
  SITE (145)..(145): Xaa at position 145 is Val, Ala, Gly, Leu, or Ile
  SITE (148)..(148): Xaa at position 148 is Leu, Ala, Val, Gly, or Ile
  SITE (149)..(149): Xaa at position 149 is Leu, Ala, Val, Gly, or Ile
  SITE (152)..(152): Xaa at position 152 is Leu, Ala, Val, Gly, or Ile
  SITE (169)..(169): Xaa at position 169 is Ile, Ala, Val, Leu, or Gly
  SITE (171)..(171): Xaa at position 171 is Ala, Gly, or Pro
  SITE (174)..(174): Xaa at position 174 is Ile, Ala, Val, Leu, or Gly
  SITE (175)..(175): Xaa at position 175 is Val, Ala, Gly, Leu, or Ile
  SITE (176)..(176): Xaa at position 176 is Tyr, Phe, Met, His, Ile, Leu, Val Ala, or Gly
  SITE (177)..(177): Xaa at position 177 is Ile, Ala, Val, Leu, or Gly
  SITE (179)..(179): Xaa at position 179 is Leu, Ala, Val, Gly, or Ile
  SITE (190)..(190): Xaa at position 190 is Leu, Ala, Val, Gly, or Ile
  SITE (198)..(198): Xaa at position 198 is Phe, Tyr, Met, His, Ile, Leu, Val Ala, or Gly
  SITE (211)..(211): Xaa at position 211 is Val, Ala, Gly, Leu, or Ile
  SITE (212)..(212): Xaa at position 212 is Met, Ile, Leu, Val, Ala, or Gly
  SITE (219)..(219): Xaa at position 219 is Leu, Ala, Val, Gly, or Ile
  SITE (227)..(227): Xaa at position 227 is Ile, Ala, Val, Leu, or Gly
  SITE (228)..(228): Xaa at position 228 is His, Phe, Tyr, Lys, Arg, Gly, Ser Thr, Ala, Val, Leu, Ile, Asn, Met, or Gln
  SITE (229)..(229): Xaa at position 229 is Leu, Ala, Val, Gly, or Ile
  SITE (231)..(231): Xaa at position 231 is Phe, Tyr, Met, His, Ile, Leu, Val Ala, or Gly
  SITE (233)..(233): Xaa at position 233 is Val, Ala, Gly, Leu, or Ile
  SITE (236)..(236): Xaa at position 236 is Leu, Ala, Val, Gly, or Ile
  SITE (243)..(243): Xaa at position 243 is Ala, Gly, or Pro
  SITE (252)..(252): Xaa at position 252 is Leu, Ala, Val, Gly, or Ile
  SITE (260)..(260): Xaa at position 260 is Ile, Ala, Val, Leu, or Gly
  SITE (264)..(264): Xaa at position 264 is Ile, Ala, Val, Leu, or Gly
  SITE (273)..(273): Xaa at position 273 is Leu, Ala, Val, Gly, or Ile
  SITE (275)..(275): Xaa at position 275 is Ile, Ala, Val, Leu, or Gly
  SITE (276)..(276): Xaa at position 276 is Met, Ile, Leu, Val, Ala, or Gly
  SITE (278)..(278): Xaa at position 278 is Val, Ala, Gly, Leu, or Ile
  SITE (293)..(293): Xaa at position 293 is Val, Ala, Gly, Leu, or Ile
  SITE (296)..(296): Xaa at position 296 is Ala, Gly, or Pro
  SITE (299)..(299): Xaa at position 299 is Ile, Ala, Val, Leu, or Gly
  SITE (302)..(302): Xaa at position 302 is Ala, Gly, or Pro
  SITE (303)..(303): Xaa at position 303 is Cys, Ala, Val, Gly, Ser, or Thr
  SITE (304)..(304): Xaa at position 304 is Phe, Tyr, Met, His, Ile, Leu, Val Ala, or Gly
MSAKSRTXGXXGXPXSKGQPRGGXEEGPTXXRKAGXLEKXKEQECDVKDYGDLPFADIPNDSPFQIXKNPRSXGKXSEQXXGKXXEXKKNGRISXXXGGDXSXXXGSXSGXARVXPDXGXXXXDXHTDXNTPLTTTSGNXHGQPXSFXXKEXKGKIPDVPGFSWVTPCXSXKDXXXXGXRDVDPGEHYIXKTLGIKYXSMTEVDRLGIGKXXEETLSYXLGRKKRPXXXSXDXDGXDPSFTPXTGTPVVGGXTYREGLYXTEEXYKTGLLSGXDXXEXNPSLGKTPEEVTRTXNTXVAXTLXXXGLAREGNHKPIDYLNPPK

SEQ ID NO: 196 - protein, 517 aa, Homo sapiens
  SITE (36)..(36): Xaa at position 36 is Cys, Ala, Val, Gly, Ser, or Thr
  SITE (39)..(39): Xaa at position 39 is Ile, Ala, Val, Leu, or Gly
  SITE (40)..(40): Xaa at position 40 is Phe, Tyr, Met, His, Ile, Leu, Val Ala, or Gly
  SITE (48)..(48): Xaa at position 48 is Ala, Gly, or Pro
  SITE (54)..(54): Xaa at position 54 is Phe, Tyr, Met, His, Ile, Leu, Val Ala, or Gly
  SITE (68)..(68): Xaa at position 68 is Val, Ala, Gly, Leu, or Ile
  SITE (69)..(69): Xaa at position 69 is Ala, Gly, or Pro
  SITE (76)..(76): Xaa at position 76 is Val, Ala, Gly, Leu, or Ile
  SITE (79)..(79): Xaa at position 79 is Ala, Gly, or Pro
  SITE (80)..(80): Xaa at position 80 is Val, Ala, Gly, Leu, or Ile
  SITE (82)..(82): Xaa at position 82 is Ala, Gly, or Pro
  SITE (83)..(83): Xaa at position 83 is Ala, Gly, or Pro
  SITE (85)..(85): Xaa at position 85 is Ala, Gly, or Pro
  SITE (93)..(93): Xaa at position 93 is Trp, Tyr, Phe, Met, His, Ile, Leu Val, Ala, or Gly
  SITE (104)..(104): Xaa at position 104 is Leu, Ala, Val, Gly, or Ile
  SITE (105)..(105): Xaa at position 105 is Leu, Ala, Val, Gly, or Ile
  SITE (108)..(108): Xaa at position 108 is Leu, Ala, Val, Gly, or Ile
  SITE (109)..(109): Xaa at position 109 is Ala, Gly, or Pro
  SITE (111)..(111): Xaa at position 111 is Leu, Ala, Val, Gly, or Ile
  SITE (112)..(112): Xaa at position 112 is Ile, Ala, Val, Leu, or Gly
  SITE (118)..(118): Xaa at position 118 is Tyr, Phe, Met, His, Ile, Leu, Val Ala, or Gly
  SITE (119)..(119): Xaa at position 119 is Leu, Ala, Val, Gly, or Ile
  SITE (120)..(120): Xaa at position 120 is Ala, Gly, or Pro
  SITE (121)..(121): Xaa at position 121 is Ala, Gly, or Pro
  SITE (122)..(122): Xaa at position 122 is Leu, Ala, Val, Gly, or Ile
  SITE (125)..(125): Xaa at position 125 is Leu, Ala, Val, Gly, or Ile
  SITE (139)..(139): Xaa at position 139 is Leu, Ala, Val, Gly, or Ile
  SITE (142)..(142): Xaa at position 142 is Val, Ala, Gly, Leu, or Ile
  SITE (143)..(143): Xaa at position 143 is Leu, Ala, Val, Gly, or Ile
  SITE (145)..(145): Xaa at position 145 is Cys, Ala, Val, Gly, Ser, or Thr
  SITE (146)..(146): Xaa at position 146 is Leu, Ala, Val, Gly, or Ile
  SITE (149)..(149): Xaa at position 149 is Tyr, Phe, Met, His, Ile, Leu, Val Ala, or Gly
  SITE (150)..(150): Xaa at position 150 is Ala, Gly, or Pro
  SITE (153)..(153): Xaa at position 153 is Ala, Gly, or Pro
  SITE (178)..(178): Xaa at position 178 is Val, Ala, Gly, Leu, or Ile
  SITE (179)..(179): Xaa at position 179 is Cys, Ala, Val, Gly, Ser, or Thr
  SITE (189)..(189): Xaa at position 189 is Leu, Ala, Val, Gly, or Ile
  SITE (190)..(190): Xaa at position 190 is Leu, Ala, Val, Gly, or Ile
  SITE (191)..(191): Xaa at position 191 is Met, Ile, Leu, Val, Ala, or Gly
  SITE (193)..(193): Xaa at position 193 is Ala, Gly, or Pro
  SITE (196)..(196): Xaa at position 196 is Leu, Ala, Val, Gly, or Ile
  SITE (199)..(199): Xaa at position 199 is Ala, Gly, or Pro
  SITE (200)..(200): Xaa at position 200 is Leu, Ala, Val, Gly, or Ile
  SITE (201)..(201): Xaa at position 201 is Ala, Gly, or Pro
  SITE (205)..(205): Xaa at position 205 is Val, Ala, Gly, Leu, or Ile
  SITE (206)..(206): Xaa at position 206 is Val, Ala, Gly, Leu, or Ile
  SITE (207)..(207): Xaa at position 207 is Val, Ala, Gly, Leu, or Ile
  SITE (208)..(208): Xaa at position 208 is Met, Ile, Leu, Val, Ala, or Gly
  SITE (210)..(210): Xaa at position 210 is Val, Ala, Gly, Leu, or Ile
  SITE (216)..(216): Xaa at position 216 is Leu, Ala, Val, Gly, or Ile
  SITE (218)..(218): Xaa at position 218 is Ala, Gly, or Pro
  SITE (219)..(219): Xaa at position 219 is Leu, Ala, Val, Gly, or Ile
  SITE (220)..(220): Xaa at position 220 is Tyr, Phe, Met, His, Ile, Leu, Val Ala, or Gly
  SITE (221)..(221): Xaa at position 221 is Val, Ala, Gly, Leu, or Ile
  SITE (222)..(222): Xaa at position 222 is Ala, Gly, or Pro
  SITE (224)..(224): Xaa at position 224 is Leu, Ala, Val, Gly, or Ile
  SITE (225)..(225): Xaa at position 225 is Ile, Ala, Val, Leu, or Gly
  SITE (228)..(228): Xaa at position 228 is Ala, Gly, or Pro
  SITE (234)..(234): Xaa at position 234 is Val, Ala, Gly, Leu, or Ile
  SITE (235)..(235): Xaa at position 235 is Val, Ala, Gly, Leu, or Ile
  SITE (237)..(237): Xaa at position 237 is Ile, Ala, Val, Leu, or Gly
  SITE (238)..(238): Xaa at position 238 is Val, Ala, Gly, Leu, or Ile
  SITE (245)..(245): Xaa at position 245 is Ala, Gly, or Pro
  SITE (249)..(249): Xaa at position 249 is Ile, Ala, Val, Leu, or Gly
  SITE (250)..(250): Xaa at position 250 is Ala, Gly, or Pro
  SITE (255)..(255): Xaa at position 255 is Val, Ala, Gly, Leu, or Ile
  SITE (258)..(258): Xaa at position 258 is Val, Ala, Gly, Leu, or Ile
  SITE (259)..(259): Xaa at position 259 is Ala, Gly, or Pro
  SITE (270)..(270): Xaa at position 270 is Ile, Ala, Val, Leu, or Gly
  SITE (273)..(273): Xaa at position 273 is Ala, Gly, or Pro
  SITE (274)..(274): Xaa at position 274 is Ala, Gly, or Pro
  SITE (293)..(293): Xaa at position 293 is Ile, Ala, Val, Leu, or Gly
  SITE (294)..(294): Xaa at position 294 is Ile, Ala, Val, Leu, or Gly
  SITE (303)..(303): Xaa at position 303 is Ala, Gly, or Pro
  SITE (307)..(307): Xaa at position 307 is Ala, Gly, or Pro
  SITE (308)..(308): Xaa at position 308 is His, Phe, Tyr, Lys, Arg, Gly, Ser Thr, Ala, Val, Leu, Ile, Asn, Met, or Gln
  SITE (310)..(310): Xaa at position 310 is Ala, Gly, or Pro
  SITE (311)..(311): Xaa at position 311 is Leu, Ala, Val, Gly, or Ile
  SITE (312)..(312): Xaa at position 312 is Phe, Tyr, Met, His, Ile, Leu, Val Ala, or Gly
  SITE (313)..(313): Xaa at position 313 is Phe, Tyr, Met, His, Ile, Leu, Val Ala, or Gly
  SITE (318)..(318): Xaa at position 318 is Cys, Ala, Val, Gly, Ser, or Thr
  SITE (319)..(319): Xaa at position 319 is Cys, Ala, Val, Gly, Ser, or Thr
  SITE (320)..(320): Xaa at position 320 is Cys, Ala, Val, Gly, Ser, or Thr
  SITE (321)..(321): Xaa at position 321 is Ala, Gly, or Pro
  SITE (326)..(326): Xaa at position 326 is Phe, Tyr, Met, His, Ile, Leu, Val Ala, or Gly
  SITE (327)..(327): Xaa at position 327 is Val, Ala, Gly, Leu, or Ile
  SITE (335)..(335): Xaa at position 335 is Phe, Tyr, Met, His, Ile, Leu, Val Ala, or Gly
  SITE (343)..(343): Xaa at position 343 is Ala, Gly, or Pro
  SITE (370)..(370): Xaa at position 370 is Ile, Ala, Val, Leu, or Gly
  SITE (373)..(373): Xaa at position 373 is Tyr, Phe, Met, His, Ile, Leu, Val Ala, or Gly
  SITE (374)..(374): Xaa at position 374 is Ile, Ala, Val, Leu, or Gly
  SITE (397)..(397): Xaa at position 397 is Phe, Tyr, Met, His, Ile, Leu, Val Ala, or Gly
  SITE (398)..(398): Xaa at position 398 is Ile, Ala, Val, Leu, or Gly
  SITE (402)..(402): Xaa at position 402 is Val, Ala, Gly, Leu, or Ile
  SITE (403)..(403): Xaa at position 403 is Phe, Tyr, Met, His, Ile, Leu, Val Ala, or Gly
  SITE (406)..(406): Xaa at position 406 is Val, Ala, Gly, Leu, or Ile
  SITE (412)..(412): Xaa at position 412 is Ile, Ala, Val, Leu, or Gly
  SITE (413)..(413): Xaa at position 413 is Ala, Gly, or Pro
  SITE (417)..(417): Xaa at position 417 is Ile, Ala, Val, Leu, or Gly
  SITE (421)..(421): Xaa at position 421 is Val, Ala, Gly, Leu, or Ile
  SITE (422)..(422): Xaa at position 422 is Met, Ile, Leu, Val, Ala, or Gly
  SITE (424)..(424): Xaa at position 424 is Ile, Ala, Val, Leu, or Gly
  SITE (425)..(425): Xaa at position 425 is Leu, Ala, Val, Gly, or Ile
  SITE (427)..(427): Xaa at position 427 is Phe, Tyr, Met, His, Ile, Leu, Val Ala, or Gly
  SITE (430)..(430): Xaa at position 430 is Ile, Ala, Val, Leu, or Gly
  SITE (433)..(433): Xaa at position 433 is Val, Ala, Gly, Leu, or Ile
  SITE (434)..(434): Xaa at position 434 is Val, Ala, Gly, Leu, or Ile
  SITE (444)..(444): Xaa at position 444 is Leu, Ala, Val, Gly, or Ile
  SITE (445)..(445): Xaa at position 445 is Ala, Gly, or Pro
  SITE (446)..(446): Xaa at position 446 is Ala, Gly, or Pro
  SITE (447)..(447): Xaa at position 447 is Ala, Gly, or Pro
  SITE (448)..(448): Xaa at position 448 is Val, Ala, Gly, Leu, or Ile
  SITE (449)..(449): Xaa at position 449 is Phe, Tyr, Met, His, Ile, Leu, Val Ala, or Gly
  SITE (459)..(459): Xaa at position 459 is Leu, Ala, Val, Gly, or Ile
  SITE (478)..(478): Xaa at position 478 is Ala, Gly, or Pro
  SITE (482)..(482): Xaa at position 482 is Phe, Tyr, Met, His, Ile, Leu, Val Ala, or Gly
  SITE (494)..(494): Xaa at position 494 is Leu, Ala, Val, Gly, or Ile
  SITE (499)..(499): Xaa at position 499 is Leu, Ala, Val, Gly, or Ile
  SITE (502)..(502): Xaa at position 502 is Tyr, Phe, Met, His, Ile, Leu, Val Ala, or Gly
MLRAAARFGPRLGRRLLSAAATQAVPAPNQQPEVFXNQXXINNEWHDXVSRKTXPTVNPSTGEVICQXXEGDKEDXDKXXKXXRXAFQLGSPXRRMDASHRGRXXNRXXDXXERDRTXXXXXETXDNGKPYVISYLVDXDMXXKXXRYXXGWXDKYHGKTIPIDGDFFSYTRHEPVGXXGQIIPWNFPXXXQXWKXGPXXXTGNXXXXKXAEQTPXTXXXXXNXXKEXGFPPGXXNXXPGFGPTXGAAXXSHEDXDKXXFTGSTEIGRVXQVXXGSSNLKRVTLELGGKSPNXXMSDADMDWXVEQXXFXXXXNQGQXXXXGSRTXXQEDIYDEXVERSVARXKSRVVGNPFDSKTEQGPQVDETQFKKXLGXXNTGKQEGAKLLCGGGIAADRGYXXQPTXXGDXQDGMTXXKEEXFGPXXQXXKXKTXEEXXGRANNSTYGXXXXXXTKDLDKANYXSQALQAGTVWVNCYDVFGXQSPXGGYKMSGSGREXGEYGXQAXTEVKTVTVKVPQKNS

SEQ ID NO: 197 - protein, 788 aa, Homo sapiens
  SITE (31)..(31): Xaa at position 31 is Cys, Ala, Val, Gly, Ser, or Thr
  SITE (39)..(39): Xaa at position 39 is Cys, Ala, Val, Gly, Ser, or Thr
  SITE (42)..(42): Xaa at position 42 is Cys, Ala, Val, Gly, Ser, or Thr
  SITE (43)..(43): Xaa at position 43 is Leu, Ala, Val, Gly, or Ile
  SITE (49)..(49): Xaa at position 49 is Cys, Ala, Val, Gly, Ser, or Thr
  SITE (50)..(50): Xaa at position 50 is Ala, Gly, or Pro
  SITE (51)..(51): Xaa at position 51 is Trp, Tyr, Phe, Met, His, Ile, Leu Val, Ala, or Gly
  SITE (52)..(52): Xaa at position 52 is Cys, Ala, Val, Gly, Ser, or Thr
  SITE (64)..(64): Xaa at position 64 is Cys, Ala, Val, Gly, Ser, or Thr
  SITE (70)..(70): Xaa at position 70 is Leu, Ala, Val, Gly, or Ile
  SITE (75)..(75): Xaa at position 75 is Cys, Ala, Val, Gly, Ser, or Thr
  SITE (109)..(109): Xaa at position 109 is Val, Ala, Gly, Leu, or Ile
  SITE (114)..(114): Xaa at position 114 is Ile, Ala, Val, Leu, or Gly
  SITE (116)..(116): Xaa at position 116 is Leu, Ala, Val, Gly, or Ile
  SITE (118)..(118): Xaa at position 118 is Leu, Ala, Val, Gly, or Ile
  SITE (126)..(126): Xaa at position 126 is Phe, Tyr, Met, His, Ile, Leu, Val Ala, or Gly
  SITE (128)..(128): Xaa at position 128 is Ile, Ala, Val, Leu, or Gly
  SITE (130)..(130): Xaa at position 130 is Val, Ala, Gly, Leu, or Ile
  SITE (133)..(133): Xaa at position 133 is Val, Ala, Gly, Leu, or Ile
  SITE (138)..(138): Xaa at position 138 is Val, Ala, Gly, Leu, or Ile
  SITE (140)..(140): Xaa at position 140 is Ile, Ala, Val, Leu, or Gly
  SITE (141)..(141): Xaa at position 141 is Tyr, Phe, Met, His, Ile, Leu, Val Ala, or Gly
  SITE (142)..(142): Xaa at position 142 is Tyr, Phe, Met, His, Ile, Leu, Val Ala, or Gly
  SITE (143)..(143): Xaa at position 143 is Leu, Ala, Val, Gly, or Ile
  SITE (144)..(144): Xaa at position 144 is Met, Ile, Leu, Val, Ala, or Gly
  SITE (146)..(146): Xaa at position 146 is Leu, Ala, Val, Gly, or Ile
  SITE (150)..(150): Xaa at position 150 is Met, Ile, Leu, Val, Ala, or Gly
  SITE (157)..(157): Xaa at position 157 is Ile, Ala, Val, Leu, or Gly
  SITE (160)..(160): Xaa at position 160 is Leu, Ala, Val, Gly, or Ile
  SITE (164)..(164): Xaa at position 164 is Leu, Ala, Val, Gly, or Ile
  SITE (165)..(165): Xaa at position 165 is Ala, Gly, or Pro
  SITE (168)..(168): Xaa at position 168 is Met, Ile, Leu, Val, Ala, or Gly
  SITE (177)..(177): Xaa at position 177 is Ile, Ala, Val, Leu, or Gly
  SITE (179)..(179): Xaa at position 179 is Phe, Tyr, Met, His, Ile, Leu, Val Ala, or Gly
  SITE (181)..(181): Xaa at position 181 is Ala, Gly, or Pro
  SITE (182)..(182): Xaa at position 182 is Phe, Tyr, Met, His, Ile, Leu, Val Ala, or Gly
  SITE (183)..(183): Xaa at position 183 is Val, Ala, Gly, Leu, or Ile
  SITE (190)..(190): Xaa at position 190 is Tyr, Phe, Met, His, Ile, Leu, Val Ala, or Gly
  SITE (192)..(192): Xaa at position 192 is Tyr, Phe, Met, His, Ile, Leu, Val Ala, or Gly
  SITE (198)..(198): Xaa at position 198 is Ala, Gly, or Pro
  SITE (203)..(203): Xaa at position 203 is Cys, Ala, Val, Gly, Ser, or Thr
  SITE (210)..(210): Xaa at position 210 is Cys, Ala, Val, Gly, Ser, or Thr
  SITE (216)..(216): Xaa at position 216 is Tyr, Phe, Met, His, Ile, Leu, Val Ala, or Gly
  SITE (220)..(220): Xaa at position 220 is Leu, Ala, Val, Gly, or Ile
  SITE (222)..(222): Xaa at position 222 is Leu, Ala, Val, Gly, or Ile
  SITE (229)..(229): Xaa at position 229 is Phe, Tyr, Met, His, Ile, Leu, Val Ala, or Gly
  SITE (233)..(233): Xaa at position 233 is Val, Ala, Gly, Leu, or Ile
  SITE (249)..(249): Xaa at position 249 is Phe, Tyr, Met, His, Ile, Leu, Val Ala, or Gly
  SITE (251)..(251): Xaa at position 251 is Ala, Gly, or Pro
  SITE (252)..(252): Xaa at position 252 is Ile, Ala, Val, Leu, or Gly
  SITE (253)..(253): Xaa at position 253 is Met, Ile, Leu, Val, Ala, or Gly
  SITE (255)..(255): Xaa at position 255 is Ala, Gly, or Pro
  SITE (258)..(258): Xaa at position 258 is Cys, Ala, Val, Gly, Ser, or Thr
  SITE (262)..(262): Xaa at position 262 is Ile, Ala, Val, Leu, or Gly
  SITE (271)..(271): Xaa at position 271 is Leu, Ala, Val, Gly, or Ile
  SITE (272)..(272): Xaa at position 272 is Leu, Ala, Val, Gly, or Ile
  SITE (273)..(273): Xaa at position 273 is Val, Ala, Gly, Leu, or Ile
  SITE (274)..(274): Xaa at position 274 is Phe, Tyr, Met, His, Ile, Leu, Val Ala, or Gly
  SITE (291)..(291): Xaa at position 291 is Ile, Ala, Val, Leu, or Gly
  SITE (313)..(313): Xaa at position 313 is Met, Ile, Leu, Val, Ala, or Gly
  SITE (315)..(315): Xaa at position 315 is Tyr, Phe, Met, His, Ile, Leu, Val Ala, or Gly
  SITE (321)..(321): Xaa at position 321 is Met, Ile, Leu, Val, Ala, or Gly
  SITE (325)..(325): Xaa at position 325 is Leu, Ala, Val, Gly, or Ile
  SITE (332)..(332): Xaa at position 332 is Leu, Ala, Val, Gly, or Ile
  SITE (333)..(333): Xaa at position 333 is Ile, Ala, Val, Leu, or Gly
  SITE (334)..(334): Xaa at position 334 is Phe, Tyr, Met, His, Ile, Leu, Val Ala, or Gly
  SITE (335)..(335): Xaa at position 335 is Ala, Gly, or Pro
  SITE (336)..(336): Xaa at position 336 is Val, Ala, Gly, Leu, or Ile
  SITE (344)..(344): Xaa at position 344 is Tyr, Phe, Met, His, Ile, Leu, Val Ala, or Gly
  SITE (351)..(351): Xaa at position 351 is Ile, Ala, Val, Leu, or Gly
  SITE (359)..(359): Xaa at position 359 is Leu, Ala, Val, Gly, or Ile
  SITE (366)..(366): Xaa at position 366 is Val, Ala, Gly, Leu, or Ile
  SITE (370)..(370): Xaa at position 370 is Ile, Ala, Val, Leu, or Gly
  SITE (373)..(373): Xaa at position 373 is Ala, Gly, or Pro
  SITE (374)..(374): Xaa at position 374 is Tyr, Phe, Met, His, Ile, Leu, Val Ala, or Gly
  SITE (381)..(381): Xaa at position 381 is Val, Ala, Gly, Leu, or Ile
  SITE (383)..(383): Xaa at position 383 is Leu, Ala, Val, Gly, or Ile
  SITE (392)..(392): Xaa at position 392 is Leu, Ala, Val, Gly, or Ile
  SITE (398)..(398): Xaa at position 398 is Ala, Gly, or Pro
  SITE (400)..(400): Xaa at position 400 is Cys, Ala, Val, Gly, Ser, or Thr
  SITE (406)..(406): Xaa at position 406 is Ile, Ala, Val, Leu, or Gly
  SITE (409)..(409): Xaa at position 409 is Leu, Ala, Val, Gly, or Ile
  SITE (412)..(412): Xaa at position 412 is Cys, Ala, Val, Gly, Ser, or Thr
  SITE (415)..(415): Xaa at position 415 is Leu, Ala, Val, Gly, or Ile
  SITE (421)..(421): Xaa at position 421 is Val, Ala, Gly, Leu, or Ile
  SITE (423)..(423): Xaa at position 423 is Phe, Tyr, Met, His, Ile, Leu, Val Ala, or Gly
  SITE (425)..(425): Xaa at position 425 is Ile, Ala, Val, Leu, or Gly
  SITE (427)..(427): Xaa at position 427 is Ala, Gly, or Pro
  SITE (429)..(429): Xaa at position 429 is Val, Ala, Gly, Leu, or Ile
  SITE (440)..(440): Xaa at position 440 is Phe, Tyr, Met, His, Ile, Leu, Val Ala, or Gly
  SITE (442)..(442): Xaa at position 442 is Ile, Ala, Val, Leu, or Gly
  SITE (451)..(451): Xaa at position 451 is Leu, Ala, Val, Gly, or Ile
  SITE (453)..(453): Xaa at position 453 is Val, Ala, Gly, Leu, or Ile
  SITE (455)..(455): Xaa at position 455 is Val, Ala, Gly, Leu, or Ile
  SITE (461)..(461): Xaa at position 461 is Cys, Ala, Val, Gly, Ser, or Thr
  SITE (474)..(474): Xaa at position 474 is Cys, Ala, Val, Gly, Ser, or Thr
  SITE (497)..(497): Xaa at position 497 is Cys, Ala, Val, Gly, Ser, or Thr
  SITE (499)..(499): Xaa at position 499 is Cys, Ala, Val, Gly, Ser, or Thr
  SITE (512)..(512): Xaa at position 512 is Cys, Ala, Val, Gly, Ser, or Thr
  SITE (521)..(521): Xaa at position 521 is Cys, Ala, Val, Gly, Ser, or Thr
  SITE (547)..(547): Xaa at position 547 is Cys, Ala, Val, Gly, Ser, or Thr
  SITE (562)..(562): Xaa at position 562 is Cys, Ala, Val, Gly, Ser, or Thr
  SITE (584)..(584): Xaa at position 584 is Cys, Ala, Val, Gly, Ser, or Thr
  SITE (593)..(593): Xaa at position 593 is Cys, Ala, Val, Gly, Ser, or Thr
  SITE (601)..(601): Xaa at position 601 is Cys, Ala, Val, Gly, Ser, or Thr
  SITE (624)..(624): Xaa at position 624 is Cys, Ala, Val, Gly, Ser, or Thr
  SITE (641)..(641): Xaa at position 641 is Val, Ala, Gly, Leu, or Ile
  SITE (661)..(661): Xaa at position 661 is Cys, Ala, Val, Gly, Ser, or Thr
  SITE (681)..(681): Xaa at position 681 is Cys, Ala, Val, Gly, Ser, or Thr
  SITE (689)..(689): Xaa at position 689 is Cys, Ala, Val, Gly, Ser, or Thr
  SITE (691)..(691): Xaa at position 691 is Val, Ala, Gly, Leu, or Ile
  SITE (693)..(693): Xaa at position 693 is Phe, Tyr, Met, His, Ile, Leu, Val Ala, or Gly
  SITE (705)..(705): Xaa at position 705 is Leu, Ala, Val, Gly, or Ile
MRARPRPRPLWATVLALGALAGVGVGGPNIXTTRGVSSXQQXXAVSPMXXXXSDEALPLGSPRXDLKENXLKDNXAPESIEFPVSEARVLEDRPLSDKGSGDSSQVTQXSPQRXAXRXRPDDSKNXSXQXRQXEDYPXDXXXXXDXSYSXKDDLWSXQNXGTKXXTQXRKLTSNLRXGXGXXXDKPVSPXMXISPPEXLENPXYDMKTTXLPMFGXKHVXTXTDQVTRXNEEXKKQSVSRNRDAPEGGXDXXXQXTVXDEKXGWRNDASHXXXXTTDAKTHIALDGRLAGXVQPNDGQCHVGSDNHYSASTTXDXPSLGLXTEKXSQKNINXXXXXTENVVNLXQNYSELXPGTTVGVXSMDSSNXLQLXVDXXGKIRSKXEXEVRDLPEEXSLSFNXTXLNNEVXPGXKSXMGXKIGDTXSXSXEXKXRGCPQEKEKSXTXKPVGFKDSXIXQXTFDCDXACQAQAEPNSHRXNNGNGTFECGVCRCGPGWLGSQXEXSEEDYRPSQQDEXSPREGQPVXSQRGECLCGQCVCHSSDFGKITGKYXECDDFSCVRYKGEMXSGHGQCSCGDCLCDSDWTGYYXNCTTRTDTXMSSNGLLXSGRGKCECGSCVCIQPGSYGDTXEKCPTCPDACTFKKECXECKKFDRGALHDENTCNRYXRDEIESVKELKDTGKDAVNXTYKNEDDXVXRXQYYEDSSGKSIXYVVEEPECPKGPDILVVLLSVMGAILLIGLAALLIWKLLITIHDRKEFAKFEEERARAKWDTANNPLYKEATSTFTNITYRGT

SEQ ID NO: 198 - protein, 769 aa, Homo sapiens
  SITE (25)..(25): Xaa at position 25 is Cys, Ala, Val, Gly, Ser, or Thr
  SITE (30)..(30): Xaa at position 30 is Val, Ala, Gly, Leu, or Ile
  SITE (33)..(33): Xaa at position 33 is Cys, Ala, Val, Gly, Ser, or Thr
  SITE (36)..(36): Xaa at position 36 is Cys, Ala, Val, Gly, Ser, or Thr
  SITE (37)..(37): Xaa at position 37 is Ile, Ala, Val, Leu, or Gly
  SITE (43)..(43): Xaa at position 43 is Cys, Ala, Val, Gly, Ser, or Thr
  SITE (45)..(45): Xaa at position 45 is Trp, Tyr, Phe, Met, His, Ile, Leu Val, Ala, or Gly
  SITE (46)..(46): Xaa at position 46 is Cys, Ala, Val, Gly, Ser, or Thr
  SITE (62)..(62): Xaa at position 62 is Cys, Ala, Val, Gly, Ser, or Thr
  SITE (68)..(68): Xaa at position 68 is Leu, Ala, Val, Gly, or Ile
  SITE (73)..(73): Xaa at position 73 is Cys, Ala, Val, Gly, Ser, or Thr
  SITE (98)..(98): Xaa at position 98 is Leu, Ala, Val, Gly, or Ile
  SITE (103)..(103): Xaa at position 103 is Val, Ala, Gly, Leu, or Ile
  SITE (105)..(105): Xaa at position 105 is Leu, Ala, Val, Gly, or Ile
  SITE (107)..(107): Xaa at position 107 is Leu, Ala, Val, Gly, or Ile
  SITE (113)..(113): Xaa at position 113 is Ala, Gly, or Pro
  SITE (115)..(115): Xaa at position 115 is Phe, Tyr, Met, His, Ile, Leu, Val Ala, or Gly
  SITE (117)..(117): Xaa at position 117 is Val, Ala, Gly, Leu, or Ile
  SITE (119)..(119): Xaa at position 119 is Phe, Tyr, Met, His, Ile, Leu, Val Ala, or Gly
  SITE (127)..(127): Xaa at position 127 is Ile, Ala, Val, Leu, or Gly
  SITE (129)..(129): Xaa at position 129 is Leu, Ala, Val, Gly, or Ile
  SITE (130)..(130): Xaa at position 130 is Tyr, Phe, Met, His, Ile, Leu, Val Ala, or Gly
  SITE (131)..(131): Xaa at position 131 is Tyr, Phe, Met, His, Ile, Leu, Val Ala, or Gly
  SITE (132)..(132): Xaa at position 132 is Leu, Ala, Val, Gly, or Ile
  SITE (133)..(133): Xaa at position 133 is Met, Ile, Leu, Val, Ala, or Gly
  SITE (135)..(135): Xaa at position 135 is Leu, Ala, Val, Gly, or Ile
  SITE (139)..(139): Xaa at position 139 is Met, Ile, Leu, Val, Ala, or Gly
  SITE (146)..(146): Xaa at position 146 is Val, Ala, Gly, Leu, or Ile
  SITE (149)..(149): Xaa at position 149 is Leu, Ala, Val, Gly, or Ile
  SITE (153)..(153): Xaa at position 153 is Leu, Ala, Val, Gly, or Ile
  SITE (154)..(154): Xaa at position 154 is Leu, Ala, Val, Gly, or Ile
  SITE (156)..(156): Xaa at position 156 is Ala, Gly, or Pro
  SITE (157)..(157): Xaa at position 157 is Leu, Ala, Val, Gly, or Ile
  SITE (166)..(166): Xaa at position 166 is Ile, Ala, Val, Leu, or Gly
  SITE (168)..(168): Xaa at position 168 is Phe, Tyr, Met, His, Ile, Leu, Val Ala, or Gly
  SITE (171)..(171): Xaa at position 171 is Phe, Tyr, Met, His, Ile, Leu, Val Ala, or Gly
  SITE (172)..(172): Xaa at position 172 is Val, Ala, Gly, Leu, or Ile
  SITE (179)..(179): Xaa at position 179 is Phe, Tyr, Met, His, Ile, Leu, Val Ala, or Gly
  SITE (180)..(180): Xaa at position 180 is Val, Ala, Gly, Leu, or Ile
  SITE (191)..(191): Xaa at position 191 is Cys, Ala, Val, Gly, Ser, or Thr
  SITE (198)..(198): Xaa at position 198 is Cys, Ala, Val, Gly, Ser, or Thr
  SITE (204)..(204): Xaa at position 204 is Phe, Tyr, Met, His, Ile, Leu, Val Ala, or Gly
  SITE (217)..(217): Xaa at position 217 is Phe, Tyr, Met, His, Ile, Leu, Val Ala, or Gly
  SITE (221)..(221): Xaa at position 221 is Val, Ala, Gly, Leu, or Ile
  SITE (226)..(226): Xaa at position 226 is Ile, Ala, Val, Leu, or Gly
  SITE (237)..(237): Xaa at position 237 is Leu, Ala, Val, Gly, or Ile
  SITE (239)..(239): Xaa at position 239 is Ala, Gly, or Pro
  SITE (240)..(240): Xaa at position 240 is Met, Ile, Leu, Val, Ala, or Gly
  SITE (241)..(241): Xaa at position 241 is Met, Ile, Leu, Val, Ala, or Gly
  SITE (243)..(243): Xaa at position 243 is Val, Ala, Gly, Leu, or Ile
  SITE (244)..(244): Xaa at position 244 is Ala, Gly, or Pro
  SITE (246)..(246): Xaa at position 246 is Cys, Ala, Val, Gly, Ser, or Thr
  SITE (250)..(250): Xaa at position 250 is Ile, Ala, Val, Leu, or Gly
  SITE (255)..(255): Xaa at position 255 is Val, Ala, Gly, Leu, or Ile
  SITE (258)..(258): Xaa at position 258 is Leu, Ala, Val, Gly, or Ile
  SITE (259)..(259): Xaa at position 259 is Leu, Ala, Val, Gly, or Ile
  SITE (260)..(260): Xaa at position 260 is Val, Ala, Gly, Leu, or Ile
  SITE (261)..(261): Xaa at position 261 is Phe, Tyr, Met, His, Ile, Leu, Val Ala, or Gly
  SITE (262)..(262): Xaa at position 262 is Ala, Gly, or Pro
  SITE (278)..(278): Xaa at position 278 is Ile, Ala, Val, Leu, or Gly
  SITE (293)..(293): Xaa at position 293 is Tyr, Phe, Met, His, Ile, Leu, Val Ala, or Gly
  SITE (301)..(301): Xaa at position 301 is Tyr, Phe, Met, His, Ile, Leu, Val Ala, or Gly
  SITE (307)..(307): Xaa at position 307 is Leu, Ala, Val, Gly, or Ile
  SITE (311)..(311): Xaa at position 311 is Leu, Ala, Val, Gly, or Ile
  SITE (316)..(316): Xaa at position 316 is Ile, Ala, Val, Leu, or Gly
  SITE (319)..(319): Xaa at position 319 is Ile, Ala, Val, Leu, or Gly
  SITE (320)..(320): Xaa at position 320 is Phe, Tyr, Met, His, Ile, Leu, Val Ala, or Gly
  SITE (321)..(321): Xaa at position 321 is Ala, Gly, or Pro
  SITE (322)..(322): Xaa at position 322 is Val, Ala, Gly, Leu, or Ile
  SITE (330)..(330): Xaa at position 330 is Tyr, Phe, Met, His, Ile, Leu, Val Ala, or Gly
  SITE (333)..(333): Xaa at position 333 is Leu, Ala, Val, Gly, or Ile
  SITE (337)..(337): Xaa at position 337 is Ile, Ala, Val, Leu, or Gly
  SITE (341)..(341): Xaa at position 341 is Ala, Gly, or Pro
  SITE (345)..(345): Xaa at position 345 is Leu, Ala, Val, Gly, or Ile
  SITE (352)..(352): Xaa at position 352 is Val, Ala, Gly, Leu, or Ile
  SITE (356)..(356): Xaa at position 356 is Ile, Ala, Val, Leu, or Gly
  SITE (359)..(359): Xaa at position 359 is Ala, Gly, or Pro
  SITE (367)..(367): Xaa at position 367 is Val, Ala, Gly, Leu, or Ile
  SITE (369)..(369): Xaa at position 369 is Leu, Ala, Val, Gly, or Ile
  SITE (378)..(378): Xaa at position 378 is Leu, Ala, Val, Gly, or Ile
  SITE (382)..(382): Xaa at position 382 is Tyr, Phe, Met, His, Ile, Leu, Val Ala, or Gly
  SITE (400)..(400): Xaa at position 400 is Cys, Ala, Val, Gly, Ser, or Thr
  SITE (403)..(403): Xaa at position 403 is Val, Ala, Gly, Leu, or Ile
  SITE (409)..(409): Xaa at position 409 is Ile, Ala, Val, Leu, or Gly
  SITE (411)..(411): Xaa at position 411 is Phe, Tyr, Met, His, Ile, Leu, Val Ala, or Gly
  SITE (413)..(413): Xaa at position 413 is Val, Ala, Gly, Leu, or Ile
  SITE (415)..(415): Xaa at position 415 is Val, Ala, Gly, Leu, or Ile
  SITE (417)..(417): Xaa at position 417 is Ala, Gly, or Pro
  SITE (426)..(426): Xaa at position 426 is Phe, Tyr, Met, His, Ile, Leu, Val Ala, or Gly
  SITE (428)..(428): Xaa at position 428 is Ile, Ala, Val, Leu, or Gly
  SITE (430)..(430): Xaa at position 430 is Ala, Gly, or Pro
  SITE (437)..(437): Xaa at position 437 is Val, Ala, Gly, Leu, or Ile
  SITE (439)..(439): Xaa at position 439 is Val, Ala, Gly, Leu, or Ile
  SITE (441)..(441): Xaa at position 441 is Val, Ala, Gly, Leu, or Ile
  SITE (445)..(445): Xaa at position 445 is Cys, Ala, Val, Gly, Ser, or Thr
  SITE (459)..(459): Xaa at position 459 is Cys, Ala, Val, Gly, Ser, or Thr
  SITE (467)..(467): Xaa at position 467 is Cys, Ala, Val, Gly, Ser, or Thr
  SITE (481)..(481): Xaa at position 481 is Cys, Ala, Val, Gly, Ser, or Thr
  SITE (483)..(483): Xaa at position 483 is Cys, Ala, Val, Gly, Ser, or Thr
  SITE (497)..(497): Xaa at position 497 is Cys, Ala, Val, Gly, Ser, or Thr
  SITE (506)..(506): Xaa at position 506 is Cys, Ala, Val, Gly, Ser, or Thr
  SITE (534)..(534): Xaa at position 534 is Cys, Ala, Val, Gly, Ser, or Thr
  SITE (549)..(549): Xaa at position 549 is Cys, Ala, Val, Gly, Ser, or Thr
  SITE (557)..(557): Xaa at position 557 is Cys, Ala, Val, Gly, Ser, or Thr
  SITE (572)..(572): Xaa at position 572 is Ala, Gly, or Pro
  SITE (573)..(573): Xaa at position 573 is Cys, Ala, Val, Gly, Ser, or Thr
  SITE (582)..(582): Xaa at position 582 is Cys, Ala, Val, Gly, Ser, or Thr
  SITE (590)..(590): Xaa at position 590 is Cys, Ala, Val, Gly, Ser, or Thr
  SITE (612)..(612): Xaa at position 612 is Cys, Ala, Val, Gly, Ser, or Thr
  SITE (629)..(629): Xaa at position 629 is Ala, Gly, or Pro
  SITE (662)..(662): Xaa at position 662 is Cys, Ala, Val, Gly, Ser, or Thr
  SITE (672)..(672): Xaa at position 672 is Val, Ala, Gly, Leu, or Ile
  SITE (674)..(674): Xaa at position 674 is Tyr, Phe, Met, His, Ile, Leu, Val Ala, or Gly
  SITE (687)..(687): Xaa at position 687 is Ile, Ala, Val, Leu, or Gly
  SITE (689)..(689): Xaa at position 689 is Val, Ala, Gly, Leu, or Ile
MLGLRPPLLALVGLLSLGCVLSQEXTKFKXSSXREXXESGPGXTXXQKLNFTGPGDPDSIRXDTRPQXLMRGXAADDIMDPTSLAETQEDHNGGQKQXSPQKXTXYXRPGQAXAXNXTXRRAKGYPXDXXXXXDXSYSXLDDLRNXKKXGGDXXRXXNEITESGRXGXGSXXDKTVLPXXNTHPDKLRNPXPNKEKEXQPPFAXRHVLKLTNNSNQXQTEXGKQLXSGNLDAPEGGXDXXXQXXAXPEEXGWRNXTRXXXXXTDDGFHFAGDGKLGAXLTPNDGRCHLEDNLXKRSNEFDXPSVGQXAHKXAENNXQPXXXXTSRMVKTXEKXTEIXPKSXVGEXSEDSSNXVQLXKNXYNKLSSRXFXDHNALPDTXKVTXDSFCSNGVTHRNQPRGDXDGXQINVPXTXQXKXTXTECIQEQSXVXRXLGFTDIXTXQXLPQXECRCRDQSRDRSLXHGKGFLEXGICRCDTGYIGKNXEXQTQGRSSQELEGSXRKDNNSIIXSGLGDCVCGQCLCHTSDVPGKLIYGQYXECDTINCERYNGQVXGGPGRGLXFCGKCRCHPGFEGSXXQCERTTEGXLNPRRVEXSGRGRCRCNVCECHSGYQLPLXQECPGCPSPCGKYISCXECLKFEKGPFGKNCSAACPGLQLSNNPVKGRTXKERDSEGCWXAXTLEQQDGMDRYLXYXDESRECVAGPNIAAIVGGTVAGIVLIGILLLVIWKALIHLSDLREYRRFEKEKLKSQWNNDNPLFKSATTTVMNPKFAES

SEQ ID NO: 199 - protein, 153 aa, Homo sapiens
  SITE (31)..(31): Xaa at position 31 is Leu, Ala, Val, Gly, or Ile
  SITE (34)..(34): Xaa at position 34 is Ile, Ala, Val, Leu, or Gly
  SITE (38)..(38): Xaa at position 38 is Leu, Ala, Val, Gly, or Ile
  SITE (41)..(41): Xaa at position 41 is Leu, Ala, Val, Gly, or Ile
  SITE (48)..(48): Xaa at position 48 is Cys, Ala, Val, Gly, Ser, or Thr
  SITE (56)..(56): Xaa at position 56 is Ile, Ala, Val, Leu, or Gly
  SITE (69)..(69): Xaa at position 69 is Phe, Tyr, Met, His, Ile, Leu, Val Ala, or Gly
  SITE (70)..(70): Xaa at position 70 is Cys, Ala, Val, Gly, Ser, or Thr
  SITE (72)..(72): Xaa at position 72 is Ala, Gly, or Pro
  SITE (73)..(73): Xaa at position 73 is Ala, Gly, or Pro
  SITE (75)..(75): Xaa at position 75 is Val, Ala, Gly, Leu, or Ile
  SITE (76)..(76): Xaa at position 76 is Leu, Ala, Val, Gly, or Ile
  SITE (89)..(89): Xaa at position 89 is Cys, Ala, Val, Gly, Ser, or Thr
  SITE (100)..(100): Xaa at position 100 is His, Phe, Tyr, Lys, Arg, Gly, Ser Thr, Ala, Val, Leu, Ile, Asn, Met, or Gln
  SITE (103)..(103): Xaa at position 103 is Leu, Ala, Val, Gly, or Ile
  SITE (107)..(107): Xaa at position 107 is Leu, Ala, Val, Gly, or Ile
  SITE (110)..(110): Xaa at position 110 is Leu, Ala, Val, Gly, or Ile
  SITE (114)..(114): Xaa at position 114 is Leu, Ala, Val, Gly, or Ile
  SITE (118)..(118): Xaa at position 118 is Ala, Gly, or Pro
  SITE (133)..(133): Xaa at position 133 is Leu, Ala, Val, Gly, or Ile
  SITE (136)..(136): Xaa at position 136 is Phe, Tyr, Met, His, Ile, Leu, Val Ala, or Gly
  SITE (137)..(137): Xaa at position 137 is Leu, Ala, Val, Gly, or Ile
  SITE (140)..(140): Xaa at position 140 is Leu, Ala, Val, Gly, or Ile
  SITE (144)..(144): Xaa at position 144 is Met, Ile, Leu, Val, Ala, or Gly
MGLTSQLLPPLFFLLACAGNFVHGHKCDITXQEXIKTXNSXTEQKTLXTELTVTDXFAASKNTTEKETXXRXXTXXRQFYSHHEKDTRXLGATAQQFHRXKQXIRFXKRXDRNXWGLXGLNSCPVKEANQSTXENXXERXKTIXREKYSKCSS

SEQ ID NO: 200 - protein, 134 aa, Homo sapiens
  SITE (84)..(84): Xaa at position 84 is Val, Ala, Gly, Leu, or Ile
  SITE (87)..(87): Xaa at position 87 is Leu, Ala, Val, Gly, or Ile
  SITE (91)..(91): Xaa at position 91 is Leu, Ala, Val, Gly, or Ile
MRMLLHLSLLALGAAYVYAIPTEIPTSALVKETLALLSTHRTLLIANETLRIPVPVHKNHQLCTEEIFQGIGTLESQTVQGGTXERXFKNXSLIKKYIDGQKKKCGEERRRVNQFLDYLQEFLGVMNTEWIIES

SEQ ID NO: 201 - protein, 402 aa, Homo sapiens
  SITE (31)..(31): Xaa at position 31 is Val, Ala, Gly, Leu, or Ile
  SITE (32)..(32): Xaa at position 32 is Ala, Gly, or Pro
  SITE (35)..(35): Xaa at position 35 is Ala, Gly, or Pro
  SITE (38)..(38): Xaa at position 38 is Phe, Tyr, Met, His, Ile, Leu, Val Ala, or Gly
  SITE (40)..(40): Xaa at position 40 is Val, Ala, Gly, Leu, or Ile
  SITE (42)..(42): Xaa at position 42 is Val, Ala, Gly, Leu, or Ile
  SITE (43)..(43): Xaa at position 43 is Phe, Tyr, Met, His, Ile, Leu, Val Ala, or Gly
  SITE (46)..(46): Xaa at position 46 is Val, Ala, Gly, Leu, or Ile
  SITE (47)..(47): Xaa at position 47 is Ala, Gly, or Pro
  SITE (55)..(55): Xaa at position 55 is Val, Ala, Gly, Leu, or Ile
  SITE (56)..(56): Xaa at position 56 is Val, Ala, Gly, Leu, or Ile
  SITE (57)..(57): Xaa at position 57 is Phe, Tyr, Met, His, Ile, Leu, Val Ala, or Gly
  SITE (60)..(60): Xaa at position 60 is Tyr, Phe, Met, His, Ile, Leu, Val Ala, or Gly
  SITE (62)..(62): Xaa at position 62 is Val, Ala, Gly, Leu, or Ile
  SITE (63)..(63): Xaa at position 63 is Ala, Gly, or Pro
  SITE (65)..(65): Xaa at position 65 is Val, Ala, Gly, Leu, or Ile
  SITE (66)..(66): Xaa at position 66 is Leu, Ala, Val, Gly, or Ile
  SITE (67)..(67): Xaa at position 67 is Ala, Gly, or Pro
  SITE (68)..(68): Xaa at position 68 is Met, Ile, Leu, Val, Ala, or Gly
  SITE (69)..(69): Xaa at position 69 is Leu, Ala, Val, Gly, or Ile
  SITE (71)..(71): Xaa at position 71 is Leu, Ala, Val, Gly, or Ile
  SITE (81)..(81): Xaa at position 81 is Ile, Ala, Val, Leu, or Gly
  SITE (85)..(85): Xaa at position 85 is Met, Ile, Leu, Val, Ala, or Gly
  SITE (89)..(89): Xaa at position 89 is Ile, Ala, Val, Leu, or Gly
  SITE (94)..(94): Xaa at position 94 is Met, Ile, Leu, Val, Ala, or Gly
  SITE (95)..(95): Xaa at position 95 is Ala, Gly, or Pro
  SITE (101)..(101): Xaa at position 101 is Leu, Ala, Val, Gly, or Ile
  SITE (105)..(105): Xaa at position 105 is Leu, Ala, Val, Gly, or Ile
  SITE (114)..(114): Xaa at position 114 is Ile, Ala, Val, Leu, or Gly
  SITE (119)..(119): Xaa at position 119 is Ala, Gly, or Pro
  SITE (120)..(120): Xaa at position 120 is Ile, Ala, Val, Leu, or Gly
  SITE (121)..(121): Xaa at position 121 is Phe, Tyr, Met, His, Ile, Leu, Val Ala, or Gly
  SITE (122)..(122): Xaa at position 122 is Val, Ala, Gly, Leu, or Ile
  SITE (128)..(128): Xaa at position 128 is Leu, Ala, Val, Gly, or Ile
  SITE (132)..(132): Xaa at position 132 is Phe, Tyr, Met, His, Ile, Leu, Val Ala, or Gly
  SITE (136)..(136): Xaa at position 136 is Phe, Tyr, Met, His, Ile, Leu, Val Ala, or Gly
  SITE (140)..(140): Xaa at position 140 is Phe, Tyr, Met, His, Ile, Leu, Val Ala, or Gly
  SITE (144)..(144): Xaa at position 144 is Val, Ala, Gly, Leu, or Ile
  SITE (147)..(147): Xaa at position 147 is Val, Ala, Gly, Leu, or Ile
  SITE (149)..(149): Xaa at position 149 is Phe, Tyr, Met, His, Ile, Leu, Val Ala, or Gly
  SITE (155)..(155): Xaa at position 155 is Ala, Gly, or Pro
  SITE (159)..(159): Xaa at position 159 is Ile, Ala, Val, Leu, or Gly
  SITE (163)..(163): Xaa at position 163 is Val, Ala, Gly, Leu, or Ile
  SITE (171)..(171): Xaa at position 171 is Ile, Ala, Val, Leu, or Gly
  SITE (174)..(174): Xaa at position 174 is Leu, Ala, Val, Gly, or Ile
  SITE (175)..(175): Xaa at position 175 is Leu, Ala, Val, Gly, or Ile
  SITE (180)..(180): Xaa at position 180 is Val, Ala, Gly, Leu, or Ile
  SITE (186)..(186): Xaa at position 186 is Leu, Ala, Val, Gly, or Ile
  SITE (187)..(187): Xaa at position 187 is Val, Ala, Gly, Leu, or Ile
  SITE (188)..(188): Xaa at position 188 is Leu, Ala, Val, Gly, or Ile
  SITE (189)..(189): Xaa at position 189 is Val, Ala, Gly, Leu, or Ile
  SITE (191)..(191): Xaa at position 191 is Ala, Gly, or Pro
  SITE (192)..(192): Xaa at position 192 is Leu, Ala, Val, Gly, or Ile
  SITE (194)..(194): Xaa at position 194 is Phe, Tyr, Met, His, Ile, Leu, Val Ala, or Gly
  SITE (198)..(198): Xaa at position 198 is Trp, Tyr, Phe, Met, His, Ile, Leu Val, Ala, or Gly
  SITE (202)..(202): Xaa at position 202 is Phe, Tyr, Met, His, Ile, Leu, Val Ala, or Gly
  SITE (211)..(211): Xaa at position 211 is Leu, Ala, Val, Gly, or Ile
  SITE (212)..(212): Xaa at position 212 is Phe, Tyr, Met, His, Ile, Leu, Val Ala, or Gly
  SITE (224)..(224): Xaa at position 224 is Met, Ile, Leu, Val, Ala, or Gly
  SITE (225)..(225): Xaa at position 225 is Met, Ile, Leu, Val, Ala, or Gly
  SITE (231)..(231): Xaa at position 231 is Phe, Tyr, Met, His, Ile, Leu, Val Ala, or Gly
  SITE (244)..(244): Xaa at position 244 is Tyr, Phe, Met, His, Ile, Leu, Val Ala, or Gly
  SITE (246)..(246): Xaa at position 246 is Ile, Ala, Val, Leu, or Gly
  SITE (247)..(247): Xaa at position 247 is Leu, Ala, Val, Gly, or Ile
  SITE (249)..(249): Xaa at position 249 is Leu, Ala, Val, Gly, or Ile
  SITE (251)..(251): Xaa at position 251 is Tyr, Phe, Met, His, Ile, Leu, Val Ala, or Gly
  SITE (256)..(256): Xaa at position 256 is Leu, Ala, Val, Gly, or Ile
  SITE (258)..(258): Xaa at position 258 is Met, Ile, Leu, Val, Ala, or Gly
  SITE (259)..(259): Xaa at position 259 is Phe, Tyr, Met, His, Ile, Leu, Val Ala, or Gly
  SITE (260)..(260): Xaa at position 260 is Ile, Ala, Val, Leu, or Gly
  SITE (261)..(261): Xaa at position 261 is Ala, Gly, or Pro
  SITE (262)..(262): Xaa at position 262 is Ala, Gly, or Pro
  SITE (270)..(270): Xaa at position 270 is Leu, Ala, Val, Gly, or Ile
  SITE (273)..(273): Xaa at position 273 is Leu, Ala, Val, Gly, or Ile
  SITE (277)..(277): Xaa at position 277 is Leu, Ala, Val, Gly, or Ile
  SITE (279)..(279): Xaa at position 279 is Ala, Gly, or Pro
  SITE (282)..(282): Xaa at position 282 is Ile, Ala, Val, Leu, or Gly
  SITE (285)..(285): Xaa at position 285 is Trp, Tyr, Phe, Met, His, Ile, Leu Val, Ala, or Gly
  SITE (296)..(296): Xaa at position 296 is Leu, Ala, Val, Gly, or Ile
  SITE (297)..(297): Xaa at position 297 is Val, Ala, Gly, Leu, or Ile
  SITE (298)..(298): Xaa at position 298 is Leu, Ala, Val, Gly, or Ile
  SITE (301)..(301): Xaa at position 301 is Phe, Tyr, Met, His, Ile, Leu, Val Ala, or Gly
  SITE (307)..(307): Xaa at position 307 is Val, Ala, Gly, Leu, or Ile
  SITE (309)..(309): Xaa at position 309 is Leu, Ala, Val, Gly, or Ile
  SITE (313)..(313): Xaa at position 313 is Leu, Ala, Val, Gly, or Ile
  SITE (316)..(316): Xaa at position 316 is Leu, Ala, Val, Gly, or Ile
  SITE (318)..(318): Xaa at position 318 is Met, Ile, Leu, Val, Ala, or Gly
  SITE (321)..(321): Xaa at position 321 is Met, Ile, Leu, Val, Ala, or Gly
  SITE (329)..(329): Xaa at position 329 is Phe, Tyr, Met, His, Ile, Leu, Val Ala, or Gly
  SITE (332)..(332): Xaa at position 332 is Leu, Ala, Val, Gly, or Ile
  SITE (338)..(338): Xaa at position 338 is Leu, Ala, Val, Gly, or Ile
  SITE (340)..(340): Xaa at position 340 is Val, Ala, Gly, Leu, or Ile
  SITE (343)..(343): Xaa at position 343 is Ala, Gly, or Pro
  SITE (344)..(344): Xaa at position 344 is Leu, Ala, Val, Gly, or Ile
  SITE (347)..(347): Xaa at position 347 is Val, Ala, Gly, Leu, or Ile
  SITE (349)..(349): Xaa at position 349 is Ile, Ala, Val, Leu, or Gly
  SITE (351)..(351): Xaa at position 351 is Val, Ala, Gly, Leu, or Ile
  SITE (358)..(358): Xaa at position 358 is Ala, Gly, or Pro
  SITE (363)..(363): Xaa at position 363 is Ala, Gly, or Pro
  SITE (364)..(364): Xaa at position 364 is Val, Ala, Gly, Leu, or Ile
  SITE (365)..(365): Xaa at position 365 is Ile, Ala, Val, Leu, or Gly
  SITE (366)..(366): Xaa at position 366 is Val, Ala, Gly, Leu, or Ile
  SITE (368)..(368): Xaa at position 368 is Ala, Gly, or Pro
  SITE (377)..(377): Xaa at position 377 is Met, Ile, Leu, Val, Ala, or Gly
  SITE (381)..(381): Xaa at position 381 is Phe, Tyr, Met, His, Ile, Leu, Val Ala, or Gly
  SITE (382)..(382): Xaa at position 382 is Leu, Ala, Val, Gly, or Ile
  SITE (383)..(383): Xaa at position 383 is Phe, Tyr, Met, His, Ile, Leu, Val Ala, or Gly
  SITE (384)..(384): Xaa at position 384 is Val, Ala, Gly, Leu, or Ile
  SITE (385)..(385): Xaa at position 385 is Val, Ala, Gly, Leu, or Ile
  SITE (387)..(387): Xaa at position 387 is His, Phe, Tyr, Lys, Arg, Gly, Ser Thr, Ala, Val, Leu, Ile, Asn, Met, or Gln
  SITE (393)..(393): Xaa at position 393 is Val, Ala, Gly, Leu, or Ile
  SITE (394)..(394): Xaa at position 394 is Leu, Ala, Val, Gly, or Ile
  SITE (395)..(395): Xaa at position 395 is Phe, Tyr, Met, His, Ile, Leu, Val Ala, or Gly
  SITE (396)..(396): Xaa at position 396 is Met, Ile, Leu, Val, Ala, or Gly
  SITE (399)..(399): Xaa at position 399 is Val, Ala, Gly, Leu, or Ile
  SITE (400)..(400): Xaa at position 400 is Met, Ile, Leu, Val, Ala, or Gly
MQMSPALTCLVLGLALVFGEGSAVHHPPSYXXHLXSDXGXRXXQQXXQASKDRNXXXSPXGXXSXXXXXQXTTGGETQQQXQAAXGFKXDDKGXXPALRHXYKEXMGPWNKDEXSTTDXXXXQRDLKXVQGXMPHXFRLXRSTXKQXDXSEVERXRFIXNDWXKTHTKGMXSNXXGKGAXDQLTRXXXXNXXYXNGQXKTPXPDSSTHRRXXHKSDGSTVSVPXXAQTNKXNYTEFTTPDGHYXDXXEXPXHGDTXSXXXXXPYEKEVPXSAXTNIXSXQLXSHXKGNMTRLPRLXXXPKXSLETEXDXRKPXENXGXTDXFRQFQADXTSXSDQEPXHXAQXXQKXKXEXNESGTVXSSSTXXXXSXRMAPEEIIXDRPXXXXXRXNPTGTXXXXGQXXEP

SEQ ID NO: 202 - protein, 697 aa, Homo sapiens
  SITE (120)..(120): Xaa at position 120 is Leu, Ala, Val, Gly, or Ile
  SITE (386)..(386): Xaa at position 386 is Val, Ala, Gly, Leu, or Ile
  SITE (461)..(461): Xaa at position 461 is Ala, Gly, or Pro
  SITE (476)..(476): Xaa at position 476 is Ile, Ala, Val, Leu, or Gly
  SITE (538)..(538): Xaa at position 538 is Trp, Tyr, Phe, Met, His, Ile, Leu Val, Ala, or Gly
  SITE (544)..(544): Xaa at position 544 is Leu, Ala, Val, Gly, or Ile
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSXLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDXIVQDDDVDCTLVEKRVLALGGRGPGGRPHFLTQLHSTFQTPDRLYFVMEYVTGGDLMYHIQQLGKFKEPHAAFYXAEIAIGLFFLHNQGXIYRDLKLDNVMLDAEGHIKITDFGMCKENVFPGTTTRTFCGTPDYIAPEIIAYQPYGKSVDXWSFGVXLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 203 - protein, 500 aa, Homo sapiens
  SITE (142)..(142): Xaa at position 142 is Leu, Ala, Val, Gly, or Ile
  SITE (145)..(145): Xaa at position 145 is Ala, Gly, or Pro
  SITE (149)..(149): Xaa at position 149 is Phe, Tyr, Met, His, Ile, Leu, Val Ala, or Gly
  SITE (153)..(153): Xaa at position 153 is Leu, Ala, Val, Gly, or Ile
  SITE (154)..(154): Xaa at position 154 is Tyr, Phe, Met, His, Ile, Leu, Val Ala, or Gly
  SITE (168)..(168): Xaa at position 168 is Ala, Gly, or Pro
  SITE (169)..(169): Xaa at position 169 is Phe, Tyr, Met, His, Ile, Leu, Val Ala, or Gly
  SITE (174)..(174): Xaa at position 174 is Ile, Ala, Val, Leu, or Gly
  SITE (175)..(175): Xaa at position 175 is Ala, Gly, or Pro
  SITE (177)..(177): Xaa at position 177 is Leu, Ala, Val, Gly, or Ile
  SITE (178)..(178): Xaa at position 178 is Leu, Ala, Val, Gly, or Ile
  SITE (193)..(193): Xaa at position 193 is Leu, Ala, Val, Gly, or Ile
  SITE (197)..(197): Xaa at position 197 is Leu, Ala, Val, Gly, or Ile
  SITE (213)..(213): Xaa at position 213 is Phe, Tyr, Met, His, Ile, Leu, Val Ala, or Gly
  SITE (218)..(218): Xaa at position 218 is Val, Ala, Gly, Leu, or Ile
  SITE (224)..(224): Xaa at position 224 is Ile, Ala, Val, Leu, or Gly
  SITE (225)..(225): Xaa at position 225 is Phe, Tyr, Met, His, Ile, Leu, Val Ala, or Gly
  SITE (230)..(230): Xaa at position 230 is Leu, Ala, Val, Gly, or Ile
  SITE (236)..(236): Xaa at position 236 is Phe, Tyr, Met, His, Ile, Leu, Val Ala, or Gly
  SITE (262)..(262): Xaa at position 262 is Ile, Ala, Val, Leu, or Gly
  SITE (266)..(266): Xaa at position 266 is Val, Ala, Gly, Leu, or Ile
  SITE (274)..(274): Xaa at position 274 is Ile, Ala, Val, Leu, or Gly
  SITE (278)..(278): Xaa at position 278 is Leu, Ala, Val, Gly, or Ile
  SITE (281)..(281): Xaa at position 281 is Leu, Ala, Val, Gly, or Ile
  SITE (288)..(288): Xaa at position 288 is Val, Ala, Gly, Leu, or Ile
  SITE (290)..(290): Xaa at position 290 is Leu, Ala, Val, Gly, or Ile
  SITE (292)..(292): Xaa at position 292 is Ala, Gly, or Pro
  SITE (293)..(293): Xaa at position 293 is Ile, Ala, Val, Leu, or Gly
  SITE (295)..(295): Xaa at position 295 is Leu, Ala, Val, Gly, or Ile
  SITE (313)..(313): Xaa at position 313 is Phe, Tyr, Met, His, Ile, Leu, Val Ala, or Gly
  SITE (325)..(325): Xaa at position 325 is Met, Ile, Leu, Val, Ala, or Gly
  SITE (330)..(330): Xaa at position 330 is Tyr, Phe, Met, His, Ile, Leu, Val Ala, or Gly
  SITE (333)..(333): Xaa at position 333 is Ala, Gly, or Pro
  SITE (342)..(342): Xaa at position 342 is Ala, Gly, or Pro
  SITE (344)..(344): Xaa at position 344 is Val, Ala, Gly, Leu, or Ile
  SITE (347)..(347): Xaa at position 347 is Leu, Ala, Val, Gly, or Ile
  SITE (353)..(353): Xaa at position 353 is Leu, Ala, Val, Gly, or Ile
  SITE (355)..(355): Xaa at position 355 is Leu, Ala, Val, Gly, or Ile
  SITE (356)..(356): Xaa at position 356 is Val, Ala, Gly, Leu, or Ile
  SITE (370)..(370): Xaa at position 370 is Met, Ile, Leu, Val, Ala, or Gly
  SITE (374)..(374): Xaa at position 374 is Leu, Ala, Val, Gly, or Ile
  SITE (386)..(386): Xaa at position 386 is Leu, Ala, Val, Gly, or Ile
  SITE (409)..(409): Xaa at position 409 is Met, Ile, Leu, Val, Ala, or Gly
  SITE (413)..(413): Xaa at position 413 is Met, Ile, Leu, Val, Ala, or Gly
  SITE (430)..(430): Xaa at position 430 is Leu, Ala, Val, Gly, or Ile
  SITE (441)..(441): Xaa at position 441 is Met, Ile, Leu, Val, Ala, or Gly
  SITE (443)..(443): Xaa at position 443 is His, Phe, Tyr, Lys, Arg, Gly, Ser Thr, Ala, Val, Leu, Ile, Asn, Met, or Gln
  SITE (447)..(447): Xaa at position 447 is Leu, Ala, Val, Gly, or Ile
  SITE (449)..(449): Xaa at position 449 is Leu, Ala, Val, Gly, or Ile
  SITE (454)..(454): Xaa at position 454 is Val, Ala, Gly, Leu, or Ile
  SITE (456)..(456): Xaa at position 456 is Ala, Gly, or Pro
  SITE (457)..(457): Xaa at position 457 is Ala, Gly, or Pro
  SITE (458)..(458): Xaa at position 458 is Ala, Gly, or Pro
  SITE (459)..(459): Xaa at position 459 is Ala, Gly, or Pro
  SITE (461)..(461): Xaa at position 461 is Ala, Gly, or Pro
  SITE (478)..(478): Xaa at position 478 is Leu, Ala, Val, Gly, or Ile
  SITE (479)..(479): Xaa at position 479 is Phe, Tyr, Met, His, Ile, Leu, Val Ala, or Gly
  SITE (480)..(480): Xaa at position 480 is Val, Ala, Gly, Leu, or Ile
  SITE (481)..(481): Xaa at position 481 is Leu, Ala, Val, Gly, or Ile
  SITE (488)..(488): Xaa at position 488 is Phe, Tyr, Met, His, Ile, Leu, Val Ala, or Gly
  SITE (490)..(490): Xaa at position 490 is Val, Ala, Gly, Leu, or Ile
  SITE (491)..(491): Xaa at position 491 is Phe, Tyr, Met, His, Ile, Leu, Val Ala, or Gly
  SITE (492)..(492): Xaa at position 492 is Met, Ile, Leu, Val, Ala, or Gly
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVXGDXLVDXSLKXXHAFSAMKKVETNMXXSPFSXXSXXTQVLLGAGENTKTNXESIXSYPKDFTCVHQALKGXTTKGXTSVSQXXHSPDXAIRDTXVNASRTLYSSSPRVLSNNSDANLELXNTWXAKNTNNKXSRLXDSXPSDTRLXLXNXXYXSAKWKTTFDPKKTRMEPXHFKNSVIKVPMXNSKKXPVXHFIDQTLKXKXGQXQLSHNXSXXILVPQNLKHRLEDXEQAXSPSVFKAIMEKXEMSKFQPTLLTLPRIKVTTSQDXLSIXEKLEFFDFSYDLNLCGXTEDPDLQVSAXQXQTVXEXTETGXEXXXXSXISVARTLLVFEVQQPFXXXXWDQQHKXPXXXGRVYDPRA

SEQ ID NO: 204 - protein, 583 aa, Homo sapiens
  SITE (33)..(33): Xaa at position 33 is Cys, Ala, Val, Gly, Ser, or Thr
  SITE (74)..(74): Xaa at position 74 is Val, Ala, Gly, Leu, or Ile
  SITE (76)..(76): Xaa at position 76 is Ala, Gly, or Pro
  SITE (86)..(86): Xaa at position 86 is Cys, Ala, Val, Gly, Ser, or Thr
  SITE (100)..(100): Xaa at position 100 is Phe, Tyr, Met, His, Ile, Leu, Val Ala, or Gly
  SITE (129)..(129): Xaa at position 129 is Val, Ala, Gly, Leu, or Ile
  SITE (140)..(140): Xaa at position 140 is Ile, Ala, Val, Leu, or Gly
  SITE (150)..(150): Xaa at position 150 is Ala, Gly, or Pro
  SITE (152)..(152): Xaa at position 152 is Val, Ala, Gly, Leu, or Ile
  SITE (153)..(153): Xaa at position 153 is Ala, Gly, or Pro
  SITE (154)..(154): Xaa at position 154 is Cys, Ala, Val, Gly, Ser, or Thr
  SITE (163)..(163): Xaa at position 163 is Ala, Gly, or Pro
  SITE (181)..(181): Xaa at position 181 is Cys, Ala, Val, Gly, Ser, or Thr
  SITE (182)..(182): Xaa at position 182 is Leu, Ala, Val, Gly, or Ile
  SITE (184)..(184): Xaa at position 184 is Val, Ala, Gly, Leu, or Ile
  SITE (186)..(186): Xaa at position 186 is Cys, Ala, Val, Gly, Ser, or Thr
  SITE (193)..(193): Xaa at position 193 is Leu, Ala, Val, Gly, or Ile
  SITE (210)..(210): Xaa at position 210 is Ala, Gly, or Pro
  SITE (214)..(214): Xaa at position 214 is Cys, Ala, Val, Gly, Ser, or Thr
  SITE (229)..(229): Xaa at position 229 is Cys, Ala, Val, Gly, Ser, or Thr
  SITE (241)..(241): Xaa at position 241 is Cys, Ala, Val, Gly, Ser, or Thr
  SITE (247)..(247): Xaa at position 247 is Cys, Ala, Val, Gly, Ser, or Thr
  SITE (254)..(254): Xaa at position 254 is Leu, Ala, Val, Gly, or Ile
  SITE (256)..(256): Xaa at position 256 is Cys, Ala, Val, Gly, Ser, or Thr
  SITE (266)..(266): Xaa at position 266 is Cys, Ala, Val, Gly, Ser, or Thr
  SITE (357)..(357): Xaa at position 357 is Ile, Ala, Val, Leu, or Gly
  SITE (365)..(365): Xaa at position 365 is Cys, Ala, Val, Gly, Ser, or Thr
  SITE (368)..(368): Xaa at position 368 is Ile, Ala, Val, Leu, or Gly
  SITE (375)..(375): Xaa at position 375 is Ile, Ala, Val, Leu, or Gly
  SITE (376)..(376): Xaa at position 376 is Leu, Ala, Val, Gly, or Ile
  SITE (378)..(378): Xaa at position 378 is Ala, Gly, or Pro
  SITE (379)..(379): Xaa at position 379 is Ala, Gly, or Pro
  SITE (382)..(382): Xaa at position 382 is Leu, Ala, Val, Gly, or Ile
  SITE (430)..(430): Xaa at position 430 is Ile, Ala, Val, Leu, or Gly
  SITE (431)..(431): Xaa at position 431 is Ala, Gly, or Pro
  SITE (432)..(432): Xaa at position 432 is Leu, Ala, Val, Gly, or Ile
  SITE (433)..(433): Xaa at position 433 is Ile, Ala, Val, Leu, or Gly
  SITE (452)..(452): Xaa at position 452 is Ala, Gly, or Pro
  SITE (467)..(467): Xaa at position 467 is Cys, Ala, Val, Gly, Ser, or Thr
  SITE (491)..(491): Xaa at position 491 is Leu, Ala, Val, Gly, or Ile
  SITE (508)..(508): Xaa at position 508 is Met, Ile, Leu, Val, Ala, or Gly
  SITE (510)..(510): Xaa at position 510 is Cys, Ala, Val, Gly, Ser, or Thr
  SITE (511)..(511): Xaa at position 511 is Ala, Gly, or Pro
  SITE (529)..(529): Xaa at position 529 is Leu, Ala, Val, Gly, or Ile
  SITE (530)..(530): Xaa at position 530 is Val, Ala, Gly, Leu, or Ile
  SITE (531)..(531): Xaa at position 531 is Cys, Ala, Val, Gly, Ser, or Thr
  SITE (540)..(540): Xaa at position 540 is Val, Ala, Gly, Leu, or Ile
  SITE (541)..(541): Xaa at position 541 is Trp, Tyr, Phe, Met, His, Ile, Leu Val, Ala, or Gly
  SITE (543)..(543): Xaa at position 543 is Val, Ala, Gly, Leu, or Ile
  SITE (558)..(558): Xaa at position 558 is Val, Ala, Gly, Leu, or Ile
  SITE (562)..(562): Xaa at position 562 is Val, Ala, Gly, Leu, or Ile
MKLLHVFLLFLCFHLRFCKVTYTSQEDLVEKKXLAKKYTHLSCDKVFCQPWQRCIEGTCVCKLPYQCPKNGTAXCXTNRRSFPTYXQQKSLECLHPGTKXLNNGTCTAEGKFSVSLKHGNTDSEGIVEXKLVDQDKTMFXCKSSWSMREXNXXXLDLGFQQGXDTQRRFKLSDLSINSTEXXHXHXRGLETSXAECTFTKRRTMGYQDFXDVVXYTQKADSPMDDFFQXVNGKYISQMKAXDGINDXGDQSDEXCXKACQGKGFHXKSGVCIPSQYQCNGEVDCITGEDEVGCAGFASVTQEETEILTADMDAERRRIKSLLPKLSCGVKNRMHIRRKRIVGGKRAQLGDLPWQVAXKDASGITXGGXYIGGCWXXTXXHCXRASKTHRYQIWTTVVDWIHPDLKRIVIEYVDRIIFHENYNAGTYQNDXXXXEMKKDGNKKDCELPRSIPXCVPWSPYLFQPNDTXIVSGWGREKDNERVFSLQWGEVKXISNCSKFYGNRFYEKEXEXXGTYDGSIDACKGDSGGPXXXMDANNVTYXXGXVSWGENCGKPEFPGXYTKXANYFDWISYHVGRPFISQYNV

SEQ ID NO: 205 - protein, 524 aa, Homo sapiens
  SITE (46)..(46): Xaa at position 46 is Leu, Ala, Val, Gly, or Ile
  SITE (51)..(51): Xaa at position 51 is Ala, Gly, or Pro
  SITE (54)..(54): Xaa at position 54 is Val, Ala, Gly, Leu, or Ile
  SITE (55)..(55): Xaa at position 55 is Ile, Ala, Val, Leu, or Gly
  SITE (56)..(56): Xaa at position 56 is Met, Ile, Leu, Val, Ala, or Gly
  SITE (57)..(57): Xaa at position 57 is Phe, Tyr, Met, His, Ile, Leu, Val Ala, or Gly
  SITE (58)..(58): Xaa at position 58 is Leu, Ala, Val, Gly, or Ile
  SITE (69)..(69): Xaa at position 69 is Ala, Gly, or Pro
  SITE (70)..(70): Xaa at position 70 is Ala, Gly, or Pro
  SITE (87)..(87): Xaa at position 87 is Leu, Ala, Val, Gly, or Ile
  SITE (89)..(89): Xaa at position 89 is Met, Ile, Leu, Val, Ala, or Gly
  SITE (96)..(96): Xaa at position 96 is Ala, Gly, or Pro
  SITE (111)..(111): Xaa at position 111 is Ala, Gly, or Pro
  SITE (114)..(114): Xaa at position 114 is Ala, Gly, or Pro
  SITE (116)..(116): Xaa at position 116 is Ala, Gly, or Pro
  SITE (117)..(117): Xaa at position 117 is Tyr, Phe, Met, His, Ile, Leu, Val Ala, or Gly
  SITE (118)..(118): Xaa at position 118 is Leu, Ala, Val, Gly, or Ile
  SITE (123)..(123): Xaa at position 123 is Ala, Gly, or Pro
  SITE (128)..(128): Xaa at position 128 is Val, Ala, Gly, Leu, or Ile
  SITE (130)..(130): Xaa at position 130 is Val, Ala, Gly, Leu, or Ile
  SITE (150)..(150): Xaa at position 150 is Ile, Ala, Val, Leu, or Gly
  SITE (151)..(151): Xaa at position 151 is Leu, Ala, Val, Gly, or Ile
  SITE (154)..(154): Xaa at position 154 is Ala, Gly, or Pro
  SITE (161)..(161): Xaa at position 161 is Val, Ala, Gly, Leu, or Ile
  SITE (163)..(163): Xaa at position 163 is Ile, Ala, Val, Leu, or Gly
  SITE (164)..(164): Xaa at position 164 is Val, Ala, Gly, Leu, or Ile
  SITE (169)..(169): Xaa at position 169 is Val, Ala, Gly, Leu, or Ile
  SITE (172)..(172): Xaa at position 172 is Ala, Gly, or Pro
  SITE (179)..(179): Xaa at position 179 is Ala, Gly, or Pro
  SITE (182)..(182): Xaa at position 182 is Ala, Gly, or Pro
  SITE (192)..(192): Xaa at position 192 is Met, Ile, Leu, Val, Ala, or Gly
  SITE (196)..(196): Xaa at position 196 is Ala, Gly, or Pro
  SITE (204)..(204): Xaa at position 204 is Ile, Ala, Val, Leu, or Gly
  SITE (205)..(205): Xaa at position 205 is Ala, Gly, or Pro
  SITE (208)..(208): Xaa at position 208 is Leu, Ala, Val, Gly, or Ile
  SITE (209)..(209): Xaa at position 209 is Met, Ile, Leu, Val, Ala, or Gly
  SITE (215)..(215): Xaa at position 215 is Ile, Ala, Val, Leu, or Gly
  SITE (217)..(217): Xaa at position 217 is Val, Ala, Gly, Leu, or Ile
  SITE (218)..(218): Xaa at position 218 is Ile, Ala, Val, Leu, or Gly
  SITE (219)..(219): Xaa at position 219 is Met, Ile, Leu, Val, Ala, or Gly
  SITE (226)..(226): Xaa at position 226 is Met, Ile, Leu, Val, Ala, or Gly
  SITE (252)..(252): Xaa at position 252 is Leu, Ala, Val, Gly, or Ile
  SITE (253)..(253): Xaa at position 253 is Val, Ala, Gly, Leu, or Ile
  SITE (256)..(256): Xaa at position 256 is Trp, Tyr, Phe, Met, His, Ile, Leu Val, Ala, or Gly
  SITE (269)..(269): Xaa at position 269 is Ile, Ala, Val, Leu, or Gly
  SITE (275)..(275): Xaa at position 275 is Leu, Ala, Val, Gly, or Ile
  SITE (278)..(278): Xaa at position 278 is Leu, Ala, Val, Gly, or Ile
  SITE (283)..(283): Xaa at position 283 is Val, Ala, Gly, Leu, or Ile
  SITE (286)..(286): Xaa at position 286 is Leu, Ala, Val, Gly, or Ile
  SITE (287)..(287): Xaa at position 287 is Leu, Ala, Val, Gly, or Ile
  SITE (289)..(289): Xaa at position 289 is Leu, Ala, Val, Gly, or Ile
  SITE (290)..(290): Xaa at position 290 is Phe, Tyr, Met, His, Ile, Leu, Val Ala, or Gly
  SITE (295)..(295): Xaa at position 295 is Met, Ile, Leu, Val, Ala, or Gly
  SITE (312)..(312): Xaa at position 312 is Met, Ile, Leu, Val, Ala, or Gly
  SITE (315)..(315): Xaa at position 315 is Val, Ala, Gly, Leu, or Ile
  SITE (316)..(316): Xaa at position 316 is Ala, Gly, or Pro
  SITE (320)..(320): Xaa at position 320 is Leu, Ala, Val, Gly, or Ile
  SITE (327)..(327): Xaa at position 327 is Phe, Tyr, Met, His, Ile, Leu, Val Ala, or Gly
  SITE (328)..(328): Xaa at position 328 is Phe, Tyr, Met, His, Ile, Leu, Val Ala, or Gly
  SITE (329)..(329): Xaa at position 329 is Leu, Ala, Val, Gly, or Ile
  SITE (330)..(330): Xaa at position 330 is Leu, Ala, Val, Gly, or Ile
  SITE (331)..(331): Xaa at position 331 is Val, Ala, Gly, Leu, or Ile
  SITE (336)..(336): Xaa at position 336 is Ile, Ala, Val, Leu, or Gly
  SITE (340)..(340): Xaa at position 340 is His, Phe, Tyr, Lys, Arg, Gly, Ser Thr, Ala, Val, Leu, Ile, Asn, Met, or Gln
  SITE (345)..(345): Xaa at position 345 is Ala, Gly, or Pro
  SITE (348)..(348): Xaa at position 348 is Ala, Gly, or Pro
  SITE (349)..(349): Xaa at position 349 is Leu, Ala, Val, Gly, or Ile
  SITE (352)..(352): Xaa at position 352 is Ala, Gly, or Pro
  SITE (353)..(353): Xaa at position 353 is Val, Ala, Gly, Leu, or Ile
  SITE (355)..(355): Xaa at position 355 is Met, Ile, Leu, Val, Ala, or Gly
  SITE (358)..(358): Xaa at position 358 is Ala, Gly, or Pro
  SITE (359)..(359): Xaa at position 359 is Ile, Ala, Val, Leu, or Gly
  SITE (362)..(362): Xaa at position 362 is Ala, Gly, or Pro
  SITE (372)..(372): Xaa at position 372 is Leu, Ala, Val, Gly, or Ile
  SITE (374)..(374): Xaa at position 374 is Val, Ala, Gly, Leu, or Ile
  SITE (375)..(375): Xaa at position 375 is Val, Ala, Gly, Leu, or Ile
  SITE (377)..(377): Xaa at position 377 is Ala, Gly, or Pro
  SITE (379)..(379): Xaa at position 379 is His, Phe, Tyr, Lys, Arg, Gly, Ser Thr, Ala, Val, Leu, Ile, Asn, Met, or Gln
  SITE (395)..(395): Xaa at position 395 is Ile, Ala, Val, Leu, or Gly
  SITE (412)..(412): Xaa at position 412 is Ala, Gly, or Pro
  SITE (413)..(413): Xaa at position 413 is Ile, Ala, Val, Leu, or Gly
  SITE (459)..(459): Xaa at position 459 is Val, Ala, Gly, Leu, or Ile
  SITE (461)..(461): Xaa at position 461 is Val, Ala, Gly, Leu, or Ile
  SITE (468)..(468): Xaa at position 468 is Ala, Gly, or Pro
  SITE (471)..(471): Xaa at position 471 is Leu, Ala, Val, Gly, or Ile
  SITE (480)..(480): Xaa at position 480 is Val, Ala, Gly, Leu, or Ile
  SITE (483)..(483): Xaa at position 483 is Val, Ala, Gly, Leu, or Ile
  SITE (484)..(484): Xaa at position 484 is Met, Ile, Leu, Val, Ala, or Gly
  SITE (485)..(485): Xaa at position 485 is Ala, Gly, or Pro
  SITE (487)..(487): Xaa at position 487 is Ala, Gly, or Pro
  SITE (490)..(490): Xaa at position 490 is Ile, Ala, Val, Leu, or Gly
MISPFLVLAIGTCLTNSLVPEKEKDPKYWRDQAQETLKYALELQKXNTNVXKNXXXXXGDGMGVSTVTXXRILKGQLHHNPGEETRXEXDKFPFVXLSKTYNTNAQVPDSXGTXTXXXCGVKXNEGTXGXSAATERSRCNTTQGNEVTSXXRWXKDAGKSXGXXTTTRXNHXTPSAAYXHSXDRDWYSDNEXPPEXLSQGCKDXXYQXXHNIRDXDXXXGGGRKYXYPKNKTDVEYESDEKARGTRLDGLDXXDTXKSFKPRYKHSHFXWNRTEXLTXDPHNXDYXXGXXEPGDXQYELNRNNVTDPSLSEXVVXXIQIXRKNPKGXXXXXEGGRXDHGXHEGKXKQXXHEXXEXDRXXGQXGSLTSSEDTXTXXTXDXSHVFTFGGYTPRGNSXFGLAPMLSDTDKKPFTXXLYGNGPGYKVVGGERENVSMVDYAHNNYQAQSAVPLRHETHGGEDXAXFSKGPMXHLXHGVHEQNYXPHXXXYXACXGANLGHCAPASSAGSLAAGPLLLALALYPLSVLF

SEQ ID NO: 206 - protein, 212 aa, Homo sapiens
  SITE (53)..(53): Xaa at position 53 is Ile, Ala, Val, Leu, or Gly
  SITE (57)..(57): Xaa at position 57 is Ile, Ala, Val, Leu, or Gly
  SITE (60)..(60): Xaa at position 60 is Ile, Ala, Val, Leu, or Gly
  SITE (64)..(64): Xaa at position 64 is Ile, Ala, Val, Leu, or Gly
  SITE (67)..(67): Xaa at position 67 is Leu, Ala, Val, Gly, or Ile
  SITE (86)..(86): Xaa at position 86 is Ala, Gly, or Pro
  SITE (92)..(92): Xaa at position 92 is Leu, Ala, Val, Gly, or Ile
  SITE (111)..(111): Xaa at position 111 is Cys, Ala, Val, Gly, Ser, or Thr
  SITE (115)..(115): Xaa at position 115 is Ile, Ala, Val, Leu, or Gly
  SITE (116)..(116): Xaa at position 116 is Ile, Ala, Val, Leu, or Gly
  SITE (119)..(119): Xaa at position 119 is Leu, Ala, Val, Gly, or Ile
  SITE (122)..(122): Xaa at position 122 is Phe, Tyr, Met, His, Ile, Leu, Val Ala, or Gly
  SITE (124)..(124): Xaa at position 124 is Val, Ala, Gly, Leu, or Ile
  SITE (125)..(125): Xaa at position 125 is Tyr, Phe, Met, His, Ile, Leu, Val Ala, or Gly
  SITE (126)..(126): Xaa at position 126 is Leu, Ala, Val, Gly, or Ile
  SITE (128)..(128): Xaa at position 128 is Tyr, Phe, Met, His, Ile, Leu, Val Ala, or Gly
  SITE (129)..(129): Xaa at position 129 is Leu, Ala, Val, Gly, or Ile
  SITE (140)..(140): Xaa at position 140 is Ala, Gly, or Pro
  SITE (143)..(143): Xaa at position 143 is Val, Ala, Gly, Leu, or Ile
  SITE (150)..(150): Xaa at position 150 is Leu, Ala, Val, Gly, or Ile
  SITE (151)..(151): Xaa at position 151 is Ile, Ala, Val, Leu, or Gly
  SITE (154)..(154): Xaa at position 154 is Leu, Ala, Val, Gly, or Ile
  SITE (164)..(164): Xaa at position 164 is Ile, Ala, Val, Leu, or Gly
  SITE (179)..(179): Xaa at position 179 is Leu, Ala, Val, Gly, or Ile
  SITE (189)..(189): Xaa at position 189 is Met, Ile, Leu, Val, Ala, or Gly
  SITE (194)..(194): Xaa at position 194 is Ile, Ala, Val, Leu, or Gly
  SITE (195)..(195): Xaa at position 195 is Leu, Ala, Val, Gly, or Ile
  SITE (198)..(198): Xaa at position 198 is Phe, Tyr, Met, His, Ile, Leu, Val Ala, or Gly
  SITE (201)..(201): Xaa at position 201 is Phe, Tyr, Met, His, Ile, Leu, Val Ala, or Gly
  SITE (202)..(202): Xaa at position 202 is Leu, Ala, Val, Gly, or Ile
  SITE (208)..(208): Xaa at position 208 is Ala, Gly, or Pro
MNSFSTSAFGPVAFSLGLLLVLPAAFPAPVPPGEDSKDVAAPHRQPLTSSERXDKQXRYXLDGXSAXRKETCNKSNMCESSKEALXENNLNXPKMAEKDGCFQSGFNEETXLVKXXTGXLEXEXXXEXXQNRFESSEEQXRAXQMSTKVXXQFXQKKAKNLDAXTTPDPTTNASLLTKXQAQNQWLQDXTTHLXXRSXKEXXQSSLRXLRQM

SEQ ID NO: 207 - protein, 114 aa, Homo sapiens
  SITE (8)..(8): Xaa at position 8 is Ala, Gly, or Pro
  SITE (9)..(9): Xaa at position 9 is Cys, Ala, Val, Gly, Ser, or Thr
  SITE (13)..(13): Xaa at position 13 is Ala, Gly, or Pro
  SITE (16)..(16): Xaa at position 16 is Leu, Ala, Val, Gly, or Ile
  SITE (28)..(28): Xaa at position 28 is Ile, Ala, Val, Leu, or Gly
  SITE (32)..(32): Xaa at position 32 is Ile, Ala, Val, Leu, or Gly
  SITE (47)..(47): Xaa at position 47 is Phe, Tyr, Met, His, Ile, Leu, Val Ala, or Gly
MASVSELXXIYSXLIXHDDEVTVTEDKXNALXKAAGVNVEPFWPGLXAKALANVNIGSLICNVGAGGPAPAAGAAPAGGPAPSTAAAPAEEKKVEAKKEESEESDDDMGFGLFD

SEQ ID NO: 208 - protein, 457 aa, Rattus norvegicus
  SITE (222)..(222): Xaa at position 222 is Ala, Gly, or Pro
  SITE (224)..(224): Xaa at position 224 is Phe, Tyr, Met, His, Ile, Leu, Val Ala, or Gly
  SITE (226)..(226): Xaa at position 226 is Phe, Tyr, Met, His, Ile, Leu, Val Ala, or Gly
  SITE (239)..(239): Xaa at position 239 is Leu, Ala, Val, Gly, or Ile
  SITE (255)..(255): Xaa at position 255 is Phe, Tyr, Met, His, Ile, Leu, Val Ala, or Gly
  SITE (262)..(262): Xaa at position 262 is Val, Ala, Gly, Leu, or Ile
  SITE (283)..(283): Xaa at position 283 is Leu, Ala, Val, Gly, or Ile
  SITE (285)..(285): Xaa at position 285 is Ile, Ala, Val, Leu, or Gly
  SITE (293)..(293): Xaa at position 293 is Ala, Gly, or Pro
  SITE (298)..(298): Xaa at position 298 is Leu, Ala, Val, Gly, or Ile
  SITE (300)..(300): Xaa at position 300 is Leu, Ala, Val, Gly, or Ile
  SITE (311)..(311): Xaa at position 311 is Val, Ala, Gly, Leu, or Ile
  SITE (313)..(313): Xaa at position 313 is Leu, Ala, Val, Gly, or Ile
  SITE (314)..(314): Xaa at position 314 is Val, Ala, Gly, Leu, or Ile
  SITE (315)..(315): Xaa at position 315 is Val, Ala, Gly, Leu, or Ile
  SITE (316)..(316): Xaa at position 316 is Met, Ile, Leu, Val, Ala, or Gly
  SITE (326)..(326): Xaa at position 326 is Leu, Ala, Val, Gly, or Ile
  SITE (328)..(328): Xaa at position 328 is Cys, Ala, Val, Gly, Ser, or Thr
  SITE (330)..(330): Xaa at position 330 is Val, Ala, Gly, Leu, or Ile
  SITE (340)..(340): Xaa at position 340 is Leu, Ala, Val, Gly, or Ile
  SITE (342)..(342): Xaa at position 342 is Leu, Ala, Val, Gly, or Ile
  SITE (358)..(358): Xaa at position 358 is Ile, Ala, Val, Leu, or Gly
  SITE (368)..(368): Xaa at position 368 is Trp, Tyr, Phe, Met, His, Ile, Leu Val, Ala, or Gly
  SITE (370)..(370): Xaa at position 370 is Cys, Ala, Val, Gly, Ser, or Thr
MCRGFSFRHLLPLLLLQLSKLLVVTQGKTVVLGKEGGSAELPCESTSRRSASFAWKSSDQKTILGYKNKLLIKGSLELYSRFDSRKNAWERGSFPLIINKLRMEDSQTYVCELENKKEEVELWVFRVTFNPGTRLLQGQSLTLILDSNPKVSDPPIECKHKSSNIVKDSKAFSTHSLRIQDSGIWNCTVTLNQKKHSFDMKLSVLGFASTSITAYKSEGESXEXSXPLNLGEESLQGEXRWKAEKAPSSQSWITXSLKNQKXSVQKSTSNPKFQLSETLPLTXQXPQVSLQFXGSGNXTXTLDRGILYQEXNXXXXKVTQPDSNTXTXEXMGPTSPKMRXIXKQENQEARVSRQEKVXQVQAPEAGVXQXLLSEGEEVKMDSKIQVLSKGLNQTMFLAVVLGSAFSFLVFTGLCILFCVRCRHQQRQAARMSQIKRLLSEKKTCQCSHRMQKSHNLI

SEQ ID NO: 209 - protein, 798 aa, Homo sapiens
  SITE (27)..(27): Xaa at position 27 is Cys, Ala, Val, Gly, Ser, or Thr
  SITE (32)..(32): Xaa at position 32 is Ala, Gly, or Pro
  SITE (38)..(38): Xaa at position 38 is Cys, Ala, Val, Gly, Ser, or Thr
  SITE (39)..(39): Xaa at position 39 is Ile, Ala, Val, Leu, or Gly
  SITE (45)..(45): Xaa at position 45 is Cys, Ala, Val, Gly, Ser, or Thr
  SITE (64)..(64): Xaa at position 64 is Cys, Ala, Val, Gly, Ser, or Thr
  SITE (114)..(114): Xaa at position 114 is Ile, Ala, Val, Leu, or Gly
  SITE (119)..(119): Xaa at position 119 is Leu, Ala, Val, Gly, or Ile
  SITE (121)..(121): Xaa at position 121 is Leu, Ala, Val, Gly, or Ile
  SITE (123)..(123): Xaa at position 123 is Leu, Ala, Val, Gly, or Ile
  SITE (131)..(131): Xaa at position 131 is Phe, Tyr, Met, His, Ile, Leu, Val Ala, or Gly
  SITE (133)..(133): Xaa at position 133 is Leu, Ala, Val, Gly, or Ile
  SITE (143)..(143): Xaa at position 143 is Ile, Ala, Val, Leu, or Gly
  SITE (145)..(145): Xaa at position 145 is Leu, Ala, Val, Gly, or Ile
  SITE (146)..(146): Xaa at position 146 is Tyr, Phe, Met, His, Ile, Leu, Val Ala, or Gly
  SITE (147)..(147): Xaa at position 147 is Tyr, Phe, Met, His, Ile, Leu, Val Ala, or Gly
  SITE (148)..(148): Xaa at position 148 is Leu, Ala, Val, Gly, or Ile
  SITE (149)..(149): Xaa at position 149 is Met, Ile, Leu, Val, Ala, or Gly
  SITE (151)..(151): Xaa at position 151 is Leu, Ala, Val, Gly, or Ile
  SITE (155)..(155): Xaa at position 155 is Met, Ile, Leu, Val, Ala, or Gly
  SITE (162)..(162): Xaa at position 162 is Val, Ala, Gly, Leu, or Ile
  SITE (169)..(169): Xaa at position 169 is Leu, Ala, Val, Gly, or Ile
  SITE (173)..(173): Xaa at position 173 is Met, Ile, Leu, Val, Ala, or Gly
  SITE (182)..(182): Xaa at position 182 is Ile, Ala, Val, Leu, or Gly
  SITE (184)..(184): Xaa at position 184 is Phe, Tyr, Met, His, Ile, Leu, Val Ala, or Gly
  SITE (187)..(187): Xaa at position 187 is Phe, Tyr, Met, His, Ile, Leu, Val Ala, or Gly
  SITE (188)..(188): Xaa at position 188 is Val, Ala, Gly, Leu, or Ile
  SITE (195)..(195): Xaa at position 195 is Tyr, Phe, Met, His, Ile, Leu, Val Ala, or Gly
  SITE (196)..(196): Xaa at position 196 is Ile, Ala, Val, Leu, or Gly
  SITE (213)..(213): Xaa at position 213 is Cys, Ala, Val, Gly, Ser, or Thr
  SITE (219)..(219): Xaa at position 219 is Tyr, Phe, Met, His, Ile, Leu, Val Ala, or Gly
  SITE (232)..(232): Xaa at position 232 is Phe, Tyr, Met, His, Ile, Leu, Val Ala, or Gly
  SITE (236)..(236): Xaa at position 236 is Val, Ala, Gly, Leu, or Ile
  SITE (252)..(252): Xaa at position 252 is Phe, Tyr, Met, His, Ile, Leu, Val Ala, or Gly
  SITE (254)..(254): Xaa at position 254 is Ala, Gly, or Pro
  SITE (255)..(255): Xaa at position 255 is Ile, Ala, Val, Leu, or Gly
  SITE (256)..(256): Xaa at position 256 is Met, Ile, Leu, Val, Ala, or Gly
  SITE (258)..(258): Xaa at position 258 is Val, Ala, Gly, Leu, or Ile
  SITE (259)..(259): Xaa at position 259 is Ala, Gly, or Pro
  SITE (261)..(261): Xaa at position 261 is Cys, Ala, Val, Gly, Ser, or Thr
  SITE (265)..(265): Xaa at position 265 is Ile, Ala, Val, Leu, or Gly
  SITE (270)..(270): Xaa at position 270 is Val, Ala, Gly, Leu, or Ile
  SITE (273)..(273): Xaa at position 273 is Leu, Ala, Val, Gly, or Ile
  SITE (274)..(274): Xaa at position 274 is Leu, Ala, Val, Gly, or Ile
  SITE (275)..(275): Xaa at position 275 is Val, Ala, Gly, Leu, or Ile
  SITE (276)..(276): Xaa at position 276 is Phe, Tyr, Met, His, Ile, Leu, Val Ala, or Gly
  SITE (293)..(293): Xaa at position 293 is Ile, Ala, Val, Leu, or Gly
  SITE (316)..(316): Xaa at position 316 is Tyr, Phe, Met, His, Ile, Leu, Val Ala, or Gly
  SITE (322)..(322): Xaa at position 322 is Leu, Ala, Val, Gly, or Ile
  SITE (326)..(326): Xaa at position 326 is Leu, Ala, Val, Gly, or Ile
  SITE (331)..(331): Xaa at position 331 is Ile, Ala, Val, Leu, or Gly
  SITE (334)..(334): Xaa at position 334 is Ile, Ala, Val, Leu, or Gly
  SITE (335)..(335): Xaa at position 335 is Phe, Tyr, Met, His, Ile, Leu, Val Ala, or Gly
  SITE (336)..(336): Xaa at position 336 is Ala, Gly, or Pro
  SITE (337)..(337): Xaa at position 337 is Val, Ala, Gly, Leu, or Ile
  SITE (345)..(345): Xaa at position 345 is Tyr, Phe, Met, His, Ile, Leu, Val Ala, or Gly
  SITE (348)..(348): Xaa at position 348 is Leu, Ala, Val, Gly, or Ile
  SITE (352)..(352): Xaa at position 352 is Ile, Ala, Val, Leu, or Gly
  SITE (360)..(360): Xaa at position 360 is Leu, Ala, Val, Gly, or Ile
  SITE (367)..(367): Xaa at position 367 is Val, Ala, Gly, Leu, or Ile
  SITE (371)..(371): Xaa at position 371 is Ile, Ala, Val, Leu, or Gly
  SITE (372)..(372): Xaa at position 372 is Ile, Ala, Val, Leu, or Gly
  SITE (382)..(382): Xaa at position 382 is Val, Ala, Gly, Leu, or Ile
  SITE (384)..(384): Xaa at position 384 is Leu, Ala, Val, Gly, or Ile
  SITE (415)..(415): Xaa at position 415 is Cys, Ala, Val, Gly, Ser, or Thr
  SITE (418)..(418): Xaa at position 418 is Ile, Ala, Val, Leu, or Gly
  SITE (426)..(426): Xaa at position 426 is Phe, Tyr, Met, His, Ile, Leu, Val Ala, or Gly
  SITE (428)..(428): Xaa at position 428 is Ile, Ala, Val, Leu, or Gly
  SITE (430)..(430): Xaa at position 430 is Ile, Ala, Val, Leu, or Gly
  SITE (445)..(445): Xaa at position 445 is Ile, Ala, Val, Leu, or Gly
  SITE (454)..(454): Xaa at position 454 is Val, Ala, Gly, Leu, or Ile
  SITE (456)..(456): Xaa at position 456 is Val, Ala, Gly, Leu, or Ile
  SITE (458)..(458): Xaa at position 458 is Leu, Ala, Val, Gly, or Ile
MNLQPIFWIGLISSVCCVFAQTDENRXLKANXKSCGEXXQAGPNXGWCTNSTFLQEGMPTSARXDDLEALKKKGCPPDDIENPRGSKDIKKNKNVTNRSKGTAEKLKPEDITQXQPQQXVXRXRSGEPQTXTXKFKRAEDYPXDXXXXXDXSYSXKDDLENXKSLGTDXMNEXRRITSDFRXGXGSXXEKTVMPXXSTTPAKLRNPCTSEQNXTSPFSXKNVLSLTNKGEVXNELXGKQRISGNLDSPEGGXDXXXQXXVXGSLXGWRNXTRXXXXSTDAGFHFAGDGKLGGXVLPNDGQCHLENNMYTMSHYYDXPSIAHXVQKXSENNXQTXXXXTEEFQPVXKEXKNLXPKSAVGTXSANSSNXIQLXXDAYNSLSSEXIXENGKLSEGVTISYKSYCKNGVNGTGENGRKXSNXSIGDEVQXEXSXTSNKCPKKDSDSFKXRPLGFTEEXEXIXQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 210 - protein, 1441 aa, Human immunodeficiency virus 1
  group M subtype B (isolate MN) (HIV-1)
  SITE (8)..(8): Xaa at position 8 is Leu, Ala, Val, Gly, or Ile
  SITE (16)..(16): Xaa at position 16 is Trp, Tyr, Phe, Met, His, Ile, Leu Val, Ala, or Gly
  SITE (19)..(19): Xaa at position 19 is Ile, Ala, Val, Leu, or Gly
  SITE (21)..(21): Xaa at position 21 is Leu, Ala, Val, Gly, or Ile
  SITE (29)..(29): Xaa at position 29 is Tyr, Phe, Met, His, Ile, Leu, Val Ala, or Gly
  SITE (34)..(34): Xaa at position 34 is Val, Ala, Gly, Leu, or Ile
  SITE (37)..(37): Xaa at position 37 is Ala, Gly, or Pro
  SITE (41)..(41): Xaa at position 41 is Leu, Ala, Val, Gly, or Ile
  SITE (50)..(50): Xaa at position 50 is Leu, Ala, Val, Gly, or Ile
  SITE (51)..(51): Xaa at position 51 is Leu, Ala, Val, Gly, or Ile
  SITE (57)..(57): Xaa at position 57 is Cys, Ala, Val, Gly, Ser, or Thr
  SITE (60)..(60): Xaa at position 60 is Ile, Ala, Val, Leu, or Gly
  SITE (61)..(61): Xaa at position 61 is Leu, Ala, Val, Gly, or Ile
  SITE (64)..(64): Xaa at position 64 is Leu, Ala, Val, Gly, or Ile
  SITE (75)..(75): Xaa at position 75 is Leu, Ala, Val, Gly, or Ile
  SITE (78)..(78): Xaa at position 78 is Leu, Ala, Val, Gly, or Ile
  SITE (82)..(82): Xaa at position 82 is Val, Ala, Gly, Leu, or Ile
  SITE (83)..(83): Xaa at position 83 is Ala, Gly, or Pro
  SITE (85)..(85): Xaa at position 85 is Leu, Ala, Val, Gly, or Ile
  SITE (86)..(86): Xaa at position 86 is Tyr, Phe, Met, His, Ile, Leu, Val Ala, or Gly
  SITE (87)..(87): Xaa at position 87 is Cys, Ala, Val, Gly, Ser, or Thr
  SITE (88)..(88): Xaa at position 88 is Val, Ala, Gly, Leu, or Ile
  SITE (94)..(94): Xaa at position 94 is Ile, Ala, Val, Leu, or Gly
  SITE (100)..(100): Xaa at position 100 is Ala, Gly, or Pro
  SITE (104)..(104): Xaa at position 104 is Ile, Ala, Val, Leu, or Gly
  SITE (158)..(158): Xaa at position 158 is Trp, Tyr, Phe, Met, His, Ile, Leu Val, Ala, or Gly
  SITE (161)..(161): Xaa at position 161 is Val, Ala, Gly, Leu, or Ile
  SITE (162)..(162): Xaa at position 162 is Val, Ala, Gly, Leu, or Ile
  SITE (167)..(167): Xaa at position 167 is Phe, Tyr, Met, His, Ile, Leu, Val Ala, or Gly
  SITE (171)..(171): Xaa at position 171 is Val, Ala, Gly, Leu, or Ile
  SITE (172)..(172): Xaa at position 172 is Ile, Ala, Val, Leu, or Gly
  SITE (175)..(175): Xaa at position 175 is Phe, Tyr, Met, His, Ile, Leu, Val Ala, or Gly
  SITE (182)..(182): Xaa at position 182 is Ala, Gly, or Pro
  SITE (187)..(187): Xaa at position 187 is Leu, Ala, Val, Gly, or Ile
  SITE (190)..(190): Xaa at position 190 is Met, Ile, Leu, Val, Ala, or Gly
  SITE (191)..(191): Xaa at position 191 is Leu, Ala, Val, Gly, or Ile
  SITE (194)..(194): Xaa at position 194 is Val, Ala, Gly, Leu, or Ile
  SITE (199)..(199): Xaa at position 199 is Ala, Gly, or Pro
  SITE (200)..(200): Xaa at position 200 is Ala, Gly, or Pro
  SITE (204)..(204): Xaa at position 204 is Leu, Ala, Val, Gly, or Ile
  SITE (208)..(208): Xaa at position 208 is Ile, Ala, Val, Leu, or Gly
  SITE (212)..(212): Xaa at position 212 is Ala, Gly, or Pro
  SITE (239)..(239): Xaa at position 239 is Ile, Ala, Val, Leu, or Gly
  SITE (240)..(240): Xaa at position 240 is Ala, Gly, or Pro
  SITE (252)..(252): Xaa at position 252 is Trp, Tyr, Phe, Met, His, Ile, Leu Val, Ala, or Gly
  SITE (261)..(261): Xaa at position 261 is Val, Ala, Gly, Leu, or Ile
  SITE (265)..(265): Xaa at position 265 is Tyr, Phe, Met, His, Ile, Leu, Val Ala, or Gly
  SITE (269)..(269): Xaa at position 269 is Ile, Ala, Val, Leu, or Gly
  SITE (273)..(273): Xaa at position 273 is Leu, Ala, Val, Gly, or Ile
  SITE (276)..(276): Xaa at position 276 is Ile, Ala, Val, Leu, or Gly
  SITE (277)..(277): Xaa at position 277 is Val, Ala, Gly, Leu, or Ile
  SITE (285)..(285): Xaa at position 285 is Ile, Ala, Val, Leu, or Gly
  SITE (296)..(296): Xaa at position 296 is Phe, Tyr, Met, His, Ile, Leu, Val Ala, or Gly
  SITE (299)..(299): Xaa at position 299 is Tyr, Phe, Met, His, Ile, Leu, Val Ala, or Gly
  SITE (300)..(300): Xaa at position 300 is Val, Ala, Gly, Leu, or Ile
  SITE (303)..(303): Xaa at position 303 is Phe, Tyr, Met, His, Ile, Leu, Val Ala, or Gly
  SITE (304)..(304): Xaa at position 304 is Tyr, Phe, Met, His, Ile, Leu, Val Ala, or Gly
  SITE (307)..(307): Xaa at position 307 is Leu, Ala, Val, Gly, or Ile
  SITE (309)..(309): Xaa at position 309 is Ala, Gly, or Pro
  SITE (325)..(325): Xaa at position 325 is Leu, Ala, Val, Gly, or Ile
  SITE (333)..(333): Xaa at position 333 is Cys, Ala, Val, Gly, Ser, or Thr
  SITE (337)..(337): Xaa at position 337 is Leu, Ala, Val, Gly, or Ile
  SITE (350)..(350): Xaa at position 350 is Met, Ile, Leu, Val, Ala, or Gly
  SITE (353)..(353): Xaa at position 353 is Cys, Ala, Val, Gly, Ser, or Thr
  SITE (395)..(395): Xaa at position 395 is Cys, Ala, Val, Gly, Ser, or Thr
  SITE (405)..(405): Xaa at position 405 is Ala, Gly, or Pro
  SITE (416)..(416): Xaa at position 416 is Cys, Ala, Val, Gly, Ser, or Thr
  SITE (499)..(499): Xaa at position 499 is Leu, Ala, Val, Gly, or Ile
  SITE (507)..(507): Xaa at position 507 is Ile, Ala, Val, Leu, or Gly
  SITE (509)..(509): Xaa at position 509 is Ile, Ala, Val, Leu, or Gly
  SITE (516)..(516): Xaa at position 516 is Ala, Gly, or Pro
  SITE (518)..(518): Xaa at position 518 is Leu, Ala, Val, Gly, or Ile
  SITE (526)..(526): Xaa at position 526 is Val, Ala, Gly, Leu, or Ile
  SITE (527)..(527): Xaa at position 527 is Leu, Ala, Val, Gly, or Ile
  SITE (530)..(530): Xaa at position 530 is Met, Ile, Leu, Val, Ala, or Gly
  SITE (550)..(550): Xaa at position 550 is Val, Ala, Gly, Leu, or Ile
  SITE (553)..(553): Xaa at position 553 is Tyr, Phe, Met, His, Ile, Leu, Val Ala, or Gly
  SITE (556)..(556): Xaa at position 556 is Ile, Ala, Val, Leu, or Gly
  SITE (558)..(558): Xaa at position 558 is Ile, Ala, Val, Leu, or Gly
  SITE (560)..(560): Xaa at position 560 is Ile, Ala, Val, Leu, or Gly
  SITE (561)..(561): Xaa at position 561 is Cys, Ala, Val, Gly, Ser, or Thr
  SITE (565)..(565): Xaa at position 565 is Ala, Gly, or Pro
  SITE (569)..(569): Xaa at position 569 is Val, Ala, Gly, Leu, or Ile
  SITE (570)..(570): Xaa at position 570 is Leu, Ala, Val, Gly, or Ile
  SITE (571)..(571): Xaa at position 571 is Val, Ala, Gly, Leu, or Ile
  SITE (578)..(578): Xaa at position 578 is Ile, Ala, Val, Leu, or Gly
  SITE (579)..(579): Xaa at position 579 is Ile, Ala, Val, Leu, or Gly
  SITE (583)..(583): Xaa at position 583 is Leu, Ala, Val, Gly, or Ile
  SITE (584)..(584): Xaa at position 584 is Leu, Ala, Val, Gly, or Ile
  SITE (591)..(591): Xaa at position 591 is Leu, Ala, Val, Gly, or Ile
  SITE (603)..(603): Xaa at position 603 is Val, Ala, Gly, Leu, or Ile
  SITE (624)..(624): Xaa at position 624 is Ile, Ala, Val, Leu, or Gly
  SITE (626)..(626): Xaa at position 626 is Ala, Gly, or Pro
  SITE (627)..(627): Xaa at position 627 is Leu, Ala, Val, Gly, or Ile
  SITE (630)..(630): Xaa at position 630 is Ile, Ala, Val, Leu, or Gly
  SITE (631)..(631): Xaa at position 631 is Cys, Ala, Val, Gly, Ser, or Thr
  SITE (640)..(640): Xaa at position 640 is Ile, Ala, Val, Leu, or Gly
  SITE (643)..(643): Xaa at position 643 is Ile, Ala, Val, Leu, or Gly
  SITE (653)..(653): Xaa at position 653 is Val, Ala, Gly, Leu, or Ile
  SITE (654)..(654): Xaa at position 654 is Phe, Tyr, Met, His, Ile, Leu, Val Ala, or Gly
  SITE (655)..(655): Xaa at position 655 is Ala, Gly, or Pro
  SITE (656)..(656): Xaa at position 656 is Ile, Ala, Val, Leu, or Gly
  SITE (667)..(667): Xaa at position 667 is Leu, Ala, Val, Gly, or Ile
  SITE (668)..(668): Xaa at position 668 is Val, Ala, Gly, Leu, or Ile
  SITE (670)..(670): Xaa at position 670 is Phe, Tyr, Met, His, Ile, Leu, Val Ala, or Gly
  SITE (673)..(673): Xaa at position 673 is Leu, Ala, Val, Gly, or Ile
  SITE (683)..(683): Xaa at position 683 is Val, Ala, Gly, Leu, or Ile
  SITE (691)..(691): Xaa at position 691 is Ala, Gly, or Pro
  SITE (693)..(693): Xaa at position 693 is Leu, Ala, Val, Gly, or Ile
  SITE (699)..(699): Xaa at position 699 is Val, Ala, Gly, Leu, or Ile
  SITE (701)..(701): Xaa at position 701 is Val, Ala, Gly, Leu, or Ile
  SITE (702)..(702): Xaa at position 702 is Leu, Ala, Val, Gly, or Ile
  SITE (704)..(704): Xaa at position 704 is Val, Ala, Gly, Leu, or Ile
  SITE (707)..(707): Xaa at position 707 is Ala, Gly, or Pro
  SITE (708)..(708): Xaa at position 708 is Tyr, Phe, Met, His, Ile, Leu, Val Ala, or Gly
  SITE (709)..(709): Xaa at position 709 is Phe, Tyr, Met, His, Ile, Leu, Val Ala, or Gly
  SITE (711)..(711): Xaa at position 711 is Val, Ala, Gly, Leu, or Ile
  SITE (713)..(713): Xaa at position 713 is Leu, Ala, Val, Gly, or Ile
  SITE (717)..(717): Xaa at position 717 is Phe, Tyr, Met, His, Ile, Leu, Val Ala, or Gly
  SITE (722)..(722): Xaa at position 722 is Ala, Gly, or Pro
  SITE (723)..(723): Xaa at position 723 is Phe, Tyr, Met, His, Ile, Leu, Val Ala, or Gly
  SITE (725)..(725): Xaa at position 725 is Ile, Ala, Val, Leu, or Gly
  SITE (728)..(728): Xaa at position 728 is Ile, Ala, Val, Leu, or Gly
  SITE (737)..(737): Xaa at position 737 is Tyr, Phe, Met, His, Ile, Leu, Val Ala, or Gly
  SITE (739)..(739): Xaa at position 739 is Tyr, Phe, Met, His, Ile, Leu, Val Ala, or Gly
  SITE (741)..(741): Xaa at position 741 is Val, Ala, Gly, Leu, or Ile
  SITE (742)..(742): Xaa at position 742 is Leu, Ala, Val, Gly, or Ile
  SITE (746)..(746): Xaa at position 746 is Trp, Tyr, Phe, Met, His, Ile, Leu Val, Ala, or Gly
  SITE (751)..(751): Xaa at position 751 is Ala, Gly, or Pro
  SITE (752)..(752): Xaa at position 752 is Ile, Ala, Val, Leu, or Gly
  SITE (753)..(753): Xaa at position 753 is Phe, Tyr, Met, His, Ile, Leu, Val Ala, or Gly
  SITE (757)..(757): Xaa at position 757 is Met, Ile, Leu, Val, Ala, or Gly
  SITE (760)..(760): Xaa at position 760 is Ile, Ala, Val, Leu, or Gly
  SITE (761)..(761): Xaa at position 761 is Leu, Ala, Val, Gly, or Ile
  SITE (764)..(764): Xaa at position 764 is Phe, Tyr, Met, His, Ile, Leu, Val Ala, or Gly
  SITE (780)..(780): Xaa at position 780 is Leu, Ala, Val, Gly, or Ile
  SITE (781)..(781): Xaa at position 781 is Tyr, Phe, Met, His, Ile, Leu, Val Ala, or Gly
  SITE (782)..(782): Xaa at position 782 is Val, Ala, Gly, Leu, or Ile
  SITE (786)..(786): Xaa at position 786 is Leu, Ala, Val, Gly, or Ile
  SITE (791)..(791): Xaa at position 791 is His, Phe, Tyr, Lys, Arg, Gly, Ser Thr, Ala, Val, Leu, Ile, Asn, Met, or Gln
  SITE (795)..(795): Xaa at position 795 is Ile, Ala, Val, Leu, or Gly
  SITE (798)..(798): Xaa at position 798 is Leu, Ala, Val, Gly, or Ile
  SITE (801)..(801): Xaa at position 801 is His, Phe, Tyr, Lys, Arg, Gly, Ser Thr, Ala, Val, Leu, Ile, Asn, Met, or Gln
  SITE (802)..(802): Xaa at position 802 is Leu, Ala, Val, Gly, or Ile
  SITE (803)..(803): Xaa at position 803 is Leu, Ala, Val, Gly, or Ile
  SITE (807)..(807): Xaa at position 807 is Phe, Tyr, Met, His, Ile, Leu, Val Ala, or Gly
  SITE (820)..(820): Xaa at position 820 is Phe, Tyr, Met, His, Ile, Leu, Val Ala, or Gly
  SITE (822)..(822): Xaa at position 822 is Trp, Tyr, Phe, Met, His, Ile, Leu Val, Ala, or Gly
  SITE (823)..(823): Xaa at position 823 is Met, Ile, Leu, Val, Ala, or Gly
  SITE (825)..(825): Xaa at position 825 is Tyr, Phe, Met, His, Ile, Leu, Val Ala, or Gly
  SITE (827)..(827): Xaa at position 827 is Leu, Ala, Val, Gly, or Ile
  SITE (832)..(832): Xaa at position 832 is Trp, Tyr, Phe, Met, His, Ile, Leu Val, Ala, or Gly
  SITE (834)..(834): Xaa at position 834 is Val, Ala, Gly, Leu, or Ile
  SITE (839)..(839): Xaa at position 839 is Leu, Ala, Val, Gly, or Ile
  SITE (845)..(845): Xaa at position 845 is Trp, Tyr, Phe, Met, His, Ile, Leu Val, Ala, or Gly
  SITE (847)..(847): Xaa at position 847 is Val, Ala, Gly, Leu, or Ile
  SITE (850)..(850): Xaa at position 850 is Ile, Ala, Val, Leu, or Gly
  SITE (853)..(853): Xaa at position 853 is Leu, Ala, Val, Gly, or Ile
  SITE (857)..(857): Xaa at position 857 is Leu, Ala, Val, Gly, or Ile
  SITE (860)..(860): Xaa at position 860 is Ala, Gly, or Pro
  SITE (863)..(863): Xaa at position 863 is Ile, Ala, Val, Leu, or Gly
  SITE (864)..(864): Xaa at position 864 is Tyr, Phe, Met, His, Ile, Leu, Val Ala, or Gly
  SITE (867)..(867): Xaa at position 867 is Ile, Ala, Val, Leu, or Gly
  SITE (872)..(872): Xaa at position 872 is Leu, Ala, Val, Gly, or Ile
  SITE (876)..(876): Xaa at position 876 is Leu, Ala, Val, Gly, or Ile
  SITE (888)..(888): Xaa at position 888 is Leu, Ala, Val, Gly, or Ile
  SITE (892)..(892): Xaa at position 892 is Ala, Gly, or Pro
  SITE (896)..(896): Xaa at position 896 is Leu, Ala, Val, Gly, or Ile
  SITE (897)..(897): Xaa at position 897 is Ala, Gly, or Pro
  SITE (903)..(903): Xaa at position 903 is Leu, Ala, Val, Gly, or Ile
  SITE (918)..(918): Xaa at position 918 is Leu, Ala, Val, Gly, or Ile
  SITE (919)..(919): Xaa at position 919 is Ile, Ala, Val, Leu, or Gly
  SITE (920)..(920): Xaa at position 920 is Ala, Gly, or Pro
  SITE (922)..(922): Xaa at position 922 is Val, Ala, Gly, Leu, or Ile
  SITE (930)..(930): Xaa at position 930 is Trp, Tyr, Phe, Met, His, Ile, Leu Val, Ala, or Gly
  SITE (932)..(932): Xaa at position 932 is Tyr, Phe, Met, His, Ile, Leu, Val Ala, or Gly
  SITE (934)..(934): Xaa at position 934 is Ile, Ala, Val, Leu, or Gly
  SITE (942)..(942): Xaa at position 942 is Leu, Ala, Val, Gly, or Ile
  SITE (948)..(948): Xaa at position 948 is Ala, Gly, or Pro
  SITE (953)..(953): Xaa at position 953 is Ala, Gly, or Pro
  SITE (958)..(958): Xaa at position 958 is Val, Ala, Gly, Leu, or Ile
  SITE (961)..(961): Xaa at position 961 is Leu, Ala, Val, Gly, or Ile
  SITE (964)..(964): Xaa at position 964 is Ala, Gly, or Pro
  SITE (965)..(965): Xaa at position 965 is Val, Ala, Gly, Leu, or Ile
  SITE (968)..(968): Xaa at position 968 is Ile, Ala, Val, Leu, or Gly
  SITE (973)..(973): Xaa at position 973 is Ile, Ala, Val, Leu, or Gly
  SITE (974)..(974): Xaa at position 974 is Val, Ala, Gly, Leu, or Ile
  SITE (982)..(982): Xaa at position 982 is Phe, Tyr, Met, His, Ile, Leu, Val Ala, or Gly
  SITE (984)..(984): Xaa at position 984 is Leu, Ala, Val, Gly, or Ile
  SITE (986)..(986): Xaa at position 986 is Ile, Ala, Val, Leu, or Gly
  SITE (991)..(991): Xaa at position 991 is Trp, Tyr, Phe, Met, His, Ile, Leu Val, Ala, or Gly
  SITE (994)..(994): Xaa at position 994 is Trp, Tyr, Phe, Met, His, Ile, Leu Val, Ala, or Gly
  SITE (995)..(995): Xaa at position 995 is Trp, Tyr, Phe, Met, His, Ile, Leu Val, Ala, or Gly
  SITE (1000)..(1000): Xaa at position 1000 is undefined in the entry for UniProt ID P05961
  SITE (1001)..(1001): Xaa at position 1001 is Ala, Gly, or Pro
  SITE (1003)..(1003): Xaa at position 1003 is Trp, Tyr, Phe, Met, His, Ile Leu, Val, Ala, or Gly
  SITE (1004)..(1004): Xaa at position 1004 is Ile, Ala, Val, Leu, or Gly
  SITE (1007)..(1007): Xaa at position 1007 is Trp, Tyr, Phe, Met, His, Ile Leu, Val, Ala, or Gly
  SITE (1016)..(1016): Xaa at position 1016 is Val, Ala, Gly, Leu, or Ile
  SITE (1019)..(1019): Xaa at position 1019 is Trp, Tyr, Phe, Met, His, Ile Leu, Val, Ala, or Gly
  SITE (1027)..(1027): Xaa at position 1027 is Ile, Ala, Val, Leu, or Gly
  SITE (1033)..(1033): Xaa at position 1033 is Phe, Tyr, Met, His, Ile, Leu Val, Ala, or Gly
  SITE (1035)..(1035): Xaa at position 1035 is Val, Ala, Gly, Leu, or Ile
  SITE (1039)..(1039): Xaa at position 1039 is Ala, Gly, or Pro
  SITE (1048)..(1048): Xaa at position 1048 is Ala, Gly, or Pro
  SITE (1050)..(1050): Xaa at position 1050 is Tyr, Phe, Met, His, Ile, Leu Val, Ala, or Gly
  SITE (1062)..(1062): Xaa at position 1062 is Leu, Ala, Val, Gly, or Ile
  SITE (1072)..(1072): Xaa at position 1072 is Leu, Ala, Val, Gly, or Ile
  SITE (1074)..(1074): Xaa at position 1074 is Ala, Gly, or Pro
  SITE (1075)..(1075): Xaa at position 1075 is Ile, Ala, Val, Leu, or Gly
  SITE (1076)..(1076): Xaa at position 1076 is His, Phe, Tyr, Lys, Arg, Gly Ser, Thr, Ala, Val, Leu, Ile, Asn, Met, or Gln
  SITE (1077)..(1077): Xaa at position 1077 is Leu, Ala, Val, Gly, or Ile
  SITE (1078)..(1078): Xaa at position 1078 is Ala, Gly, or Pro
  SITE (1079)..(1079): Xaa at position 1079 is Leu, Ala, Val, Gly, or Ile
  SITE (1086)..(1086): Xaa at position 1086 is Val, Ala, Gly, Leu, or Ile
  SITE (1088)..(1088): Xaa at position 1088 is Ile, Ala, Val, Leu, or Gly
  SITE (1089)..(1089): Xaa at position 1089 is Val, Ala, Gly, Leu, or Ile
  SITE (1095)..(1095): Xaa at position 1095 is Ala, Gly, or Pro
  SITE (1099)..(1099): Xaa at position 1099 is Ile, Ala, Val, Leu, or Gly
  SITE (1111)..(1111): Xaa at position 1111 is Val, Ala, Gly, Leu, or Ile
  SITE (1114)..(1114): Xaa at position 1114 is Ile, Ala, Val, Leu, or Gly
  SITE (1115)..(1115): Xaa at position 1115 is Ile, Ala, Val, Leu, or Gly
  SITE (1118)..(1118): Xaa at position 1118 is Leu, Ala, Val, Gly, or Ile
  SITE (1124)..(1124): Xaa at position 1124 is Val, Ala, Gly, Leu, or Ile
  SITE (1126)..(1126): Xaa at position 1126 is Leu, Ala, Val, Gly, or Ile
  SITE (1141)..(1141): Xaa at position 1141 is Val, Ala, Gly, Leu, or Ile
  SITE (1145)..(1145): Xaa at position 1145 is Val, Ala, Gly, Leu, or Ile
  SITE (1161)..(1161): Xaa at position 1161 is Ala, Gly, or Pro
  SITE (1175)..(1175): Xaa at position 1175 is Met, Ile, Leu, Val, Ala, or Gly
  SITE (1186)..(1186): Xaa at position 1186 is Ala, Gly, or Pro
  SITE (1214)..(1214): Xaa at position 1214 is Trp, Tyr, Phe, Met, His, Ile Leu, Val, Ala, or Gly
  SITE (1225)..(1225): Xaa at position 1225 is Val, Ala, Gly, Leu, or Ile
  SITE (1226)..(1226): Xaa at position 1226 is Ile, Ala, Val, Leu, or Gly
  SITE (1227)..(1227): Xaa at position 1227 is Leu, Ala, Val, Gly, or Ile
  SITE (1229)..(1229): Xaa at position 1229 is Ala, Gly, or Pro
  SITE (1230)..(1230): Xaa at position 1230 is Val, Ala, Gly, Leu, or Ile
  SITE (1231)..(1231): Xaa at position 1231 is His, Phe, Tyr, Lys, Arg, Gly Ser, Thr, Ala, Val, Leu, Ile, Asn, Met, or Gln
  SITE (1237)..(1237): Xaa at position 1237 is Ile, Ala, Val, Leu, or Gly
  SITE (1253)..(1253): Xaa at position 1253 is Phe, Tyr, Met, His, Ile, Leu Val, Ala, or Gly
  SITE (1254)..(1254): Xaa at position 1254 is Leu, Ala, Val, Gly, or Ile
  SITE (1257)..(1257): Xaa at position 1257 is Leu, Ala, Val, Gly, or Ile
  SITE (1258)..(1258): Xaa at position 1258 is Ala, Gly, or Pro
  SITE (1279)..(1279): Xaa at position 1279 is Val, Ala, Gly, Leu, or Ile
  SITE (1283)..(1283): Xaa at position 1283 is Cys, Ala, Val, Gly, Ser, or Thr
  SITE (1311)..(1311): Xaa at position 1311 is Leu, Ala, Val, Gly, or Ile
  SITE (1314)..(1314): Xaa at position 1314 is Ile, Ala, Val, Leu, or Gly
  SITE (1328)..(1328): Xaa at position 1328 is Ala, Gly, or Pro
  SITE (1329)..(1329): Xaa at position 1329 is Val, Ala, Gly, Leu, or Ile
  SITE (1332)..(1332): Xaa at position 1332 is Ala, Gly, or Pro
  SITE (1333)..(1333): Xaa at position 1333 is Val, Ala, Gly, Leu, or Ile
  SITE (1344)..(1344): Xaa at position 1344 is Ile, Ala, Val, Leu, or Gly
  SITE (1349)..(1349): Xaa at position 1349 is Ala, Gly, or Pro
  SITE (1353)..(1353): Xaa at position 1353 is Ile, Ala, Val, Leu, or Gly
  SITE (1358)..(1358): Xaa at position 1358 is Ala, Gly, or Pro
  SITE (1361)..(1361): Xaa at position 1361 is Ile, Ala, Val, Leu, or Gly
  SITE (1378)..(1378): Xaa at position 1378 is Val, Ala, Gly, Leu, or Ile
MGARASVXSGGELDRXENXRXRPGGKKKXKLKHXVWXSREXERFAVNPGXXETSEGXRQXXGQXQPSLQTGSEEXKSXYNTXXTXXXXHQKIEXKDTKEXLEKXEEEQNKSKKKAQQAAADTGNRGNSSQVSQNYPIVQNIEGQMVHQAISPRTLNAXVKXXEEKAXSPEXXPMXSALSEGXTPQDXNTXXNTXGGHQXXMQMXKETXNEEXAEWDRLHPVHAGPITPGQMREPRGSDXXGTTSTLQEQIGXMTNNPPIPXGEIXKRWXILGXNKXXRMYSPSSXLDIRQGPKEPXRDXXDRXXKTXRXEQASQEVKNRTTETLXVQNANPDXKTIXKALGPAATLEEMXTAXQGVGGPGHKARVLAEAMSQVTNSATIMMQRGNFRNQRKIIKXFNCGKEGHIXKNCRAPRKRGXWKCGKEGHQMKDCTERQANFLREDLAFLQGKAEFSSEQNRANSPTRRELQVWGRDNNSLSEAGEEAGDDRQGPVSFSFPQITXWQRPIVTXKXGGQLKEXLXDTGADDTXXGEXNLPRRWKPKMIGGIGGFIKXRQXDQXTXGXXGHKXIGTXXXGPTPVNXXGRNXXTQLGCTXNFPISPIETVPXKLKPGMDGPKVKQWPLTEEKXKXXIEXXTEMEKEGKXSKXGPENPYNTPXXXXKKKDSTKWRKXXDXREXNKKTQDFWEXQLGIPHPXGXKKKKSXTXXDXGDXXXSXPXDKDXRKYTXXTXPSXNNETPGIRXQXNXXPQGXKGSPXXXQSSXTKXXEPXRKQNPDIVIYQYMDDXXXGSDXEIGQXRAKXEEXRRXXXRWGXTTPDKKHQKEPPXLXXGXEXHPDKXTXQPIVXPEKDSXTXNDXQKXVGKXNWXSQXXAGXKVKQXCKLXRGTKALTEVIPXTEEXELEXXENREIXKEPVHGVYYDPSKDXXXEXQKQGQGQXTXQXYQEPFKNXKTGKYXRMRGXHTNDXKQXTEXXQKXATESXXIWGKTPKXRXPXQKETXETXXTEYTXXTXXPEXEVVNTPPLXKLXYQLEKEPXVGAETXYXDGAXNRETKKGKXGXVTNRGRQKVVSXTDTTNQKTEXQXXXXXXQDSGLEXNXXTDSQYXLGIXQAQPDKSESELXSQXXEQXIKKEKXYXAWVPAHKGIGGNEQXDKLXSAGIRKVLFLDGIDKXQEDHEKYHSNWRAXASDFNLPPIVXKEIVASCDKCQLKGEAMHGQVDCSPGIXQLDCTHLEGKXXXVXXXVASGYXEAEVIPAETGQETAYXXLKXXGRWPVKTIHTDNGPNFTSTTXKAAXWWTGIKQEFGIPYNPQSQGVIESMNKEXKKXIGQVRDQAEHLKRXXQMXXFIHNFKRKGGXGGYSXGERXVGIIXTDXQTKELQKQITKIQNFRXYYRDSRDPLWKGPAKLLWKGEGAVVIQDNNDIKVVPRRKAKVIRDYGKQTAGDDCVASRQDED

SEQ ID NO: 211 - protein, 1499 aa, Homo sapiens
  SITE (64)..(64): Xaa at position 64 is Cys, Ala, Val, Gly, Ser, or Thr
MMANWAEARPLLILIVLLGQFVSIKAQEEDEDEGYGEEIACTQNGQMYLNRDIWKPAPCQICVXDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 212 - protein, 495 aa, Homo sapiens
  SITE (33)..(33): Xaa at position 33 is Phe, Tyr, Met, His, Ile, Leu, Val Ala, or Gly
  SITE (35)..(35): Xaa at position 35 is Ala, Gly, or Pro
  SITE (44)..(44): Xaa at position 44 is Cys, Ala, Val, Gly, Ser, or Thr
  SITE (48)..(48): Xaa at position 48 is Leu, Ala, Val, Gly, or Ile
  SITE (50)..(50): Xaa at position 50 is Val, Ala, Gly, Leu, or Ile
  SITE (52)..(52): Xaa at position 52 is Leu, Ala, Val, Gly, or Ile
  SITE (59)..(59): Xaa at position 59 is Val, Ala, Gly, Leu, or Ile
  SITE (60)..(60): Xaa at position 60 is Cys, Ala, Val, Gly, Ser, or Thr
  SITE (64)..(64): Xaa at position 64 is Trp, Tyr, Phe, Met, His, Ile, Leu Val, Ala, or Gly
  SITE (77)..(77): Xaa at position 77 is Ala, Gly, or Pro
  SITE (80)..(80): Xaa at position 80 is Val, Ala, Gly, Leu, or Ile
  SITE (81)..(81): Xaa at position 81 is Cys, Ala, Val, Gly, Ser, or Thr
  SITE (90)..(90): Xaa at position 90 is Leu, Ala, Val, Gly, or Ile
  SITE (92)..(92): Xaa at position 92 is Leu, Ala, Val, Gly, or Ile
  SITE (105)..(105): Xaa at position 105 is Ile, Ala, Val, Leu, or Gly
  SITE (106)..(106): Xaa at position 106 is Ile, Ala, Val, Leu, or Gly
  SITE (107)..(107): Xaa at position 107 is Cys, Ala, Val, Gly, Ser, or Thr
  SITE (114)..(114): Xaa at position 114 is Phe, Tyr, Met, His, Ile, Leu, Val Ala, or Gly
  SITE (125)..(125): Xaa at position 125 is Cys, Ala, Val, Gly, Ser, or Thr
  SITE (128)..(128): Xaa at position 128 is Leu, Ala, Val, Gly, or Ile
  SITE (130)..(130): Xaa at position 130 is Leu, Ala, Val, Gly, or Ile
  SITE (132)..(132): Xaa at position 132 is Cys, Ala, Val, Gly, Ser, or Thr
  SITE (133)..(133): Xaa at position 133 is Leu, Ala, Val, Gly, or Ile
  SITE (289)..(289): Xaa at position 289 is Val, Ala, Gly, Leu, or Ile
  SITE (291)..(291): Xaa at position 291 is Val, Ala, Gly, Leu, or Ile
  SITE (300)..(300): Xaa at position 300 is Leu, Ala, Val, Gly, or Ile
  SITE (301)..(301): Xaa at position 301 is Cys, Ala, Val, Gly, Ser, or Thr
  SITE (312)..(312): Xaa at position 312 is Trp, Tyr, Phe, Met, His, Ile, Leu Val, Ala, or Gly
  SITE (315)..(315): Xaa at position 315 is Val, Ala, Gly, Leu, or Ile
  SITE (316)..(316): Xaa at position 316 is Cys, Ala, Val, Gly, Ser, or Thr
  SITE (321)..(321): Xaa at position 321 is Cys, Ala, Val, Gly, Ser, or Thr
  SITE (350)..(350): Xaa at position 350 is Cys, Ala, Val, Gly, Ser, or Thr
  SITE (360)..(360): Xaa at position 360 is Cys, Ala, Val, Gly, Ser, or Thr
  SITE (365)..(365): Xaa at position 365 is Val, Ala, Gly, Leu, or Ile
MPMGSLQPLATLYLLGMLVASCLGRLSWYDPDXQXRLTRSNSKXQGQXEXYXKDGWHMXXSQSXGRSSKQWEDPSQXSKXXQRLNCGVPXSXGPFLVTYTPQSSXXXYGQLGSXSNCSHSRNDMXHSXGXTXXEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTXEXRQGAQWAAXXDSSSARSSLRXEEXXREQQXGSVNSYRVLDAGDPTSRGLFCPHQKLSQXHELWERNSYXKKVFXTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 213 - protein, 1382 aa, Homo sapiens
  SITE (29)..(29): Xaa at position 29 is Leu, Ala, Val, Gly, or Ile
  SITE (35)..(35): Xaa at position 35 is Cys, Ala, Val, Gly, Ser, or Thr
  SITE (40)..(40): Xaa at position 40 is Ile, Ala, Val, Leu, or Gly
  SITE (47)..(47): Xaa at position 47 is Leu, Ala, Val, Gly, or Ile
  SITE (50)..(50): Xaa at position 50 is Leu, Ala, Val, Gly, or Ile
  SITE (53)..(53): Xaa at position 53 is Cys, Ala, Val, Gly, Ser, or Thr
  SITE (55)..(55): Xaa at position 55 is Val, Ala, Gly, Leu, or Ile
  SITE (56)..(56): Xaa at position 56 is Ile, Ala, Val, Leu, or Gly
  SITE (60)..(60): Xaa at position 60 is Leu, Ala, Val, Gly, or Ile
  SITE (65)..(65): Xaa at position 65 is Met, Ile, Leu, Val, Ala, or Gly
  SITE (81)..(81): Xaa at position 81 is Leu, Ala, Val, Gly, or Ile
  SITE (83)..(83): Xaa at position 83 is Met, Ile, Leu, Val, Ala, or Gly
  SITE (84)..(84): Xaa at position 84 is Ile, Ala, Val, Leu, or Gly
  SITE (88)..(88): Xaa at position 88 is Leu, Ala, Val, Gly, or Ile
  SITE (90)..(90): Xaa at position 90 is Leu, Ala, Val, Gly, or Ile
  SITE (93)..(93): Xaa at position 93 is Val, Ala, Gly, Leu, or Ile
  SITE (99)..(99): Xaa at position 99 is Leu, Ala, Val, Gly, or Ile
  SITE (102)..(102): Xaa at position 102 is Leu, Ala, Val, Gly, or Ile
  SITE (103)..(103): Xaa at position 103 is Phe, Tyr, Met, His, Ile, Leu, Val Ala, or Gly
  SITE (106)..(106): Xaa at position 106 is Leu, Ala, Val, Gly, or Ile
  SITE (108)..(108): Xaa at position 108 is Val, Ala, Gly, Leu, or Ile
  SITE (109)..(109): Xaa at position 109 is Ile, Ala, Val, Leu, or Gly
  SITE (119)..(119): Xaa at position 119 is Ala, Gly, or Pro
  SITE (120)..(120): Xaa at position 120 is Leu, Ala, Val, Gly, or Ile
  SITE (122)..(122): Xaa at position 122 is Ile, Ala, Val, Leu, or Gly
  SITE (125)..(125): Xaa at position 125 is Met, Ile, Leu, Val, Ala, or Gly
  SITE (128)..(128): Xaa at position 128 is Leu, Ala, Val, Gly, or Ile
  SITE (131)..(131): Xaa at position 131 is Leu, Ala, Val, Gly, or Ile
  SITE (133)..(133): Xaa at position 133 is Leu, Ala, Val, Gly, or Ile
  SITE (136)..(136): Xaa at position 136 is Leu, Ala, Val, Gly, or Ile
  SITE (144)..(144): Xaa at position 144 is Val, Ala, Gly, Leu, or Ile
  SITE (146)..(146): Xaa at position 146 is Ile, Ala, Val, Leu, or Gly
  SITE (152)..(152): Xaa at position 152 is Leu, Ala, Val, Gly, or Ile
  SITE (163)..(163): Xaa at position 163 is Ile, Ala, Val, Leu, or Gly
  SITE (164)..(164): Xaa at position 164 is Leu, Ala, Val, Gly, or Ile
  SITE (186)..(186): Xaa at position 186 is Cys, Ala, Val, Gly, Ser, or Thr
  SITE (209)..(209): Xaa at position 209 is Cys, Ala, Val, Gly, Ser, or Thr
  SITE (210)..(210): Xaa at position 210 is Trp, Tyr, Phe, Met, His, Ile, Leu Val, Ala, or Gly
  SITE (223)..(223): Xaa at position 223 is Cys, Ala, Val, Gly, Ser, or Thr
  SITE (228)..(228): Xaa at position 228 is Cys, Ala, Val, Gly, Ser, or Thr
  SITE (235)..(235): Xaa at position 235 is Cys, Ala, Val, Gly, Ser, or Thr
  SITE (239)..(239): Xaa at position 239 is Cys, Ala, Val, Gly, Ser, or Thr
  SITE (252)..(252): Xaa at position 252 is Cys, Ala, Val, Gly, Ser, or Thr
  SITE (254)..(254): Xaa at position 254 is Ala, Gly, or Pro
  SITE (275)..(275): Xaa at position 275 is Phe, Tyr, Met, His, Ile, Leu, Val Ala, or Gly
  SITE (278)..(278): Xaa at position 278 is Trp, Tyr, Phe, Met, His, Ile, Leu Val, Ala, or Gly
  SITE (286)..(286): Xaa at position 286 is Cys, Ala, Val, Gly, Ser, or Thr
  SITE (305)..(305): Xaa at position 305 is Val, Ala, Gly, Leu, or Ile
  SITE (326)..(326): Xaa at position 326 is Leu, Ala, Val, Gly, or Ile
  SITE (348)..(348): Xaa at position 348 is Ile, Ala, Val, Leu, or Gly
  SITE (354)..(354): Xaa at position 354 is Ala, Gly, or Pro
  SITE (357)..(357): Xaa at position 357 is Leu, Ala, Val, Gly, or Ile
  SITE (360)..(360): Xaa at position 360 is Cys, Ala, Val, Gly, Ser, or Thr
  SITE (363)..(363): Xaa at position 363 is Ile, Ala, Val, Leu, or Gly
  SITE (367)..(367): Xaa at position 367 is Leu, Ala, Val, Gly, or Ile
  SITE (369)..(369): Xaa at position 369 is Ile, Ala, Val, Leu, or Gly
  SITE (371)..(371): Xaa at position 371 is Ile, Ala, Val, Leu, or Gly
  SITE (381)..(381): Xaa at position 381 is Leu, Ala, Val, Gly, or Ile
  SITE (385)..(385): Xaa at position 385 is Leu, Ala, Val, Gly, or Ile
  SITE (388)..(388): Xaa at position 388 is Ile, Ala, Val, Leu, or Gly
  SITE (391)..(391): Xaa at position 391 is Ile, Ala, Val, Leu, or Gly
  SITE (394)..(394): Xaa at position 394 is Tyr, Phe, Met, His, Ile, Leu, Val Ala, or Gly
  SITE (395)..(395): Xaa at position 395 is Leu, Ala, Val, Gly, or Ile
  SITE (397)..(397): Xaa at position 397 is Ile, Ala, Val, Leu, or Gly
  SITE (406)..(406): Xaa at position 406 is Leu, Ala, Val, Gly, or Ile
  SITE (408)..(408): Xaa at position 408 is Phe, Tyr, Met, His, Ile, Leu, Val Ala, or Gly
  SITE (409)..(409): Xaa at position 409 is Phe, Tyr, Met, His, Ile, Leu, Val Ala, or Gly
  SITE (412)..(412): Xaa at position 412 is Leu, Ala, Val, Gly, or Ile
  SITE (415)..(415): Xaa at position 415 is Ile, Ala, Val, Leu, or Gly
  SITE (427)..(427): Xaa at position 427 is Phe, Tyr, Met, His, Ile, Leu, Val Ala, or Gly
  SITE (429)..(429): Xaa at position 429 is Ala, Gly, or Pro
  SITE (435)..(435): Xaa at position 435 is Leu, Ala, Val, Gly, or Ile
  SITE (438)..(438): Xaa at position 438 is Leu, Ala, Val, Gly, or Ile
  SITE (439)..(439): Xaa at position 439 is Trp, Tyr, Phe, Met, His, Ile, Leu Val, Ala, or Gly
  SITE (446)..(446): Xaa at position 446 is Leu, Ala, Val, Gly, or Ile
  SITE (448)..(448): Xaa at position 448 is Ile, Ala, Val, Leu, or Gly
  SITE (453)..(453): Xaa at position 453 is Leu, Ala, Val, Gly, or Ile
  SITE (455)..(455): Xaa at position 455 is Phe, Tyr, Met, His, Ile, Leu, Val Ala, or Gly
  SITE (456)..(456): Xaa at position 456 is His, Phe, Tyr, Lys, Arg, Gly, Ser Thr, Ala, Val, Leu, Ile, Asn, Met, or Gln
  SITE (461)..(461): Xaa at position 461 is Leu, Ala, Val, Gly, or Ile
  SITE (466)..(466): Xaa at position 466 is Ile, Ala, Val, Leu, or Gly
  SITE (469)..(469): Xaa at position 469 is Met, Ile, Leu, Val, Ala, or Gly
  SITE (512)..(512): Xaa at position 512 is Ile, Ala, Val, Leu, or Gly
  SITE (514)..(514): Xaa at position 514 is Leu, Ala, Val, Gly, or Ile
  SITE (516)..(516): Xaa at position 516 is Trp, Tyr, Phe, Met, His, Ile, Leu Val, Ala, or Gly
  SITE (532)..(532): Xaa at position 532 is Leu, Ala, Val, Gly, or Ile
  SITE (537)..(537): Xaa at position 537 is Ala, Gly, or Pro
  SITE (580)..(580): Xaa at position 580 is Met, Ile, Leu, Val, Ala, or Gly
  SITE (591)..(591): Xaa at position 591 is Ile, Ala, Val, Leu, or Gly
  SITE (593)..(593): Xaa at position 593 is Val, Ala, Gly, Leu, or Ile
  SITE (608)..(608): Xaa at position 608 is Ala, Gly, or Pro
  SITE (638)..(638): Xaa at position 638 is Ile, Ala, Val, Leu, or Gly
  SITE (640)..(640): Xaa at position 640 is Leu, Ala, Val, Gly, or Ile
  SITE (657)..(657): Xaa at position 657 is Val, Ala, Gly, Leu, or Ile
  SITE (809)..(809): Xaa at position 809 is Ile, Ala, Val, Leu, or Gly
  SITE (820)..(820): Xaa at position 820 is Ile, Ala, Val, Leu, or Gly
  SITE (822)..(822): Xaa at position 822 is Leu, Ala, Val, Gly, or Ile
  SITE (824)..(824): Xaa at position 824 is Ala, Gly, or Pro
  SITE (825)..(825): Xaa at position 825 is Cys, Ala, Val, Gly, Ser, or Thr
  SITE (867)..(867): Xaa at position 867 is Val, Ala, Gly, Leu, or Ile
  SITE (868)..(868): Xaa at position 868 is His, Phe, Tyr, Lys, Arg, Gly, Ser Thr, Ala, Val, Leu, Ile, Asn, Met, or Gln
  SITE (886)..(886): Xaa at position 886 is Val, Ala, Gly, Leu, or Ile
  SITE (900)..(900): Xaa at position 900 is Val, Ala, Gly, Leu, or Ile
  SITE (911)..(911): Xaa at position 911 is Cys, Ala, Val, Gly, Ser, or Thr
  SITE (923)..(923): Xaa at position 923 is Val, Ala, Gly, Leu, or Ile
  SITE (925)..(925): Xaa at position 925 is Ile, Ala, Val, Leu, or Gly
  SITE (927)..(927): Xaa at position 927 is Ala, Gly, or Pro
  SITE (942)..(942): Xaa at position 942 is Phe, Tyr, Met, His, Ile, Leu, Val Ala, or Gly
  SITE (944)..(944): Xaa at position 944 is Val, Ala, Gly, Leu, or Ile
MATGGRRGAAAAPLLVAVAALLLGAAGHXYPGEVXPGMDXRNNLTRXHEXENXSXXEGHXQILLXFKTRPEDFRDLSFPKXIXXTDYXLXFRXYGLESXKDXXPNXTXXRGSRLFFNYXXVXFEXVHXKEXGXYNXMNITRGSXRXEKNNEXCYLATIDWSRXXDSVEDNYIVLNKDDNEECGDIXPGTAKGKTNCPATVINGQFVERXXTHSHCQKVCPTIXKSHGXTAEGLCXHSEXLGNCSQPDDPTKXVXCRNFYLDGRCVETCPPPYYHXQDXRCVNFSFXQDLHHKCKNSRRQGCHQYXIHNNKCIPECPSGYTMNSSNXLCTPCLGPCPKVCHLLEGEKTXDSVTSXQEXRGXTVXNGSXIXNXRGGNNLAAEXEANXGLXEEXSGXXKXRRSYALVSXSXXRKXRLXRGETLEIGNYSXYXLDNQNXRQXXDWSKHNXTXTQGKXFXXYNPKXCLSEXHKXEEVSGTKGRQERNDIALKTNGDQASCENELLKFSYIRTSFDKXLXRXEPYWPPDFRDLLGFMXFYKEXPYQNVTEFDGQDACGSNSWTVVDIDPPLRSNDPKSQNHPGWLXRGLKPWTQYAXFXKTLVTFSDERRTYGXKSDIIYVQTDATNPSVPLDPISVSNSSSQXIXKWKPPSDPNGNITHYLXFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVXSGLRHFTGYRXEXQXXNQDTPEERCSVAAYVSARTMPEAKADDIVGPVTHEIFENNVXXLMWQEPKEPNGLIVLYEXSYRRYGDEELHLCXSRKHFALERGXRLRGLSPGNYSXRXRXTSLAGNGSWTEPTYXYXTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 214 - protein, 509 aa, Homo sapiens
  SITE (66)..(66): Xaa at position 66 is Val, Ala, Gly, Leu, or Ile
  SITE (88)..(88): Xaa at position 88 is Leu, Ala, Val, Gly, or Ile
  SITE (100)..(100): Xaa at position 100 is Ala, Gly, or Pro
  SITE (111)..(111): Xaa at position 111 is Ile, Ala, Val, Leu, or Gly
  SITE (137)..(137): Xaa at position 137 is Ala, Gly, or Pro
  SITE (141)..(141): Xaa at position 141 is Leu, Ala, Val, Gly, or Ile
  SITE (151)..(151): Xaa at position 151 is Phe, Tyr, Met, His, Ile, Leu, Val Ala, or Gly
  SITE (152)..(152): Xaa at position 152 is Leu, Ala, Val, Gly, or Ile
  SITE (153)..(153): Xaa at position 153 is Ile, Ala, Val, Leu, or Gly
  SITE (165)..(165): Xaa at position 165 is Leu, Ala, Val, Gly, or Ile
  SITE (167)..(167): Xaa at position 167 is Val, Ala, Gly, Leu, or Ile
  SITE (183)..(183): Xaa at position 183 is Ile, Ala, Val, Leu, or Gly
  SITE (193)..(193): Xaa at position 193 is Ile, Ala, Val, Leu, or Gly
  SITE (205)..(205): Xaa at position 205 is Leu, Ala, Val, Gly, or Ile
  SITE (209)..(209): Xaa at position 209 is Tyr, Phe, Met, His, Ile, Leu, Val Ala, or Gly
  SITE (216)..(216): Xaa at position 216 is Leu, Ala, Val, Gly, or Ile
  SITE (220)..(220): Xaa at position 220 is Leu, Ala, Val, Gly, or Ile
  SITE (240)..(240): Xaa at position 240 is Val, Ala, Gly, Leu, or Ile
  SITE (245)..(245): Xaa at position 245 is Leu, Ala, Val, Gly, or Ile
  SITE (247)..(247): Xaa at position 247 is Leu, Ala, Val, Gly, or Ile
  SITE (270)..(270): Xaa at position 270 is Val, Ala, Gly, Leu, or Ile
  SITE (272)..(272): Xaa at position 272 is Val, Ala, Gly, Leu, or Ile
  SITE (275)..(275): Xaa at position 275 is Leu, Ala, Val, Gly, or Ile
  SITE (285)..(285): Xaa at position 285 is Phe, Tyr, Met, His, Ile, Leu, Val Ala, or Gly
  SITE (289)..(289): Xaa at position 289 is Ala, Gly, or Pro
  SITE (295)..(295): Xaa at position 295 is Leu, Ala, Val, Gly, or Ile
  SITE (300)..(300): Xaa at position 300 is Leu, Ala, Val, Gly, or Ile
  SITE (303)..(303): Xaa at position 303 is Leu, Ala, Val, Gly, or Ile
  SITE (305)..(305): Xaa at position 305 is Ala, Gly, or Pro
  SITE (306)..(306): Xaa at position 306 is Val, Ala, Gly, Leu, or Ile
  SITE (307)..(307): Xaa at position 307 is Val, Ala, Gly, Leu, or Ile
  SITE (312)..(312): Xaa at position 312 is Ile, Ala, Val, Leu, or Gly
  SITE (314)..(314): Xaa at position 314 is Ile, Ala, Val, Leu, or Gly
  SITE (315)..(315): Xaa at position 315 is Ile, Ala, Val, Leu, or Gly
  SITE (324)..(324): Xaa at position 324 is Leu, Ala, Val, Gly, or Ile
  SITE (328)..(328): Xaa at position 328 is Leu, Ala, Val, Gly, or Ile
  SITE (341)..(341): Xaa at position 341 is Leu, Ala, Val, Gly, or Ile
  SITE (342)..(342): Xaa at position 342 is Leu, Ala, Val, Gly, or Ile
  SITE (344)..(344): Xaa at position 344 is Met, Ile, Leu, Val, Ala, or Gly
  SITE (345)..(345): Xaa at position 345 is Ala, Gly, or Pro
  SITE (348)..(348): Xaa at position 348 is Ile, Ala, Val, Leu, or Gly
  SITE (349)..(349): Xaa at position 349 is Ala, Gly, or Pro
  SITE (352)..(352): Xaa at position 352 is Met, Ile, Leu, Val, Ala, or Gly
  SITE (355)..(355): Xaa at position 355 is Ile, Ala, Val, Leu, or Gly
  SITE (361)..(361): Xaa at position 361 is Ile, Ala, Val, Leu, or Gly
  SITE (362)..(362): Xaa at position 362 is His, Phe, Tyr, Lys, Arg, Gly, Ser Thr, Ala, Val, Leu, Ile, Asn, Met, or Gln
  SITE (365)..(365): Xaa at position 365 is Leu, Ala, Val, Gly, or Ile
  SITE (367)..(367): Xaa at position 367 is Ala, Gly, or Pro
  SITE (368)..(368): Xaa at position 368 is Ala, Gly, or Pro
  SITE (370)..(370): Xaa at position 370 is Ile, Ala, Val, Leu, or Gly
  SITE (372)..(372): Xaa at position 372 is Val, Ala, Gly, Leu, or Ile
  SITE (378)..(378): Xaa at position 378 is Cys, Ala, Val, Gly, Ser, or Thr
  SITE (380)..(380): Xaa at position 380 is Ile, Ala, Val, Leu, or Gly
  SITE (381)..(381): Xaa at position 381 is Ala, Gly, or Pro
  SITE (383)..(383): Xaa at position 383 is Phe, Tyr, Met, His, Ile, Leu, Val Ala, or Gly
  SITE (386)..(386): Xaa at position 386 is Ala, Gly, or Pro
  SITE (408)..(408): Xaa at position 408 is Ala, Gly, or Pro
  SITE (411)..(411): Xaa at position 411 is Ala, Gly, or Pro
  SITE (417)..(417): Xaa at position 417 is Phe, Tyr, Met, His, Ile, Leu, Val Ala, or Gly
  SITE (423)..(423): Xaa at position 423 is Val, Ala, Gly, Leu, or Ile
  SITE (424)..(424): Xaa at position 424 is Trp, Tyr, Phe, Met, His, Ile, Leu Val, Ala, or Gly
  SITE (426)..(426): Xaa at position 426 is Phe, Tyr, Met, His, Ile, Leu, Val Ala, or Gly
  SITE (428)..(428): Xaa at position 428 is Ile, Ala, Val, Leu, or Gly
  SITE (429)..(429): Xaa at position 429 is Leu, Ala, Val, Gly, or Ile
  SITE (430)..(430): Xaa at position 430 is Leu, Ala, Val, Gly, or Ile
  SITE (433)..(433): Xaa at position 433 is Ile, Ala, Val, Leu, or Gly
  SITE (449)..(449): Xaa at position 449 is Val, Ala, Gly, Leu, or Ile
  SITE (453)..(453): Xaa at position 453 is Leu, Ala, Val, Gly, or Ile
  SITE (465)..(465): Xaa at position 465 is Cys, Ala, Val, Gly, Ser, or Thr
  SITE (469)..(469): Xaa at position 469 is Leu, Ala, Val, Gly, or Ile
  SITE (473)..(473): Xaa at position 473 is Met, Ile, Leu, Val, Ala, or Gly
  SITE (476)..(476): Xaa at position 476 is Cys, Ala, Val, Gly, Ser, or Thr
  SITE (477)..(477): Xaa at position 477 is Trp, Tyr, Phe, Met, His, Ile, Leu Val, Ala, or Gly
  SITE (487)..(487): Xaa at position 487 is Phe, Tyr, Met, His, Ile, Leu, Val Ala, or Gly
  SITE (490)..(490): Xaa at position 490 is Leu, Ala, Val, Gly, or Ile
  SITE (493)..(493): Xaa at position 493 is Val, Ala, Gly, Leu, or Ile
  SITE (494)..(494): Xaa at position 494 is Leu, Ala, Val, Gly, or Ile
MGCGCSSHPEDDWMENIDVCENCHYPIVPLDGKGTLLIRNGSEVRDPLVTYEGSNPPASPLQDNLXIALHSYEPSHDGDLGFEKGEQXRILEQSGEWWKXQSLTTGQEGFXPFNFVAKANSLEPEPWFFKNLSRKDXERQXLAPGNTHGSXXXRESESTAGSFSXSXRDFDQNQGEVVKHYKXRNLDNGGFYXSPRITFPGLHEXVRHXTNASDGXCTRXSRPCQTQKPQKPWWEDEWEXPRETXKXVERLGAGQFGEVWMGYYNGHTKXAXKSXKQGSMSPDAXLAEXNLMKQXQHQRXVRXYXXXTQEPXYXXTEYMENGSXVDFXKTPSGIKLTINKXXDXXAQXXEGXAFXEERNYXXRDXRXXNXLXSDTLSXKXXDXGLXRLIEDNEYTAREGAKFPIKWTXPEXINYGTXTIKSDXXSXGXXXTEXVTHGRIPYPGMTNPEXIQNXERGYRMVRPDNXPEEXYQLXRLXXKERPEDRPTXDYXRSXXEDFFTATEGQYQPQP

SEQ ID NO: 215 - protein, 429 aa, Homo sapiens
  SITE (44)..(44): Xaa at position 44 is Trp, Tyr, Phe, Met, His, Ile, Leu Val, Ala, or Gly
  SITE (46)..(46): Xaa at position 46 is His, Phe, Tyr, Lys, Arg, Gly, Ser Thr, Ala, Val, Leu, Ile, Asn, Met, or Gln
  SITE (63)..(63): Xaa at position 63 is Cys, Ala, Val, Gly, Ser, or Thr
  SITE (64)..(64): Xaa at position 64 is Ile, Ala, Val, Leu, or Gly
  SITE (68)..(68): Xaa at position 68 is Leu, Ala, Val, Gly, or Ile
  SITE (69)..(69): Xaa at position 69 is Phe, Tyr, Met, His, Ile, Leu, Val Ala, or Gly
  SITE (72)..(72): Xaa at position 72 is Met, Ile, Leu, Val, Ala, or Gly
  SITE (73)..(73): Xaa at position 73 is Ala, Gly, or Pro
  SITE (76)..(76): Xaa at position 76 is Met, Ile, Leu, Val, Ala, or Gly
  SITE (81)..(81): Xaa at position 81 is Trp, Tyr, Phe, Met, His, Ile, Leu Val, Ala, or Gly
  SITE (86)..(86): Xaa at position 86 is Tyr, Phe, Met, His, Ile, Leu, Val Ala, or Gly
  SITE (89)..(89): Xaa at position 89 is Leu, Ala, Val, Gly, or Ile
  SITE (90)..(90): Xaa at position 90 is Cys, Ala, Val, Gly, Ser, or Thr
  SITE (91)..(91): Xaa at position 91 is Ile, Ala, Val, Leu, or Gly
  SITE (94)..(94): Xaa at position 94 is Cys, Ala, Val, Gly, Ser, or Thr
  SITE (95)..(95): Xaa at position 95 is Trp, Tyr, Phe, Met, His, Ile, Leu Val, Ala, or Gly
  SITE (96)..(96): Xaa at position 96 is Met, Ile, Leu, Val, Ala, or Gly
  SITE (120)..(120): Xaa at position 120 is Leu, Ala, Val, Gly, or Ile
  SITE (121)..(121): Xaa at position 121 is Ala, Gly, or Pro
  SITE (124)..(124): Xaa at position 124 is Val, Ala, Gly, Leu, or Ile
  SITE (129)..(129): Xaa at position 129 is Leu, Ala, Val, Gly, or Ile
  SITE (131)..(131): Xaa at position 131 is Leu, Ala, Val, Gly, or Ile
  SITE (133)..(133): Xaa at position 133 is Ile, Ala, Val, Leu, or Gly
  SITE (134)..(134): Xaa at position 134 is Tyr, Phe, Met, His, Ile, Leu, Val Ala, or Gly
  SITE (135)..(135): Xaa at position 135 is Ala, Gly, or Pro
  SITE (137)..(137): Xaa at position 137 is Val, Ala, Gly, Leu, or Ile
  SITE (152)..(152): Xaa at position 152 is Tyr, Phe, Met, His, Ile, Leu, Val Ala, or Gly
  SITE (156)..(156): Xaa at position 156 is Ala, Gly, or Pro
  SITE (159)..(159): Xaa at position 159 is Phe, Tyr, Met, His, Ile, Leu, Val Ala, or Gly
  SITE (164)..(164): Xaa at position 164 is Val, Ala, Gly, Leu, or Ile
  SITE (167)..(167): Xaa at position 167 is Leu, Ala, Val, Gly, or Ile
  SITE (169)..(169): Xaa at position 169 is Phe, Tyr, Met, His, Ile, Leu, Val Ala, or Gly
  SITE (180)..(180): Xaa at position 180 is Leu, Ala, Val, Gly, or Ile
  SITE (184)..(184): Xaa at position 184 is Tyr, Phe, Met, His, Ile, Leu, Val Ala, or Gly
  SITE (187)..(187): Xaa at position 187 is Met, Ile, Leu, Val, Ala, or Gly
  SITE (190)..(190): Xaa at position 190 is Ala, Gly, or Pro
  SITE (199)..(199): Xaa at position 199 is Val, Ala, Gly, Leu, or Ile
  SITE (200)..(200): Xaa at position 200 is Tyr, Phe, Met, His, Ile, Leu, Val Ala, or Gly
  SITE (202)..(202): Xaa at position 202 is Cys, Ala, Val, Gly, Ser, or Thr
  SITE (219)..(219): Xaa at position 219 is Ile, Ala, Val, Leu, or Gly
  SITE (223)..(223): Xaa at position 223 is Cys, Ala, Val, Gly, Ser, or Thr
  SITE (225)..(225): Xaa at position 225 is His, Phe, Tyr, Lys, Arg, Gly, Ser Thr, Ala, Val, Leu, Ile, Asn, Met, or Gln
  SITE (226)..(226): Xaa at position 226 is Trp, Tyr, Phe, Met, His, Ile, Leu Val, Ala, or Gly
  SITE (232)..(232): Xaa at position 232 is Ile, Ala, Val, Leu, or Gly
  SITE (239)..(239): Xaa at position 239 is Ile, Ala, Val, Leu, or Gly
  SITE (242)..(242): Xaa at position 242 is Ile, Ala, Val, Leu, or Gly
  SITE (243)..(243): Xaa at position 243 is Leu, Ala, Val, Gly, or Ile
  SITE (253)..(253): Xaa at position 253 is Ile, Ala, Val, Leu, or Gly
  SITE (262)..(262): Xaa at position 262 is Trp, Tyr, Phe, Met, His, Ile, Leu Val, Ala, or Gly
  SITE (267)..(267): Xaa at position 267 is Met, Ile, Leu, Val, Ala, or Gly
  SITE (268)..(268): Xaa at position 268 is Leu, Ala, Val, Gly, or Ile
  SITE (269)..(269): Xaa at position 269 is Val, Ala, Gly, Leu, or Ile
  SITE (270)..(270): Xaa at position 270 is Ile, Ala, Val, Leu, or Gly
  SITE (281)..(281): Xaa at position 281 is Val, Ala, Gly, Leu, or Ile
  SITE (284)..(284): Xaa at position 284 is Met, Ile, Leu, Val, Ala, or Gly
  SITE (285)..(285): Xaa at position 285 is Ala, Gly, or Pro
  SITE (286)..(286): Xaa at position 286 is Leu, Ala, Val, Gly, or Ile
  SITE (287)..(287): Xaa at position 287 is Trp, Tyr, Phe, Met, His, Ile, Leu Val, Ala, or Gly
  SITE (288)..(288): Xaa at position 288 is Ala, Gly, or Pro
  SITE (289)..(289): Xaa at position 289 is Ile, Ala, Val, Leu, or Gly
  SITE (290)..(290): Xaa at position 290 is Met, Ile, Leu, Val, Ala, or Gly
  SITE (291)..(291): Xaa at position 291 is Ala, Gly, or Pro
  SITE (292)..(292): Xaa at position 292 is Ala, Gly, or Pro
  SITE (294)..(294): Xaa at position 294 is Leu, Ala, Val, Gly, or Ile
  SITE (296)..(296): Xaa at position 296 is Met, Ile, Leu, Val, Ala, or Gly
  SITE (307)..(307): Xaa at position 307 is Ala, Gly, or Pro
  SITE (311)..(311): Xaa at position 311 is Leu, Ala, Val, Gly, or Ile
  SITE (316)..(316): Xaa at position 316 is Val, Ala, Gly, Leu, or Ile
  SITE (319)..(319): Xaa at position 319 is Ile, Ala, Val, Leu, or Gly
  SITE (337)..(337): Xaa at position 337 is Phe, Tyr, Met, His, Ile, Leu, Val Ala, or Gly
  SITE (339)..(339): Xaa at position 339 is Val, Ala, Gly, Leu, or Ile
  SITE (340)..(340): Xaa at position 340 is Trp, Tyr, Phe, Met, His, Ile, Leu Val, Ala, or Gly
  SITE (348)..(348): Xaa at position 348 is Ala, Gly, or Pro
  SITE (350)..(350): Xaa at position 350 is Ala, Gly, or Pro
  SITE (351)..(351): Xaa at position 351 is Val, Ala, Gly, Leu, or Ile
  SITE (352)..(352): Xaa at position 352 is Ala, Gly, or Pro
  SITE (353)..(353): Xaa at position 353 is Met, Ile, Leu, Val, Ala, or Gly
  SITE (354)..(354): Xaa at position 354 is Ile, Ala, Val, Leu, or Gly
  SITE (367)..(367): Xaa at position 367 is Ile, Ala, Val, Leu, or Gly
  SITE (369)..(369): Xaa at position 369 is Val, Ala, Gly, Leu, or Ile
  SITE (372)..(372): Xaa at position 372 is Leu, Ala, Val, Gly, or Ile
  SITE (377)..(377): Xaa at position 377 is Ala, Gly, or Pro
  SITE (378)..(378): Xaa at position 378 is Cys, Ala, Val, Gly, Ser, or Thr
  SITE (381)..(381): Xaa at position 381 is Ala, Gly, or Pro
  SITE (382)..(382): Xaa at position 382 is Cys, Ala, Val, Gly, Ser, or Thr
  SITE (384)..(384): Xaa at position 384 is Ile, Ala, Val, Leu, or Gly
  SITE (403)..(403): Xaa at position 403 is Leu, Ala, Val, Gly, or Ile
  SITE (407)..(407): Xaa at position 407 is Ile, Ala, Val, Leu, or Gly
  SITE (413)..(413): Xaa at position 413 is Val, Ala, Gly, Leu, or Ile
  SITE (414)..(414): Xaa at position 414 is Leu, Ala, Val, Gly, or Ile
  SITE (415)..(415): Xaa at position 415 is Leu, Ala, Val, Gly, or Ile
  SITE (417)..(417): Xaa at position 417 is Leu, Ala, Val, Gly, or Ile
MQLRNPELHLGCALALRFLALVSWDIPGARALDNGLARTPTMGXLXWERFMCNLDCQEEPDSXXSEKXXMEXXELXVSEGXKDAGXEYXXXDDXXXAPQRDSEGRLQADPQRFPHGIRQXXNYXHSKGXKXGXXXDXGNKTCAGFPGSFGYXDIDXQTXADWGXDLXKXDGCYCDSLENXADGXKHXSLXLNRTGRSIXXSXEWPLYMWPFQKPNYTEXRQYXNXXRNFADXDDSWKSXKSXXDWTSFNQERXVDVAGPGGXNDPDXXXXGNFGLSWNQQXTQXXXXXXXXXPXFXSNDLRHISPQXKALXQDKDXIAXNQDPLGKQGYQLRQGDNXEXXERPLSGLXWXXXXXNRQEIGGPRSYTXAXASXGKGVXXNPXXFXTQLLPVKRKLGFYEWTSRXRSHXNPTGTXXXQXENTMQMSLKDLL

SEQ ID NO: 216 - protein, 250 aa, Homo sapiens
  SITE (50)..(50): Xaa at position 50 is His, Phe, Tyr, Lys, Arg, Gly, Ser Thr, Ala, Val, Leu, Ile, Asn, Met, or Gln
  SITE (58)..(58): Xaa at position 58 is Phe, Tyr, Met, His, Ile, Leu, Val Ala, or Gly
  SITE (60)..(60): Xaa at position 60 is Val, Ala, Gly, Leu, or Ile
  SITE (78)..(78): Xaa at position 78 is Ala, Gly, or Pro
  SITE (87)..(87): Xaa at position 87 is Ala, Gly, or Pro
  SITE (89)..(89): Xaa at position 89 is Ile, Ala, Val, Leu, or Gly
  SITE (131)..(131): Xaa at position 131 is Leu, Ala, Val, Gly, or Ile
  SITE (132)..(132): Xaa at position 132 is Ile, Ala, Val, Leu, or Gly
  SITE (133)..(133): Xaa at position 133 is Cys, Ala, Val, Gly, Ser, or Thr
  SITE (135)..(135): Xaa at position 135 is Val, Ala, Gly, Leu, or Ile
  SITE (138)..(138): Xaa at position 138 is Ile, Ala, Val, Leu, or Gly
  SITE (147)..(147): Xaa at position 147 is Trp, Tyr, Phe, Met, His, Ile, Leu Val, Ala, or Gly
  SITE (174)..(174): Xaa at position 174 is Phe, Tyr, Met, His, Ile, Leu, Val Ala, or Gly
  SITE (177)..(177): Xaa at position 177 is Leu, Ala, Val, Gly, or Ile
  SITE (180)..(180): Xaa at position 180 is Val, Ala, Gly, Leu, or Ile
  SITE (187)..(187): Xaa at position 187 is Tyr, Phe, Met, His, Ile, Leu, Val Ala, or Gly
  SITE (189)..(189): Xaa at position 189 is Cys, Ala, Val, Gly, Ser, or Thr
  SITE (191)..(191): Xaa at position 191 is Val, Ala, Gly, Leu, or Ile
  SITE (193)..(193): Xaa at position 193 is His, Phe, Tyr, Lys, Arg, Gly, Ser Thr, Ala, Val, Leu, Ile, Asn, Met, or Gln
MALRAGLVLGFHTLMTLLSPQEAGATKADHMGSYGPAFYQSYGASGQFTXEFDEEQLXSXDLKKSEAVWRLPEFGDFXRFDPQGGLXGXAAIKAHLDILVERSNRSRAINVPPRVTVLPKSRVELGQPNIXXXIXDNXFPPVINITXLRNGQTVTEGVAQTSFYSQPDHLFRKXHYXPFXPSAEDVXDXQXEXWGLDAPLLRHWELQVPIPPPDAMETLVCALGLAIGLVGFLVGTVLIIMGTYVSSVPR

SEQ ID NO: 217 - protein, 782 aa, Homo sapiens
  SITE (59)..(59): Xaa at position 59 is Phe, Tyr, Met, His, Ile, Leu, Val Ala, or Gly
  SITE (70)..(70): Xaa at position 70 is Ile, Ala, Val, Leu, or Gly
  SITE (71)..(71): Xaa at position 71 is Trp, Tyr, Phe, Met, His, Ile, Leu Val, Ala, or Gly
  SITE (73)..(73): Xaa at position 73 is Val, Ala, Gly, Leu, or Ile
  SITE (78)..(78): Xaa at position 78 is Leu, Ala, Val, Gly, or Ile
  SITE (81)..(81): Xaa at position 81 is Val, Ala, Gly, Leu, or Ile
  SITE (85)..(85): Xaa at position 85 is Leu, Ala, Val, Gly, or Ile
  SITE (89)..(89): Xaa at position 89 is Phe, Tyr, Met, His, Ile, Leu, Val Ala, or Gly
  SITE (94)..(94): Xaa at position 94 is Ala, Gly, or Pro
  SITE (95)..(95): Xaa at position 95 is Tyr, Phe, Met, His, Ile, Leu, Val Ala, or Gly
  SITE (96)..(96): Xaa at position 96 is Val, Ala, Gly, Leu, or Ile
  SITE (97)..(97): Xaa at position 97 is Ile, Ala, Val, Leu, or Gly
  SITE (98)..(98): Xaa at position 98 is Leu, Ala, Val, Gly, or Ile
  SITE (101)..(101): Xaa at position 101 is Val, Ala, Gly, Leu, or Ile
  SITE (112)..(112): Xaa at position 112 is Leu, Ala, Val, Gly, or Ile
  SITE (113)..(113): Xaa at position 113 is His, Phe, Tyr, Lys, Arg, Gly, Ser Thr, Ala, Val, Leu, Ile, Asn, Met, or Gln
  SITE (115)..(115): Xaa at position 115 is Trp, Tyr, Phe, Met, His, Ile, Leu Val, Ala, or Gly
  SITE (127)..(127): Xaa at position 127 is Ala, Gly, or Pro
  SITE (128)..(128): Xaa at position 128 is Ala, Gly, or Pro
  SITE (135)..(135): Xaa at position 135 is Leu, Ala, Val, Gly, or Ile
  SITE (143)..(143): Xaa at position 143 is Ala, Gly, or Pro
  SITE (157)..(157): Xaa at position 157 is Phe, Tyr, Met, His, Ile, Leu, Val Ala, or Gly
  SITE (173)..(173): Xaa at position 173 is Ala, Gly, or Pro
  SITE (189)..(189): Xaa at position 189 is Leu, Ala, Val, Gly, or Ile
  SITE (190)..(190): Xaa at position 190 is Phe, Tyr, Met, His, Ile, Leu, Val Ala, or Gly
  SITE (192)..(192): Xaa at position 192 is Val, Ala, Gly, Leu, or Ile
  SITE (198)..(198): Xaa at position 198 is Val, Ala, Gly, Leu, or Ile
  SITE (200)..(200): Xaa at position 200 is Ala, Gly, or Pro
  SITE (210)..(210): Xaa at position 210 is Phe, Tyr, Met, His, Ile, Leu, Val Ala, or Gly
  SITE (215)..(215): Xaa at position 215 is Cys, Ala, Val, Gly, Ser, or Thr
  SITE (216)..(216): Xaa at position 216 is Phe, Tyr, Met, His, Ile, Leu, Val Ala, or Gly
  SITE (217)..(217): Xaa at position 217 is Ile, Ala, Val, Leu, or Gly
  SITE (218)..(218): Xaa at position 218 is Leu, Ala, Val, Gly, or Ile
  SITE (220)..(220): Xaa at position 220 is Leu, Ala, Val, Gly, or Ile
  SITE (224)..(224): Xaa at position 224 is Ile, Ala, Val, Leu, or Gly
  SITE (227)..(227): Xaa at position 227 is Trp, Tyr, Phe, Met, His, Ile, Leu Val, Ala, or Gly
  SITE (238)..(238): Xaa at position 238 is Leu, Ala, Val, Gly, or Ile
  SITE (240)..(240): Xaa at position 240 is Ala, Gly, or Pro
  SITE (243)..(243): Xaa at position 243 is Val, Ala, Gly, Leu, or Ile
  SITE (247)..(247): Xaa at position 247 is Ile, Ala, Val, Leu, or Gly
  SITE (254)..(254): Xaa at position 254 is Gly, Ala, or Pro
  SITE (264)..(264): Xaa at position 264 is Gly, Ala, or Pro
  SITE (270)..(270): Xaa at position 270 is Met, Ile, Leu, Val, Ala, or Gly
  SITE (271)..(271): Xaa at position 271 is Leu, Ala, Val, Gly, or Ile
  SITE (276)..(276): Xaa at position 276 is Pro, Met, Leu, Ile, Val, Ala or Gly
  SITE (279)..(279): Xaa at position 279 is Ala, Gly, or Pro
  SITE (280)..(280): Xaa at position 280 is Leu, Ala, Val, Gly, or Ile
  SITE (282)..(282): Xaa at position 282 is Ala, Gly, or Pro
  SITE (283)..(283): Xaa at position 283 is Gly, Ala, or Pro
  SITE (292)..(292): Xaa at position 292 is Ala, Gly, or Pro
  SITE (298)..(298): Xaa at position 298 is Ala, Gly, or Pro
  SITE (300)..(300): Xaa at position 300 is Leu, Ala, Val, Gly, or Ile
  SITE (303)..(303): Xaa at position 303 is Val, Ala, Gly, Leu, or Ile
  SITE (310)..(310): Xaa at position 310 is Met, Ile, Leu, Val, Ala, or Gly
  SITE (316)..(316): Xaa at position 316 is Ala, Gly, or Pro
  SITE (321)..(321): Xaa at position 321 is Phe, Tyr, Met, His, Ile, Leu, Val Ala, or Gly
  SITE (322)..(322): Xaa at position 322 is Ala, Gly, or Pro
  SITE (326)..(326): Xaa at position 326 is Leu, Ala, Val, Gly, or Ile
  SITE (331)..(331): Xaa at position 331 is Cys, Ala, Val, Gly, Ser, or Thr
  SITE (332)..(332): Xaa at position 332 is Phe, Tyr, Met, His, Ile, Leu, Val Ala, or Gly
  SITE (333)..(333): Xaa at position 333 is Ile, Ala, Val, Leu, or Gly
  SITE (334)..(334): Xaa at position 334 is Leu, Ala, Val, Gly, or Ile
  SITE (342)..(342): Xaa at position 342 is Ile, Ala, Val, Leu, or Gly
  SITE (343)..(343): Xaa at position 343 is Phe, Tyr, Met, His, Ile, Leu, Val Ala, or Gly
  SITE (344)..(344): Xaa at position 344 is Val, Ala, Gly, Leu, or Ile
  SITE (358)..(358): Xaa at position 358 is Ala, Gly, or Pro
  SITE (359)..(359): Xaa at position 359 is Leu, Ala, Val, Gly, or Ile
  SITE (362)..(362): Xaa at position 362 is Ala, Gly, or Pro
  SITE (365)..(365): Xaa at position 365 is Phe, Tyr, Met, His, Ile, Leu, Val Ala, or Gly
  SITE (366)..(366): Xaa at position 366 is Ile, Ala, Val, Leu, or Gly
  SITE (377)..(377): Xaa at position 377 is Val, Ala, Gly, Leu, or Ile
  SITE (379)..(379): Xaa at position 379 is Val, Ala, Gly, Leu, or Ile
  SITE (380)..(380): Xaa at position 380 is Leu, Ala, Val, Gly, or Ile
  SITE (389)..(389): Xaa at position 389 is Phe, Tyr, Met, His, Ile, Leu, Val Ala, or Gly
  SITE (392)..(392): Xaa at position 392 is Phe, Tyr, Met, His, Ile, Leu, Val Ala, or Gly
  SITE (434)..(434): Xaa at position 434 is Ala, Gly, or Pro
  SITE (439)..(439): Xaa at position 439 is Met, Ile, Leu, Val, Ala, or Gly
  SITE (449)..(449): Xaa at position 449 is Ile, Ala, Val, Leu, or Gly
  SITE (452)..(452): Xaa at position 452 is Ile, Ala, Val, Leu, or Gly
  SITE (468)..(468): Xaa at position 468 is Phe, Tyr, Met, His, Ile, Leu, Val Ala, or Gly
  SITE (474)..(474): Xaa at position 474 is Tyr, Phe, Met, His, Ile, Leu, Val Ala, or Gly
  SITE (475)..(475): Xaa at position 475 is Ile, Ala, Val, Leu, or Gly
  SITE (476)..(476): Xaa at position 476 is Ile, Ala, Val, Leu, or Gly
  SITE (478)..(478): Xaa at position 478 is Tyr, Phe, Met, His, Ile, Leu, Val Ala, or Gly
  SITE (480)..(480): Xaa at position 480 is Tyr, Phe, Met, His, Ile, Leu, Val Ala, or Gly
  SITE (489)..(489): Xaa at position 489 is Ile, Ala, Val, Leu, or Gly
  SITE (490)..(490): Xaa at position 490 is Ile, Ala, Val, Leu, or Gly
  SITE (493)..(493): Xaa at position 493 is Trp, Tyr, Phe, Met, His, Ile, Leu Val, Ala, or Gly
  SITE (526)..(526): Xaa at position 526 is Val, Ala, Gly, Leu, or Ile
  SITE (534)..(534): Xaa at position 534 is His, Phe, Tyr, Lys, Arg, Gly, Ser Thr, Ala, Val, Leu, Ile, Asn, Met, or Gln
  SITE (535)..(535): Xaa at position 535 is Leu, Ala, Val, Gly, or Ile
  SITE (538)..(538): Xaa at position 538 is Leu, Ala, Val, Gly, or Ile
  SITE (539)..(539): Xaa at position 539 is Phe, Tyr, Met, His, Ile, Leu, Val Ala, or Gly
  SITE (544)..(544): Xaa at position 544 is Met, Ile, Leu, Val, Ala, or Gly
  SITE (545)..(545): Xaa at position 545 is Ile, Ala, Val, Leu, or Gly
  SITE (546)..(546): Xaa at position 546 is Ile, Ala, Val, Leu, or Gly
  SITE (565)..(565): Xaa at position 565 is Leu, Ala, Val, Gly, or Ile
  SITE (566)..(566): Xaa at position 566 is Phe, Tyr, Met, His, Ile, Leu, Val Ala, or Gly
  SITE (568)..(568): Xaa at position 568 is Val, Ala, Gly, Leu, or Ile
  SITE (578)..(578): Xaa at position 578 is Ala, Gly, or Pro
  SITE (588)..(588): Xaa at position 588 is Leu, Ala, Val, Gly, or Ile
  SITE (593)..(593): Xaa at position 593 is Ala, Gly, or Pro
  SITE (594)..(594): Xaa at position 594 is Phe, Tyr, Met, His, Ile, Leu, Val Ala, or Gly
  SITE (595)..(595): Xaa at position 595 is Val, Ala, Gly, Leu, or Ile
  SITE (596)..(596): Xaa at position 596 is Leu, Ala, Val, Gly, or Ile
  SITE (602)..(602): Xaa at position 602 is Ala, Gly, or Pro
  SITE (604)..(604): Xaa at position 604 is Leu, Ala, Val, Gly, or Ile
  SITE (605)..(605): Xaa at position 605 is Trp, Tyr, Phe, Met, His, Ile, Leu Val, Ala, or Gly
  SITE (610)..(610): Xaa at position 610 is Ala, Gly, or Pro
  SITE (618)..(618): Xaa at position 618 is Ala, Gly, or Pro
  SITE (621)..(621): Xaa at position 621 is Leu, Ala, Val, Gly, or Ile
  SITE (622)..(622): Xaa at position 622 is Leu, Ala, Val, Gly, or Ile
  SITE (632)..(632): Xaa at position 632 is Val, Ala, Gly, Leu, or Ile
  SITE (641)..(641): Xaa at position 641 is Phe, Tyr, Met, His, Ile, Leu, Val Ala, or Gly
  SITE (644)..(644): Xaa at position 644 is Ala, Gly, or Pro
  SITE (645)..(645): Xaa at position 645 is Leu, Ala, Val, Gly, or Ile
  SITE (657)..(657): Xaa at position 657 is Leu, Ala, Val, Gly, or Ile
  SITE (669)..(669): Xaa at position 669 is Leu, Ala, Val, Gly, or Ile
  SITE (671)..(671): Xaa at position 671 is Ala, Gly, or Pro
  SITE (672)..(672): Xaa at position 672 is Cys, Ala, Val, Gly, Ser, or Thr
  SITE (680)..(680): Xaa at position 680 is Val, Ala, Gly, Leu, or Ile
  SITE (693)..(693): Xaa at position 693 is Leu, Ala, Val, Gly, or Ile
  SITE (694)..(694): Xaa at position 694 is Ala, Gly, or Pro
  SITE (698)..(698): Xaa at position 698 is Val, Ala, Gly, Leu, or Ile
  SITE (699)..(699): Xaa at position 699 is Met, Ile, Leu, Val, Ala, or Gly
  SITE (700)..(700): Xaa at position 700 is Leu, Ala, Val, Gly, or Ile
  SITE (701)..(701): Xaa at position 701 is Leu, Ala, Val, Gly, or Ile
  SITE (707)..(707): Xaa at position 707 is Val, Ala, Gly, Leu, or Ile
  SITE (708)..(708): Xaa at position 708 is Phe, Tyr, Met, His, Ile, Leu, Val Ala, or Gly
  SITE (709)..(709): Xaa at position 709 is Val, Ala, Gly, Leu, or Ile
  SITE (710)..(710): Xaa at position 710 is Trp, Tyr, Phe, Met, His, Ile, Leu Val, Ala, or Gly
  SITE (723)..(723): Xaa at position 723 is Ala, Gly, or Pro
  SITE (724)..(724): Xaa at position 724 is Leu, Ala, Val, Gly, or Ile
  SITE (727)..(727): Xaa at position 727 is Ala, Gly, or Pro
  SITE (744)..(744): Xaa at position 744 is Ile, Ala, Val, Leu, or Gly
  SITE (747)..(747): Xaa at position 747 is Val, Ala, Gly, Leu, or Ile
  SITE (756)..(756): Xaa at position 756 is Phe, Tyr, Met, His, Ile, Leu, Val Ala, or Gly
MAPHRPAPALLCALSLALCALSLPVRAATASRGASQAGAPQGRVPEARPNSMVVEHPEXLKAGKEPGLQXXRXEKFDXVPXPTNXYGDXFTGDXXXXXKTXQLRNGNLQYDXXYXLGNECSQDESGXXAIFTVQXDDYLNGRXVQHREVQGFESATXLGYFKSGLKYKKGGVXSGFKHVVPNEVVVQRXXQXKGRRVXRXTEVPVSWESXNNGDXXXXDXGNNXHQXCGSNSNRYERXKXTQXSKGXRDNERSXRARVHVSEEXTEPEAXXQVLGXKPXXPXXTEDTAKEDXANRKLXKXYKXSNGAGTXSVSLVXDENPXXQGAXKSEDXXXXDHGKDGKXXXWKGKQANTEERKAXXKTXSDXXTKMDYPKQTQXSXXPEGGETPLXKQXFKNWRDPDQTDGLGLSYLSSHIANVERVPFDAATLHTSTAMXAQHGXDDDGTGQKQXWRXEGSNKVPVDPATYGQXYGGDSXXXLXNXRHGGRQGQXXYNXQGAQSTQDEVAASAILTAQLDEELGGTPVQSRXVQGKEPAXXMSXXGGKPXXXYKGGTSREGGQTAPASTRXXQXRANSAGATRXVEVLPKAGAXNSNDXXXXKTPSAXYXXVGTGXSEAEKTGXQEXXRVLRAQPVQXAEGSEPDGXWEXXGGKAAYRTSPRXKDKKMDAHPPRXFXXSNKIGRFXIEEVPGELMQEDXXTDDXXXXDTWDQXXXXVGKDSQEEEKTEXXTSXKRYIETDPANRDRRTPXTVXKQGFEPPSXVGWFLGWDDDYWSVDPLDRAMAELAA

SEQ ID NO: 218 - protein, 752 aa, Homo sapiens
  SITE (47)..(47): Xaa at position 47 is Leu, Ala, Val, Gly, or Ile
  SITE (82)..(82): Xaa at position 82 is Ala, Gly, or Pro
  SITE (89)..(89): Xaa at position 89 is Cys, Ala, Val, Gly, Ser, or Thr
  SITE (107)..(107): Xaa at position 107 is Tyr, Phe, Met, His, Ile, Leu, Val Ala, or Gly
  SITE (113)..(113): Xaa at position 113 is Val, Ala, Gly, Leu, or Ile
  SITE (144)..(144): Xaa at position 144 is Cys, Ala, Val, Gly, Ser, or Thr
  SITE (151)..(151): Xaa at position 151 is Cys, Ala, Val, Gly, Ser, or Thr
  SITE (160)..(160): Xaa at position 160 is Ala, Gly, or Pro
  SITE (173)..(173): Xaa at position 173 is Val, Ala, Gly, Leu, or Ile
  SITE (191)..(191): Xaa at position 191 is Cys, Ala, Val, Gly, Ser, or Thr
  SITE (462)..(462): Xaa at position 462 is Ile, Ala, Val, Leu, or Gly
  SITE (573)..(573): Xaa at position 573 is Met, Ile, Leu, Val, Ala, or Gly
  SITE (697)..(697): Xaa at position 697 is Val, Ala, Gly, Leu, or Ile
MGPLMVLFCLLFLYPGLADSAPSCPQNVNISGGTFTLSHGWAPGSLXTYSCPQGLYPSPASRLCKSSGQWQTPGATRSLSKXVCKPVRXPAPVSFENGIYTPRLGSXPVGGNXSFECEDGFILRGSPVRQCRPNGMWDGETAVXDNGAGHXPNPGISLGXVRTGFRFGHGDKXRYRCSSNLVLTGSSEREXQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTXCGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKXSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLXSWGLYNPCLGSADKNSRKRAPRSKVPPPRDFHINLFRMQPWLRQHLGDVLNFLPL

SEQ ID NO: 219 - protein, 1680 aa, Mus musculus
  SITE (691)..(691): Xaa at position 691 is Ala, Gly, or Pro
  SITE (703)..(703): Xaa at position 703 is Cys, Ala, Val, Gly, Ser, or Thr
  SITE (728)..(728): Xaa at position 728 is Cys, Ala, Val, Gly, Ser, or Thr
  SITE (731)..(731): Xaa at position 731 is Ala, Gly, or Pro
  SITE (735)..(735): Xaa at position 735 is Cys, Ala, Val, Gly, Ser, or Thr
  SITE (736)..(736): Xaa at position 736 is Cys, Ala, Val, Gly, Ser, or Thr
  SITE (739)..(739): Xaa at position 739 is Ala, Gly, or Pro
MGLWGILCLLIFLDKTWGQEQTYVISAPKILRVGSSENVVIQVHGYTEAFDATLSLKSYPDKKVTFSSGYVNLSPENKFQNAALLTLQPNQVPREESPVSHVYLEVVSKHFSKSKKIPITYNNGILFIHTDKPVYTPDQSVKIRVYSLGDDLKPAKRETVLTFIDPEGSEVDIVEENDYTGIISFPDFKIPSNPKYGVWTIKANYKKDFTTTGTAYFEIKEYVLPRFSVSIELERTFIGYKNFKNFEITVKARYFYNKVVPDAEVYAFFGLREDIKDEEKQMMHKATQAAKLVDGVAQISFDSETAVKELSYNSLEDLNNKYLYIAVTVTESSGGFSEEAEIPGVKYVLSPYTLNLVATPLFVKPGIPFSIKAQVKDSLEQAVGGVPVTLMAQTVDVNQETSDLETKRSITHDTDGVAVFVLNLPSNVTVLKFEIRTDDPELPEENQASKEYEAVAYSSLSQSYIYIAWTENYKPMLVGEYLNIMVTPKSPYIDKITHYNYLILSKGKIVQYGTREKLFSSTYQNINIPVTQNMVPSARLLVYYIVTGEQTAELVADAVWINIEEKCGNQLQVHLSPDEYVYSPGQTVSLDMVTEADSWVALSAVDRAVYKVQGNAKRAMQRVFQALDEKSDLGCGAGGGHDNADVFHLAGLTFLTNANADDSHYRDDSCKEILRSKRNLHLLRQKIEEQXAKYKHSVPKKCXYDGARVNFYETCEERVARVTIGPLXIRXFNEXXTIXNKIRKESPHKPVQLGRIHIKTLLPVMKADIRSYFPESWLWEIHRVPKRKQLQVTLPDSLTTWEIQGIGISDNGICVADTLKAKVFKEVFLEMNIPYSVVRGEQIQLKGTVYNYMTSGTKFCVKMSAVEGICTSGSSAASLHTSRPSRCVFQRIEGSSSHLVTFTLLPLEIGLHSINFSLETSFGKDILVKTLRVVPEGVKRESYAGVILDPKGIRGIVNRRKEFPYRIPLDLVPKTKVERILSVKGLLVGEFLSTVLSKEGINILTHLPKGSAEAELMSIAPVFYVFHYLEAGNHWNIFYPDTLSKRQSLEKKIKQGVVSVMSYRNADYSYSMWKGASASTWLTAFALRVLGQVAKYVKQDENSICNSLLWLVEKCQLENGSFKENSQYLPIKLQGTLPAEAQEKTLYLTAFSVIGIRKAVDICPTMKIHTALDKADSFLLENTLPSKSTFTLAIVAYALSLGDRTHPRFRLIVSALRKEAFVKGDPPIYRYWRDTLKRPDSSVPSSGTAGMVETTAYALLASLKLKDMNYANPIIKWLSEEQRYGGGFYSTQDTINAIEGLTEYSLLLKQIHLDMDINVAYKHEGDFHKYKVTEKHFLGRPVEVSLNDDLVVSTGYSSGLATVYVKTVVHKISVSEEFCSFYLKIDTQDIEASSHFRLSDSGFKRIIACASYKPSKEESTSGSSHAVMDISLPTGIGANEEDLRALVEGVDQLLTDYQIKDGHVILQLNSIPSRDFLCVRFRIFELFQVGFLNPATFTVYEYHRPDKQCTMIYSISDTRLQKVCEGAACTCVEADCAQLQAEVDLAISADSRKEKACKPETAYAYKVRITSATEENVFVKYTATLLVTYKTGEAADENSEVTFIKKMSCTNANLVKGKQYLIMGKEVLQIKHNFSFKYIYPLDSSTWIEYWPTDTTCPSCQAFVENLNNFAEDLFLNSCE

SEQ ID NO: 220 - protein, 847 aa, Homo sapiens
  SITE (16)..(16): Xaa at position 16 is Ile, Ala, Val, Leu, or Gly
  SITE (25)..(25): Xaa at position 25 is Val, Ala, Gly, Leu, or Ile
  SITE (28)..(28): Xaa at position 28 is Leu, Ala, Val, Gly, or Ile
  SITE (32)..(32): Xaa at position 32 is Phe, Tyr, Met, His, Ile, Leu, Val Ala, or Gly
  SITE (36)..(36): Xaa at position 36 is Leu, Ala, Val, Gly, or Ile
  SITE (54)..(54): Xaa at position 54 is Phe, Tyr, Met, His, Ile, Leu, Val Ala, or Gly
  SITE (55)..(55): Xaa at position 55 is Ala, Gly, or Pro
  SITE (56)..(56): Xaa at position 56 is Leu, Ala, Val, Gly, or Ile
  SITE (57)..(57): Xaa at position 57 is Ala, Gly, or Pro
  SITE (60)..(60): Xaa at position 60 is Val, Ala, Gly, Leu, or Ile
  SITE (64)..(64): Xaa at position 64 is Leu, Ala, Val, Gly, or Ile
  SITE (83)..(83): Xaa at position 83 is Val, Ala, Gly, Leu, or Ile
  SITE (84)..(84): Xaa at position 84 is Tyr, Phe, Met, His, Ile, Leu, Val Ala, or Gly
  SITE (85)..(85): Xaa at position 85 is Tyr, Phe, Met, His, Ile, Leu, Val Ala, or Gly
  SITE (86)..(86): Xaa at position 86 is Leu, Ala, Val, Gly, or Ile
  SITE (88)..(88): Xaa at position 88 is Leu, Ala, Val, Gly, or Ile
  SITE (90)..(90): Xaa at position 90 is Phe, Tyr, Met, His, Ile, Leu, Val Ala, or Gly
  SITE (96)..(96): Xaa at position 96 is Leu, Ala, Val, Gly, or Ile
  SITE (100)..(100): Xaa at position 100 is Met, Ile, Leu, Val, Ala, or Gly
  SITE (101)..(101): Xaa at position 101 is Ile, Ala, Val, Leu, or Gly
  SITE (105)..(105): Xaa at position 105 is Leu, Ala, Val, Gly, or Ile
  SITE (108)..(108): Xaa at position 108 is Ala, Gly, or Pro
  SITE (109)..(109): Xaa at position 109 is Cys, Ala, Val, Gly, Ser, or Thr
  SITE (113)..(113): Xaa at position 113 is Ile, Ala, Val, Leu, or Gly
  SITE (118)..(118): Xaa at position 118 is Leu, Ala, Val, Gly, or Ile
  SITE (123)..(123): Xaa at position 123 is Leu, Ala, Val, Gly, or Ile
  SITE (132)..(132): Xaa at position 132 is Leu, Ala, Val, Gly, or Ile
  SITE (137)..(137): Xaa at position 137 is Leu, Ala, Val, Gly, or Ile
  SITE (140)..(140): Xaa at position 140 is Leu, Ala, Val, Gly, or Ile
  SITE (141)..(141): Xaa at position 141 is Ala, Gly, or Pro
  SITE (142)..(142): Xaa at position 142 is Ala, Gly, or Pro
  SITE (143)..(143): Xaa at position 143 is Cys, Ala, Val, Gly, Ser, or Thr
  SITE (144)..(144): Xaa at position 144 is Phe, Tyr, Met, His, Ile, Leu, Val Ala, or Gly
  SITE (145)..(145): Xaa at position 145 is Leu, Ala, Val, Gly, or Ile
  SITE (148)..(148): Xaa at position 148 is Met, Ile, Leu, Val, Ala, or Gly
  SITE (149)..(149): Xaa at position 149 is Ala, Gly, or Pro
  SITE (151)..(151): Xaa at position 151 is Leu, Ala, Val, Gly, or Ile
  SITE (153)..(153): Xaa at position 153 is Leu, Ala, Val, Gly, or Ile
  SITE (154)..(154): Xaa at position 154 is Ala, Gly, or Pro
  SITE (155)..(155): Xaa at position 155 is Ala, Gly, or Pro
  SITE (156)..(156): Xaa at position 156 is Tyr, Phe, Met, His, Ile, Leu, Val Ala, or Gly
  SITE (158)..(158): Xaa at position 158 is Tyr, Phe, Met, His, Ile, Leu, Val Ala, or Gly
  SITE (160)..(160): Xaa at position 160 is Ile, Ala, Val, Leu, or Gly
  SITE (162)..(162): Xaa at position 162 is Tyr, Phe, Met, His, Ile, Leu, Val Ala, or Gly
  SITE (201)..(201): Xaa at position 201 is Val, Ala, Gly, Leu, or Ile
  SITE (203)..(203): Xaa at position 203 is Phe, Tyr, Met, His, Ile, Leu, Val Ala, or Gly
  SITE (222)..(222): Xaa at position 222 is Val, Ala, Gly, Leu, or Ile
  SITE (224)..(224): Xaa at position 224 is Ala, Gly, or Pro
  SITE (239)..(239): Xaa at position 239 is Val, Ala, Gly, Leu, or Ile
  SITE (242)..(242): Xaa at position 242 is Met, Ile, Leu, Val, Ala, or Gly
  SITE (244)..(244): Xaa at position 244 is Leu, Ala, Val, Gly, or Ile
  SITE (245)..(245): Xaa at position 245 is Trp, Tyr, Phe, Met, His, Ile, Leu Val, Ala, or Gly
  SITE (247)..(247): Xaa at position 247 is Ala, Gly, or Pro
  SITE (273)..(273): Xaa at position 273 is Ala, Gly, or Pro
  SITE (276)..(276): Xaa at position 276 is Ile, Ala, Val, Leu, or Gly
  SITE (280)..(280): Xaa at position 280 is Leu, Ala, Val, Gly, or Ile
  SITE (294)..(294): Xaa at position 294 is Leu, Ala, Val, Gly, or Ile
  SITE (298)..(298): Xaa at position 298 is Tyr, Phe, Met, His, Ile, Leu, Val Ala, or Gly
  SITE (299)..(299): Xaa at position 299 is Phe, Tyr, Met, His, Ile, Leu, Val Ala, or Gly
  SITE (300)..(300): Xaa at position 300 is Val, Ala, Gly, Leu, or Ile
  SITE (301)..(301): Xaa at position 301 is Val, Ala, Gly, Leu, or Ile
  SITE (302)..(302): Xaa at position 302 is Ala, Gly, or Pro
  SITE (303)..(303): Xaa at position 303 is Ala, Gly, or Pro
  SITE (305)..(305): Xaa at position 305 is Leu, Ala, Val, Gly, or Ile
  SITE (308)..(308): Xaa at position 308 is Ile, Ala, Val, Leu, or Gly
  SITE (309)..(309): Xaa at position 309 is Ile, Ala, Val, Leu, or Gly
  SITE (317)..(317): Xaa at position 317 is Phe, Tyr, Met, His, Ile, Leu, Val Ala, or Gly
  SITE (327)..(327): Xaa at position 327 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (334)..(334): Xaa at position 334 is Val, Ala, Gly, Leu, or Ile
  SITE (335)..(335): Xaa at position 335 is Ala, Gly, or Pro
  SITE (336)..(336): Xaa at position 336 is Ile, Ala, Val, Leu, or Gly
  SITE (338)..(338): Xaa at position 338 is Leu, Ala, Val, Gly, or Ile
  SITE (344)..(344): Xaa at position 344 is Ala, Gly, or Pro
  SITE (345)..(345): Xaa at position 345 is Leu, Ala, Val, Gly, or Ile
  SITE (346)..(346): Xaa at position 346 is Ala, Gly, or Pro
  SITE (347)..(347): Xaa at position 347 is Ile, Ala, Val, Leu, or Gly
  SITE (350)..(350): Xaa at position 350 is Leu, Ala, Val, Gly, or Ile
  SITE (351)..(351): Xaa at position 351 is Met, Ile, Leu, Val, Ala, or Gly
  SITE (354)..(354): Xaa at position 354 is Phe, Tyr, Met, His, Ile, Leu, Val Ala, or Gly
  SITE (357)..(357): Xaa at position 357 is Ile, Ala, Val, Leu, or Gly
  SITE (360)..(360): Xaa at position 360 is Leu, Ala, Val, Gly, or Ile
  SITE (365)..(365): Xaa at position 365 is Ala, Gly, or Pro
  SITE (368)..(368): Xaa at position 368 is Leu, Ala, Val, Gly, or Ile
  SITE (373)..(373): Xaa at position 373 is Phe, Tyr, Met, His, Ile, Leu, Val Ala, or Gly
  SITE (374)..(374): Xaa at position 374 is Ala, Gly, or Pro
  SITE (375)..(375): Xaa at position 375 is Tyr, Phe, Met, His, Ile, Leu, Val Ala, or Gly
  SITE (380)..(380): Xaa at position 380 is Val, Ala, Gly, Leu, or Ile
  SITE (388)..(388): Xaa at position 388 is Trp, Tyr, Phe, Met, His, Ile, Leu Val, Ala, or Gly
  SITE (392)..(392): Xaa at position 392 is Leu, Ala, Val, Gly, or Ile
  SITE (393)..(393): Xaa at position 393 is Val, Ala, Gly, Leu, or Ile
  SITE (396)..(396): Xaa at position 396 is Leu, Ala, Val, Gly, or Ile
  SITE (397)..(397): Xaa at position 397 is Leu, Ala, Val, Gly, or Ile
  SITE (400)..(400): Xaa at position 400 is His, Phe, Tyr, Lys, Arg, Gly, Ser Thr, Ala, Val, Leu, Ile, Asn, Met, or Gln
  SITE (403)..(403): Xaa at position 403 is Ile, Ala, Val, Leu, or Gly
  SITE (404)..(404): Xaa at position 404 is Ile, Ala, Val, Leu, or Gly
  SITE (407)..(407): Xaa at position 407 is Ile, Ala, Val, Leu, or Gly
  SITE (415)..(415): Xaa at position 415 is Ile, Ala, Val, Leu, or Gly
  SITE (418)..(418): Xaa at position 418 is Leu, Ala, Val, Gly, or Ile
  SITE (429)..(429): Xaa at position 429 is Met, Ile, Leu, Val, Ala, or Gly
  SITE (431)..(431): Xaa at position 431 is Leu, Ala, Val, Gly, or Ile
  SITE (432)..(432): Xaa at position 432 is Ile, Ala, Val, Leu, or Gly
  SITE (440)..(440): Xaa at position 440 is Ile, Ala, Val, Leu, or Gly
  SITE (442)..(442): Xaa at position 442 is Met, Ile, Leu, Val, Ala, or Gly
  SITE (443)..(443): Xaa at position 443 is Ala, Gly, or Pro
  SITE (445)..(445): Xaa at position 445 is Leu, Ala, Val, Gly, or Ile
  SITE (446)..(446): Xaa at position 446 is Cys, Ala, Val, Gly, Ser, or Thr
  SITE (447)..(447): Xaa at position 447 is Ile, Ala, Val, Leu, or Gly
  SITE (452)..(452): Xaa at position 452 is Ala, Gly, or Pro
  SITE (453)..(453): Xaa at position 453 is Val, Ala, Gly, Leu, or Ile
  SITE (456)..(456): Xaa at position 456 is Val, Ala, Gly, Leu, or Ile
  SITE (457)..(457): Xaa at position 457 is Ala, Gly, or Pro
  SITE (459)..(459): Xaa at position 459 is Ile, Ala, Val, Leu, or Gly
  SITE (460)..(460): Xaa at position 460 is His, Phe, Tyr, Lys, Arg, Gly, Ser Thr, Ala, Val, Leu, Ile, Asn, Met, or Gln
  SITE (464)..(464): Xaa at position 464 is Val, Ala, Gly, Leu, or Ile
  SITE (469)..(469): Xaa at position 469 is Phe, Tyr, Met, His, Ile, Leu, Val Ala, or Gly
  SITE (472)..(472): Xaa at position 472 is Phe, Tyr, Met, His, Ile, Leu, Val Ala, or Gly
  SITE (475)..(475): Xaa at position 475 is Leu, Ala, Val, Gly, or Ile
  SITE (487)..(487): Xaa at position 487 is Ile, Ala, Val, Leu, or Gly
  SITE (492)..(492): Xaa at position 492 is Trp, Tyr, Phe, Met, His, Ile, Leu Val, Ala, or Gly
  SITE (493)..(493): Xaa at position 493 is Leu, Ala, Val, Gly, or Ile
  SITE (494)..(494): Xaa at position 494 is Leu, Ala, Val, Gly, or Ile
  SITE (501)..(501): Xaa at position 501 is Ala, Gly, or Pro
  SITE (503)..(503): Xaa at position 503 is Leu, Ala, Val, Gly, or Ile
  SITE (504)..(504): Xaa at position 504 is Ile, Ala, Val, Leu, or Gly
  SITE (512)..(512): Xaa at position 512 is Tyr, Phe, Met, His, Ile, Leu, Val Ala, or Gly
  SITE (513)..(513): Xaa at position 513 is Val, Ala, Gly, Leu, or Ile
  SITE (516)..(516): Xaa at position 516 is Leu, Ala, Val, Gly, or Ile
  SITE (519)..(519): Xaa at position 519 is Leu, Ala, Val, Gly, or Ile
  SITE (522)..(522): Xaa at position 522 is Leu, Ala, Val, Gly, or Ile
  SITE (523)..(523): Xaa at position 523 is His, Phe, Tyr, Lys, Arg, Gly, Ser Thr, Ala, Val, Leu, Ile, Asn, Met, or Gln
  SITE (531)..(531): Xaa at position 531 is Phe, Tyr, Met, His, Ile, Leu, Val Ala, or Gly
  SITE (532)..(532): Xaa at position 532 is Leu, Ala, Val, Gly, or Ile
  SITE (538)..(538): Xaa at position 538 is Val, Ala, Gly, Leu, or Ile
  SITE (544)..(544): Xaa at position 544 is Leu, Ala, Val, Gly, or Ile
  SITE (546)..(546): Xaa at position 546 is Phe, Tyr, Met, His, Ile, Leu, Val Ala, or Gly
  SITE (550)..(550): Xaa at position 550 is Leu, Ala, Val, Gly, or Ile
  SITE (563)..(563): Xaa at position 563 is Met, Ile, Leu, Val, Ala, or Gly
  SITE (564)..(564): Xaa at position 564 is Phe, Tyr, Met, His, Ile, Leu, Val Ala, or Gly
  SITE (566)..(566): Xaa at position 566 is Val, Ala, Gly, Leu, or Ile
  SITE (571)..(571): Xaa at position 571 is Ile, Ala, Val, Leu, or Gly
  SITE (574)..(574): Xaa at position 574 is Tyr, Phe, Met, His, Ile, Leu, Val Ala, or Gly
  SITE (578)..(578): Xaa at position 578 is Leu, Ala, Val, Gly, or Ile
  SITE (579)..(579): Xaa at position 579 is Leu, Ala, Val, Gly, or Ile
  SITE (581)..(581): Xaa at position 581 is Cys, Ala, Val, Gly, Ser, or Thr
  SITE (582)..(582): Xaa at position 582 is Leu, Ala, Val, Gly, or Ile
  SITE (583)..(583): Xaa at position 583 is His, Phe, Tyr, Lys, Arg, Gly, Ser Thr, Ala, Val, Leu, Ile, Asn, Met, or Gln
  SITE (584)..(584): Xaa at position 584 is Val, Ala, Gly, Leu, or Ile
  SITE (585)..(585): Xaa at position 585 is Ile, Ala, Val, Leu, or Gly
  SITE (591)..(591): Xaa at position 591 is Ile, Ala, Val, Leu, or Gly
  SITE (604)..(604): Xaa at position 604 is Val, Ala, Gly, Leu, or Ile
  SITE (605)..(605): Xaa at position 605 is Ile, Ala, Val, Leu, or Gly
  SITE (606)..(606): Xaa at position 606 is Ile, Ala, Val, Leu, or Gly
  SITE (610)..(610): Xaa at position 610 is Ala, Gly, or Pro
  SITE (611)..(611): Xaa at position 611 is Ala, Gly, or Pro
  SITE (616)..(616): Xaa at position 616 is Met, Ile, Leu, Val, Ala, or Gly
  SITE (617)..(617): Xaa at position 617 is Ala, Gly, or Pro
  SITE (620)..(620): Xaa at position 620 is Ile, Ala, Val, Leu, or Gly
  SITE (621)..(621): Xaa at position 621 is Ile, Ala, Val, Leu, or Gly
  SITE (623)..(623): Xaa at position 623 is Leu, Ala, Val, Gly, or Ile
  SITE (624)..(624): Xaa at position 624 is Ile, Ala, Val, Leu, or Gly
  SITE (627)..(627): Xaa at position 627 is Val, Ala, Gly, Leu, or Ile
  SITE (630)..(630): Xaa at position 630 is Val, Ala, Gly, Leu, or Ile
  SITE (631)..(631): Xaa at position 631 is Val, Ala, Gly, Leu, or Ile
  SITE (636)..(636): Xaa at position 636 is Met, Ile, Leu, Val, Ala, or Gly
  SITE (637)..(637): Xaa at position 637 is Val, Ala, Gly, Leu, or Ile
  SITE (641)..(641): Xaa at position 641 is Leu, Ala, Val, Gly, or Ile
  SITE (643)..(643): Xaa at position 643 is Val, Ala, Gly, Leu, or Ile
  SITE (644)..(644): Xaa at position 644 is Ile, Ala, Val, Leu, or Gly
  SITE (646)..(646): Xaa at position 646 is Leu, Ala, Val, Gly, or Ile
  SITE (651)..(651): Xaa at position 651 is Val, Ala, Gly, Leu, or Ile
  SITE (653)..(653): Xaa at position 653 is Leu, Ala, Val, Gly, or Ile
  SITE (654)..(654): Xaa at position 654 is Ala, Gly, or Pro
  SITE (657)..(657): Xaa at position 657 is Val, Ala, Gly, Leu, or Ile
  SITE (658)..(658): Xaa at position 658 is Ile, Ala, Val, Leu, or Gly
  SITE (660)..(660): Xaa at position 660 is Ala, Gly, or Pro
  SITE (663)..(663): Xaa at position 663 is Leu, Ala, Val, Gly, or Ile
  SITE (667)..(667): Xaa at position 667 is Ile, Ala, Val, Leu, or Gly
  SITE (670)..(670): Xaa at position 670 is Ala, Gly, or Pro
  SITE (680)..(680): Xaa at position 680 is Met, Ile, Leu, Val, Ala, or Gly
  SITE (682)..(682): Xaa at position 682 is Phe, Tyr, Met, His, Ile, Leu, Val Ala, or Gly
  SITE (683)..(683): Xaa at position 683 is Met, Ile, Leu, Val, Ala, or Gly
  SITE (684)..(684): Xaa at position 684 is Leu, Ala, Val, Gly, or Ile
  SITE (687)..(687): Xaa at position 687 is Ala, Gly, or Pro
  SITE (688)..(688): Xaa at position 688 is Leu, Ala, Val, Gly, or Ile
  SITE (690)..(690): Xaa at position 690 is Ile, Ala, Val, Leu, or Gly
  SITE (696)..(696): Xaa at position 696 is Ala, Gly, or Pro
  SITE (700)..(700): Xaa at position 700 is Met, Ile, Leu, Val, Ala, or Gly
  SITE (701)..(701): Xaa at position 701 is Ala, Gly, or Pro
  SITE (712)..(712): Xaa at position 712 is Phe, Tyr, Met, His, Ile, Leu, Val Ala, or Gly
  SITE (729)..(729): Xaa at position 729 is Ala, Gly, or Pro
  SITE (736)..(736): Xaa at position 736 is Leu, Ala, Val, Gly, or Ile
  SITE (739)..(739): Xaa at position 739 is Leu, Ala, Val, Gly, or Ile
  SITE (742)..(742): Xaa at position 742 is Val, Ala, Gly, Leu, or Ile
  SITE (743)..(743): Xaa at position 743 is Ile, Ala, Val, Leu, or Gly
  SITE (746)..(746): Xaa at position 746 is Ile, Ala, Val, Leu, or Gly
  SITE (759)..(759): Xaa at position 759 is Phe, Tyr, Met, His, Ile, Leu, Val Ala, or Gly
  SITE (762)..(762): Xaa at position 762 is Ile, Ala, Val, Leu, or Gly
  SITE (766)..(766): Xaa at position 766 is Leu, Ala, Val, Gly, or Ile
  SITE (772)..(772): Xaa at position 772 is Phe, Tyr, Met, His, Ile, Leu, Val Ala, or Gly
  SITE (775)..(775): Xaa at position 775 is Phe, Tyr, Met, His, Ile, Leu, Val Ala, or Gly
  SITE (778)..(778): Xaa at position 778 is Tyr, Phe, Met, His, Ile, Leu, Val Ala, or Gly
  SITE (781)..(781): Xaa at position 781 is Tyr, Phe, Met, His, Ile, Leu, Val Ala, or Gly
  SITE (782)..(782): Xaa at position 782 is Val, Ala, Gly, Leu, or Ile
  SITE (784)..(784): Xaa at position 784 is Cys, Ala, Val, Gly, Ser, or Thr
  SITE (788)..(788): Xaa at position 788 is Val, Ala, Gly, Leu, or Ile
  SITE (792)..(792): Xaa at position 792 is Tyr, Phe, Met, His, Ile, Leu, Val Ala, or Gly
  SITE (802)..(802): Xaa at position 802 is Val, Ala, Gly, Leu, or Ile
  SITE (803)..(803): Xaa at position 803 is Leu, Ala, Val, Gly, or Ile
  SITE (806)..(806): Xaa at position 806 is Ile, Ala, Val, Leu, or Gly
  SITE (807)..(807): Xaa at position 807 is Ala, Gly, or Pro
  SITE (812)..(812): Xaa at position 812 is Phe, Tyr, Met, His, Ile, Leu, Val Ala, or Gly
  SITE (818)..(818): Xaa at position 818 is Ile, Ala, Val, Leu, or Gly
  SITE (821)..(821): Xaa at position 821 is Tyr, Phe, Met, His, Ile, Leu, Val Ala, or Gly
  SITE (822)..(822): Xaa at position 822 is Ala, Gly, or Pro
  SITE (826)..(826): Xaa at position 826 is Trp, Tyr, Phe, Met, His, Ile, Leu Val, Ala, or Gly
MAKPLTDQEKRRQISXRGIVGVENXAEXKKSXNRHXHFTLVKDRNVATTRDYYXXXXHTXRDHXVGRWIRTQQHYYDKCPKRXXXXSXEXYMGRTXQNTXXNLGXQNXXDEAXYQLGXDIEEXEEIEEDAGXGNGGXGRXXXXXXDSXXTXGXXXXGXGXRXEYGIFNQKIRDGWQVEEADDWLRYGNPWEKSRPEFMLPXHXYGKVEHTNTGTKWIDTQVXLXLPYDTPVPGYMNNTXNTXRXXSXRAPNDFNLRDFNVGDYIQAVLDRNLXENXSRVXYPNDNFFEGKELRXKQEXXXXXXTXQDXXRRFKASKXGSTRGAGTVXDAXPDQXXXQXNDTHPXXXXPEXXRIXVDXEKXPWSKXWEXTQKTXXXTNHTXLPEALERXPVDXXEKXXPRXLEXXYEXNQKHLDRXVAXFPKDVDRLRRXSXXEEEGSKRXNXXHXXXVGSHXXNGXXKXXSDIXKTKVXKDXSEXEPDKFQNKTNGXTPRRXXXLCNPGLXEXXAEKIGEDXXKDXSQXTKXXSFLGDDVXXRELAKXKQENKXKXSQFXETEYKVKINPSSXXDXQVKRXHEXKRQXXNXXXXXTMYNRXKKDPKKLFVPRTXXXGGKXXPGYHXXKMXXKXXTSXADXXNNDPXXGSKXKXXFXENYRXSXXEKXXPXTDXSEQXSTXGTEASGTGNXKXXXNGXXTXGTMDGXNVEXXEEAGEENLFIXGMRIDDVAALDKKGYEXKEYYEAXPEXKLXXDQXDNGFFSPKQPDLXKDXINMXFYHDRXKVXADXEAXXKXQDKXSQLXMNPKAWNTMXXKNXXASGKXSSDRTXKEXXQNIXNVEPSDLKISLSNESNKVNGN

SEQ ID NO: 221 - protein, 558 aa, Homo sapiens
  SITE (2)..(2): Xaa at position 2 is Ala, Gly, or Pro
  SITE (4)..(4): Xaa at position 4 is Leu, Ala, Val, Gly, or Ile
  SITE (10)..(10): Xaa at position 10 is Phe, Tyr, Met, His, Ile, Leu, Val Ala, or Gly
  SITE (13)..(13): Xaa at position 13 is Leu, Ala, Val, Gly, or Ile
  SITE (16)..(16): Xaa at position 16 is Trp, Tyr, Phe, Met, His, Ile, Leu Val, Ala, or Gly
  SITE (26)..(26): Xaa at position 26 is Leu, Ala, Val, Gly, or Ile
  SITE (40)..(40): Xaa at position 40 is Phe, Tyr, Met, His, Ile, Leu, Val Ala, or Gly
  SITE (51)..(51): Xaa at position 51 is Ile, Ala, Val, Leu, or Gly
  SITE (53)..(53): Xaa at position 53 is Val, Ala, Gly, Leu, or Ile
  SITE (55)..(55): Xaa at position 55 is Tyr, Phe, Met, His, Ile, Leu, Val Ala, or Gly
  SITE (59)..(59): Xaa at position 59 is Leu, Ala, Val, Gly, or Ile
  SITE (60)..(60): Xaa at position 60 is Val, Ala, Gly, Leu, or Ile
  SITE (64)..(64): Xaa at position 64 is Val, Ala, Gly, Leu, or Ile
  SITE (67)..(67): Xaa at position 67 is Met, Ile, Leu, Val, Ala, or Gly
  SITE (68)..(68): Xaa at position 68 is Leu, Ala, Val, Gly, or Ile
  SITE (71)..(71): Xaa at position 71 is Leu, Ala, Val, Gly, or Ile
  SITE (72)..(72): Xaa at position 72 is Ala, Gly, or Pro
  SITE (77)..(77): Xaa at position 77 is Val, Ala, Gly, Leu, or Ile
  SITE (79)..(79): Xaa at position 79 is Ala, Gly, or Pro
  SITE (80)..(80): Xaa at position 80 is Ala, Gly, or Pro
  SITE (84)..(84): Xaa at position 84 is Met, Ile, Leu, Val, Ala, or Gly
  SITE (97)..(97): Xaa at position 97 is Ala, Gly, or Pro
  SITE (98)..(98): Xaa at position 98 is Val, Ala, Gly, Leu, or Ile
  SITE (99)..(99): Xaa at position 99 is Leu, Ala, Val, Gly, or Ile
  SITE (100)..(100): Xaa at position 100 is His, Phe, Tyr, Lys, Arg, Gly, Ser Thr, Ala, Val, Leu, Ile, Asn, Met, or Gln
  SITE (101)..(101): Xaa at position 101 is Val, Ala, Gly, Leu, or Ile
  SITE (102)..(102): Xaa at position 102 is Ala, Gly, or Pro
  SITE (103)..(103): Xaa at position 103 is Leu, Ala, Val, Gly, or Ile
  SITE (111)..(111): Xaa at position 111 is Ile, Ala, Val, Leu, or Gly
  SITE (118)..(118): Xaa at position 118 is Val, Ala, Gly, Leu, or Ile
  SITE (125)..(125): Xaa at position 125 is Val, Ala, Gly, Leu, or Ile
  SITE (129)..(129): Xaa at position 129 is Met, Ile, Leu, Val, Ala, or Gly
  SITE (132)..(132): Xaa at position 132 is Phe, Tyr, Met, His, Ile, Leu, Val Ala, or Gly
  SITE (133)..(133): Xaa at position 133 is Cys, Ala, Val, Gly, Ser, or Thr
  SITE (136)..(136): Xaa at position 136 is Val, Ala, Gly, Leu, or Ile
  SITE (149)..(149): Xaa at position 149 is Ile, Ala, Val, Leu, or Gly
  SITE (152)..(152): Xaa at position 152 is Val, Ala, Gly, Leu, or Ile
  SITE (153)..(153): Xaa at position 153 is Ile, Ala, Val, Leu, or Gly
  SITE (155)..(155): Xaa at position 155 is Ile, Ala, Val, Leu, or Gly
  SITE (166)..(166): Xaa at position 166 is Met, Ile, Leu, Val, Ala, or Gly
  SITE (167)..(167): Xaa at position 167 is Val, Ala, Gly, Leu, or Ile
  SITE (170)..(170): Xaa at position 170 is Ala, Gly, or Pro
  SITE (171)..(171): Xaa at position 171 is Leu, Ala, Val, Gly, or Ile
  SITE (184)..(184): Xaa at position 184 is Val, Ala, Gly, Leu, or Ile
  SITE (192)..(192): Xaa at position 192 is Ile, Ala, Val, Leu, or Gly
  SITE (205)..(205): Xaa at position 205 is Leu, Ala, Val, Gly, or Ile
  SITE (206)..(206): Xaa at position 206 is Phe, Tyr, Met, His, Ile, Leu, Val Ala, or Gly
  SITE (207)..(207): Xaa at position 207 is Ile, Ala, Val, Leu, or Gly
  SITE (208)..(208): Xaa at position 208 is Ile, Ala, Val, Leu, or Gly
  SITE (209)..(209): Xaa at position 209 is Ala, Gly, or Pro
  SITE (213)..(213): Xaa at position 213 is Phe, Tyr, Met, His, Ile, Leu, Val Ala, or Gly
  SITE (222)..(222): Xaa at position 222 is Ala, Gly, or Pro
  SITE (225)..(225): Xaa at position 225 is Ala, Gly, or Pro
  SITE (229)..(229): Xaa at position 229 is Phe, Tyr, Met, His, Ile, Leu, Val Ala, or Gly
  SITE (233)..(233): Xaa at position 233 is Ala, Gly, or Pro
  SITE (238)..(238): Xaa at position 238 is Ala, Gly, or Pro
  SITE (239)..(239): Xaa at position 239 is Val, Ala, Gly, Leu, or Ile
  SITE (242)..(242): Xaa at position 242 is His, Phe, Tyr, Lys, Arg, Gly, Ser Thr, Ala, Val, Leu, Ile, Asn, Met, or Gln
  SITE (243)..(243): Xaa at position 243 is Phe, Tyr, Met, His, Ile, Leu, Val Ala, or Gly
  SITE (244)..(244): Xaa at position 244 is Val, Ala, Gly, Leu, or Ile
  SITE (245)..(245): Xaa at position 245 is Ala, Gly, or Pro
  SITE (246)..(246): Xaa at position 246 is Leu, Ala, Val, Gly, or Ile
  SITE (253)..(253): Xaa at position 253 is Val, Ala, Gly, Leu, or Ile
  SITE (256)..(256): Xaa at position 256 is Phe, Tyr, Met, His, Ile, Leu, Val Ala, or Gly
  SITE (258)..(258): Xaa at position 258 is Ile, Ala, Val, Leu, or Gly
  SITE (264)..(264): Xaa at position 264 is Phe, Tyr, Met, His, Ile, Leu, Val Ala, or Gly
  SITE (266)..(266): Xaa at position 266 is Phe, Tyr, Met, His, Ile, Leu, Val Ala, or Gly
  SITE (269)..(269): Xaa at position 269 is Trp, Tyr, Phe, Met, His, Ile, Leu Val, Ala, or Gly
  SITE (270)..(270): Xaa at position 270 is Val, Ala, Gly, Leu, or Ile
  SITE (274)..(274): Xaa at position 274 is Tyr, Phe, Met, His, Ile, Leu, Val Ala, or Gly
  SITE (276)..(276): Xaa at position 276 is Leu, Ala, Val, Gly, or Ile
  SITE (277)..(277): Xaa at position 277 is Trp, Tyr, Phe, Met, His, Ile, Leu Val, Ala, or Gly
  SITE (279)..(279): Xaa at position 279 is Ala, Gly, or Pro
  SITE (280)..(280): Xaa at position 280 is Ile, Ala, Val, Leu, or Gly
  SITE (282)..(282): Xaa at position 282 is Leu, Ala, Val, Gly, or Ile
  SITE (284)..(284): Xaa at position 284 is Ile, Ala, Val, Leu, or Gly
  SITE (285)..(285): Xaa at position 285 is Ala, Gly, or Pro
  SITE (286)..(286): Xaa at position 286 is Leu, Ala, Val, Gly, or Ile
  SITE (293)..(293): Xaa at position 293 is Phe, Tyr, Met, His, Ile, Leu, Val Ala, or Gly
  SITE (296)..(296): Xaa at position 296 is Leu, Ala, Val, Gly, or Ile
  SITE (297)..(297): Xaa at position 297 is Leu, Ala, Val, Gly, or Ile
  SITE (300)..(300): Xaa at position 300 is Ala, Gly, or Pro
  SITE (303)..(303): Xaa at position 303 is Met, Ile, Leu, Val, Ala, or Gly
  SITE (307)..(307): Xaa at position 307 is Phe, Tyr, Met, His, Ile, Leu, Val Ala, or Gly
  SITE (312)..(312): Xaa at position 312 is Leu, Ala, Val, Gly, or Ile
  SITE (316)..(316): Xaa at position 316 is Ala, Gly, or Pro
  SITE (318)..(318): Xaa at position 318 is Val, Ala, Gly, Leu, or Ile
  SITE (319)..(319): Xaa at position 319 is Leu, Ala, Val, Gly, or Ile
  SITE (320)..(320): Xaa at position 320 is Leu, Ala, Val, Gly, or Ile
  SITE (321)..(321): Xaa at position 321 is Ala, Gly, or Pro
  SITE (322)..(322): Xaa at position 322 is Leu, Ala, Val, Gly, or Ile
  SITE (323)..(323): Xaa at position 323 is Leu, Ala, Val, Gly, or Ile
  SITE (325)..(325): Xaa at position 325 is Ile, Ala, Val, Leu, or Gly
  SITE (326)..(326): Xaa at position 326 is Trp, Tyr, Phe, Met, His, Ile, Leu Val, Ala, or Gly
  SITE (337)..(337): Xaa at position 337 is Ala, Gly, or Pro
  SITE (338)..(338): Xaa at position 338 is Met, Ile, Leu, Val, Ala, or Gly
  SITE (339)..(339): Xaa at position 339 is Leu, Ala, Val, Gly, or Ile
  SITE (341)..(341): Xaa at position 341 is Tyr, Phe, Met, His, Ile, Leu, Val Ala, or Gly
  SITE (345)..(345): Xaa at position 345 is Leu, Ala, Val, Gly, or Ile
  SITE (348)..(348): Xaa at position 348 is Phe, Tyr, Met, His, Ile, Leu, Val Ala, or Gly
  SITE (352)..(352): Xaa at position 352 is Phe, Tyr, Met, His, Ile, Leu, Val Ala, or Gly
  SITE (379)..(379): Xaa at position 379 is Val, Ala, Gly, Leu, or Ile
  SITE (392)..(392): Xaa at position 392 is Tyr, Phe, Met, His, Ile, Leu, Val Ala, or Gly
  SITE (395)..(395): Xaa at position 395 is Ile, Ala, Val, Leu, or Gly
  SITE (404)..(404): Xaa at position 404 is Cys, Ala, Val, Gly, Ser, or Thr
  SITE (406)..(406): Xaa at position 406 is Phe, Tyr, Met, His, Ile, Leu, Val Ala, or Gly
  SITE (407)..(407): Xaa at position 407 is Leu, Ala, Val, Gly, or Ile
  SITE (408)..(408): Xaa at position 408 is Ile, Ala, Val, Leu, or Gly
  SITE (429)..(429): Xaa at position 429 is Phe, Tyr, Met, His, Ile, Leu, Val Ala, or Gly
  SITE (436)..(436): Xaa at position 436 is Leu, Ala, Val, Gly, or Ile
  SITE (437)..(437): Xaa at position 437 is Met, Ile, Leu, Val, Ala, or Gly
  SITE (445)..(445): Xaa at position 445 is Ala, Gly, or Pro
  SITE (463)..(463): Xaa at position 463 is Leu, Ala, Val, Gly, or Ile
  SITE (477)..(477): Xaa at position 477 is Ile, Ala, Val, Leu, or Gly
  SITE (479)..(479): Xaa at position 479 is Phe, Tyr, Met, His, Ile, Leu, Val Ala, or Gly
  SITE (482)..(482): Xaa at position 482 is Leu, Ala, Val, Gly, or Ile
  SITE (486)..(486): Xaa at position 486 is Met, Ile, Leu, Val, Ala, or Gly
  SITE (487)..(487): Xaa at position 487 is Leu, Ala, Val, Gly, or Ile
  SITE (489)..(489): Xaa at position 489 is Ala, Gly, or Pro
  SITE (490)..(490): Xaa at position 490 is Leu, Ala, Val, Gly, or Ile
  SITE (491)..(491): Xaa at position 491 is Val, Ala, Gly, Leu, or Ile
  SITE (492)..(492): Xaa at position 492 is Ala, Gly, or Pro
  SITE (493)..(493): Xaa at position 493 is Met, Ile, Leu, Val, Ala, or Gly
  SITE (494)..(494): Xaa at position 494 is Tyr, Phe, Met, His, Ile, Leu, Val Ala, or Gly
  SITE (496)..(496): Xaa at position 496 is His, Phe, Tyr, Lys, Arg, Gly, Ser Thr, Ala, Val, Leu, Ile, Asn, Met, or Gln
  SITE (498)..(498): Xaa at position 498 is Ile, Ala, Val, Leu, or Gly
  SITE (499)..(499): Xaa at position 499 is Phe, Tyr, Met, His, Ile, Leu, Val Ala, or Gly
  SITE (500)..(500): Xaa at position 500 is Val, Ala, Gly, Leu, or Ile
  SITE (503)..(503): Xaa at position 503 is Ile, Ala, Val, Leu, or Gly
  SITE (504)..(504): Xaa at position 504 is Ile, Ala, Val, Leu, or Gly
  SITE (505)..(505): Xaa at position 505 is Trp, Tyr, Phe, Met, His, Ile, Leu Val, Ala, or Gly
MXAXTRDPQXQKXQQXYREHRSELNXRRLFDANKDRFNHXSLTLNTNHGHXLXDXSKNXXTEDXMRXXVDXXKSRGXEXXRERXFNGEKINYTEGRXXXXXXXRNRSNTPXLVDGKDXMPEVNKXLDKXKSXXQRXRSGDWKGYTGKTXTDXXNXGIGGSDLGPLXXTEXXKPYSSGGPRVWYXSNIDGTHXAKTLAQLNPESSXXXXXSKTXTTQETITNXETXKEWXLQAXKDPSXXAKXXXXXSTNTTKXKEXGXDPQNMXEXWDXXGGRXSXXSXXGXSXXXHVGFDNXEQXXSGXHWXDQHXRTTPXEKNXPXXXXXXGXXYINCFGCETHXXXPXDQYXHRXAAYXQQGDMESNGKYITKSGTRVDHQTGPIXWGEPGTNGQHAFXQLXHQGTKMIPXDXXXPVQTQHPIRKGLHHKILLANXLAQTEAXXRGKSTEEXRKELQAAGKSPEDLERLXPHKVFEGNRPTNSXVXTKXTPFXXGXXXXXXEXKXXXQGXXXDINSFDQWGVELGKQLAKKIEPELDGSAQVTSHDASTNGLINFIKQQREARVQ

SEQ ID NO: 222 - protein, 235 aa, Mus musculus
  SITE (93)..(93): Xaa at position 93 is Ala, Gly, or Pro
  SITE (95)..(95): Xaa at position 95 is Val, Ala, Gly, Leu, or Ile
  SITE (127)..(127): Xaa at position 127 is Leu, Ala, Val, Gly, or Ile
  SITE (137)..(137): Xaa at position 137 is Val, Ala, Gly, Leu, or Ile
  SITE (141)..(141): Xaa at position 141 is Val, Ala, Gly, Leu, or Ile
  SITE (143)..(143): Xaa at position 143 is Phe, Tyr, Met, His, Ile, Leu, Val Ala, or Gly
  SITE (154)..(154): Xaa at position 154 is Leu, Ala, Val, Gly, or Ile
  SITE (156)..(156): Xaa at position 156 is His, Phe, Tyr, Lys, Arg, Gly, Ser Thr, Ala, Val, Leu, Ile, Asn, Met, or Gln
  SITE (158)..(158): Xaa at position 158 is Val, Ala, Gly, Leu, or Ile
  SITE (179)..(179): Xaa at position 179 is Cys, Ala, Val, Gly, Ser, or Thr
  SITE (204)..(204): Xaa at position 204 is Leu, Ala, Val, Gly, or Ile
  SITE (210)..(210): Xaa at position 210 is Leu, Ala, Val, Gly, or Ile
  SITE (212)..(212): Xaa at position 212 is Ala, Gly, or Pro
  SITE (230)..(230): Xaa at position 230 is Phe, Tyr, Met, His, Ile, Leu, Val Ala, or Gly
  SITE (232)..(232): Xaa at position 232 is Val, Ala, Gly, Leu, or Ile
MSTESMIRDVELAEEALPQKMGGFQNSRRCLCLSLFSFLLVAGATTLFCLLNFGVIGPQRDEKFPNGLPLISSMAQTLTLRSSSQNSSDKPVXHXVANHQVEEQLEWLSQRANALLANGMDLKDNQXVVPADGLYLXYSQXLXKGQGCPDYVLXTXTXSRFAISYQEKVNLLSAVKSPXPKDTPEGAELKPWYEPIYLGGVFQXEKGDQXSXEVNLPKYLDFAESGQVYXGXIAL

SEQ ID NO: 223 - protein, 529 aa, Homo sapiens
  SITE (24)..(24): Xaa at position 24 is Trp, Tyr, Phe, Met, His, Ile, Leu Val, Ala, or Gly
  SITE (37)..(37): Xaa at position 37 is Tyr, Phe, Met, His, Ile, Leu, Val Ala, or Gly
  SITE (60)..(60): Xaa at position 60 is Val, Ala, Gly, Leu, or Ile
  SITE (61)..(61): Xaa at position 61 is Leu, Ala, Val, Gly, or Ile
  SITE (64)..(64): Xaa at position 64 is Ala, Gly, or Pro
  SITE (90)..(90): Xaa at position 90 is Leu, Ala, Val, Gly, or Ile
  SITE (94)..(94): Xaa at position 94 is Val, Ala, Gly, Leu, or Ile
  SITE (95)..(95): Xaa at position 95 is Leu, Ala, Val, Gly, or Ile
  SITE (96)..(96): Xaa at position 96 is Val, Ala, Gly, Leu, or Ile
  SITE (97)..(97): Xaa at position 97 is Val, Ala, Gly, Leu, or Ile
  SITE (116)..(116): Xaa at position 116 is Tyr, Phe, Met, His, Ile, Leu, Val Ala, or Gly
  SITE (118)..(118): Xaa at position 118 is Leu, Ala, Val, Gly, or Ile
  SITE (120)..(120): Xaa at position 120 is Ile, Ala, Val, Leu, or Gly
  SITE (125)..(125): Xaa at position 125 is Cys, Ala, Val, Gly, Ser, or Thr
  SITE (127)..(127): Xaa at position 127 is Leu, Ala, Val, Gly, or Ile
  SITE (132)..(132): Xaa at position 132 is Val, Ala, Gly, Leu, or Ile
  SITE (133)..(133): Xaa at position 133 is Trp, Tyr, Phe, Met, His, Ile, Leu Val, Ala, or Gly
  SITE (135)..(135): Xaa at position 135 is Ala, Gly, or Pro
  SITE (136)..(136): Xaa at position 136 is Leu, Ala, Val, Gly, or Ile
  SITE (139)..(139): Xaa at position 139 is Leu, Ala, Val, Gly, or Ile
  SITE (142)..(142): Xaa at position 142 is Phe, Tyr, Met, His, Ile, Leu, Val Ala, or Gly
  SITE (156)..(156): Xaa at position 156 is Ile, Ala, Val, Leu, or Gly
  SITE (161)..(161): Xaa at position 161 is Ile, Ala, Val, Leu, or Gly
  SITE (169)..(169): Xaa at position 169 is His, Phe, Tyr, Lys, Arg, Gly, Ser Thr, Ala, Val, Leu, Ile, Asn, Met, or Gln
  SITE (172)..(172): Xaa at position 172 is Leu, Ala, Val, Gly, or Ile
  SITE (173)..(173): Xaa at position 173 is Leu, Ala, Val, Gly, or Ile
  SITE (174)..(174): Xaa at position 174 is Leu, Ala, Val, Gly, or Ile
  SITE (181)..(181): Xaa at position 181 is Leu, Ala, Val, Gly, or Ile
  SITE (186)..(186): Xaa at position 186 is Ile, Ala, Val, Leu, or Gly
  SITE (190)..(190): Xaa at position 190 is Leu, Ala, Val, Gly, or Ile
  SITE (192)..(192): Xaa at position 192 is Val, Ala, Gly, Leu, or Ile
  SITE (193)..(193): Xaa at position 193 is Met, Ile, Leu, Val, Ala, or Gly
  SITE (198)..(198): Xaa at position 198 is Leu, Ala, Val, Gly, or Ile
  SITE (200)..(200): Xaa at position 200 is Val, Ala, Gly, Leu, or Ile
  SITE (201)..(201): Xaa at position 201 is Phe, Tyr, Met, His, Ile, Leu, Val Ala, or Gly
  SITE (202)..(202): Xaa at position 202 is His, Phe, Tyr, Lys, Arg, Gly, Ser Thr, Ala, Val, Leu, Ile, Asn, Met, or Gln
  SITE (203)..(203): Xaa at position 203 is Trp, Tyr, Phe, Met, His, Ile, Leu Val, Ala, or Gly
  SITE (204)..(204): Xaa at position 204 is His, Phe, Tyr, Lys, Arg, Gly, Ser Thr, Ala, Val, Leu, Ile, Asn, Met, or Gln
  SITE (205)..(205): Xaa at position 205 is Leu, Ala, Val, Gly, or Ile
  SITE (206)..(206): Xaa at position 206 is Val, Ala, Gly, Leu, or Ile
  SITE (211)..(211): Xaa at position 211 is Phe, Tyr, Met, His, Ile, Leu, Val Ala, or Gly
  SITE (216)..(216): Xaa at position 216 is Phe, Tyr, Met, His, Ile, Leu, Val Ala, or Gly
  SITE (221)..(221): Xaa at position 221 is Leu, Ala, Val, Gly, or Ile
  SITE (234)..(234): Xaa at position 234 is Tyr, Phe, Met, His, Ile, Leu, Val Ala, or Gly
  SITE (239)..(239): Xaa at position 239 is Val, Ala, Gly, Leu, or Ile
  SITE (242)..(242): Xaa at position 242 is Val, Ala, Gly, Leu, or Ile
  SITE (246)..(246): Xaa at position 246 is Ala, Gly, or Pro
  SITE (251)..(251): Xaa at position 251 is Ile, Ala, Val, Leu, or Gly
  SITE (253)..(253): Xaa at position 253 is Val, Ala, Gly, Leu, or Ile
  SITE (254)..(254): Xaa at position 254 is Leu, Ala, Val, Gly, or Ile
  SITE (255)..(255): Xaa at position 255 is Ala, Gly, or Pro
  SITE (257)..(257): Xaa at position 257 is Phe, Tyr, Met, His, Ile, Leu, Val Ala, or Gly
  SITE (264)..(264): Xaa at position 264 is Leu, Ala, Val, Gly, or Ile
  SITE (266)..(266): Xaa at position 266 is Trp, Tyr, Phe, Met, His, Ile, Leu Val, Ala, or Gly
  SITE (273)..(273): Xaa at position 273 is Leu, Ala, Val, Gly, or Ile
  SITE (290)..(290): Xaa at position 290 is Val, Ala, Gly, Leu, or Ile
  SITE (300)..(300): Xaa at position 300 is Phe, Tyr, Met, His, Ile, Leu, Val Ala, or Gly
  SITE (301)..(301): Xaa at position 301 is Met, Ile, Leu, Val, Ala, or Gly
  SITE (304)..(304): Xaa at position 304 is Phe, Tyr, Met, His, Ile, Leu, Val Ala, or Gly
  SITE (305)..(305): Xaa at position 305 is Phe, Tyr, Met, His, Ile, Leu, Val Ala, or Gly
  SITE (308)..(308): Xaa at position 308 is Val, Ala, Gly, Leu, or Ile
  SITE (312)..(312): Xaa at position 312 is Phe, Tyr, Met, His, Ile, Leu, Val Ala, or Gly
  SITE (317)..(317): Xaa at position 317 is Leu, Ala, Val, Gly, or Ile
  SITE (318)..(318): Xaa at position 318 is His, Phe, Tyr, Lys, Arg, Gly, Ser Thr, Ala, Val, Leu, Ile, Asn, Met, or Gln
  SITE (319)..(319): Xaa at position 319 is Leu, Ala, Val, Gly, or Ile
  SITE (326)..(326): Xaa at position 326 is Phe, Tyr, Met, His, Ile, Leu, Val Ala, or Gly
  SITE (329)..(329): Xaa at position 329 is Trp, Tyr, Phe, Met, His, Ile, Leu Val, Ala, or Gly
  SITE (335)..(335): Xaa at position 335 is Ile, Ala, Val, Leu, or Gly
  SITE (339)..(339): Xaa at position 339 is Met, Ile, Leu, Val, Ala, or Gly
  SITE (351)..(351): Xaa at position 351 is Leu, Ala, Val, Gly, or Ile
  SITE (354)..(354): Xaa at position 354 is Phe, Tyr, Met, His, Ile, Leu, Val Ala, or Gly
  SITE (355)..(355): Xaa at position 355 is Tyr, Phe, Met, His, Ile, Leu, Val Ala, or Gly
  SITE (356)..(356): Xaa at position 356 is Ile, Ala, Val, Leu, or Gly
  SITE (359)..(359): Xaa at position 359 is Leu, Ala, Val, Gly, or Ile
  SITE (360)..(360): Xaa at position 360 is Leu, Ala, Val, Gly, or Ile
  SITE (363)..(363): Xaa at position 363 is Val, Ala, Gly, Leu, or Ile
  SITE (366)..(366): Xaa at position 366 is Tyr, Phe, Met, His, Ile, Leu, Val Ala, or Gly
  SITE (371)..(371): Xaa at position 371 is Val, Ala, Gly, Leu, or Ile
  SITE (372)..(372): Xaa at position 372 is Val, Ala, Gly, Leu, or Ile
  SITE (373)..(373): Xaa at position 373 is Trp, Tyr, Phe, Met, His, Ile, Leu Val, Ala, or Gly
  SITE (376)..(376): Xaa at position 376 is Val, Ala, Gly, Leu, or Ile
  SITE (389)..(389): Xaa at position 389 is Ile, Ala, Val, Leu, or Gly
  SITE (391)..(391): Xaa at position 391 is Val, Ala, Gly, Leu, or Ile
  SITE (398)..(398): Xaa at position 398 is Val, Ala, Gly, Leu, or Ile
  SITE (400)..(400): Xaa at position 400 is Tyr, Phe, Met, His, Ile, Leu, Val Ala, or Gly
  SITE (404)..(404): Xaa at position 404 is Leu, Ala, Val, Gly, or Ile
  SITE (407)..(407): Xaa at position 407 is Val, Ala, Gly, Leu, or Ile
  SITE (414)..(414): Xaa at position 414 is Ala, Gly, or Pro
  SITE (415)..(415): Xaa at position 415 is Leu, Ala, Val, Gly, or Ile
  SITE (416)..(416): Xaa at position 416 is Leu, Ala, Val, Gly, or Ile
  SITE (420)..(420): Xaa at position 420 is Trp, Tyr, Phe, Met, His, Ile, Leu Val, Ala, or Gly
  SITE (422)..(422): Xaa at position 422 is Leu, Ala, Val, Gly, or Ile
  SITE (434)..(434): Xaa at position 434 is Phe, Tyr, Met, His, Ile, Leu, Val Ala, or Gly
  SITE (435)..(435): Xaa at position 435 is Tyr, Phe, Met, His, Ile, Leu, Val Ala, or Gly
  SITE (457)..(457): Xaa at position 457 is Ala, Gly, or Pro
  SITE (458)..(458): Xaa at position 458 is Cys, Ala, Val, Gly, Ser, or Thr
  SITE (459)..(459): Xaa at position 459 is Met, Ile, Leu, Val, Ala, or Gly
  SITE (469)..(469): Xaa at position 469 is Leu, Ala, Val, Gly, or Ile
  SITE (473)..(473): Xaa at position 473 is Leu, Ala, Val, Gly, or Ile
  SITE (474)..(474): Xaa at position 474 is Trp, Tyr, Phe, Met, His, Ile, Leu Val, Ala, or Gly
  SITE (477)..(477): Xaa at position 477 is Ala, Gly, or Pro
  SITE (479)..(479): Xaa at position 479 is Ala, Gly, or Pro
  SITE (480)..(480): Xaa at position 480 is Val, Ala, Gly, Leu, or Ile
  SITE (481)..(481): Xaa at position 481 is Ala, Gly, or Pro
  SITE (484)..(484): Xaa at position 484 is Leu, Ala, Val, Gly, or Ile
  SITE (485)..(485): Xaa at position 485 is Trp, Tyr, Phe, Met, His, Ile, Leu Val, Ala, or Gly
  SITE (496)..(496): Xaa at position 496 is Ala, Gly, or Pro
  SITE (500)..(500): Xaa at position 500 is Leu, Ala, Val, Gly, or Ile
  SITE (503)..(503): Xaa at position 503 is Phe, Tyr, Met, His, Ile, Leu, Val Ala, or Gly
  SITE (507)..(507): Xaa at position 507 is Leu, Ala, Val, Gly, or Ile
  SITE (519)..(519): Xaa at position 519 is Val, Ala, Gly, Leu, or Ile
MTSSRLWFSLLLAAAFAGRATALXPWPQNFQTSDQRXVLYPNNFQFQYDVSSAAQPGCSXXDEXFQRYRDLLFGSGSWPRPYLTGKRHTXEKNXXXXSVVTPGCNQLPTLESVENXTXTXNDDQXLXLSETXXGXXRGXETXSQLVWKSAEGTFFXNKTEXEDFPRFPXRGXXXDTSRHYXPLSSXLDTXDXXAYNKXNXXXXXXXDDPSXPYESXTFPEXMRKGSYNPVTHIXTAQDXKEXIEYXRLRGXRXXXEXDTPGHTXSXGPGIPGXLTPCYSGSEPSGTFGPXNPSLNNTYEXXSTXXLEXSSVXPDFYXXXGGDEVDXTCXKSNPEXQDFXRKKGFGEDFKQXESXXXQTXXDIXSSXGKGYXXXQEXFDNKVKIQPDTIXQXWREDIPXNXMKEXELXTKAGFRXXXSAPXYXNRISYGPDWKDXXIVEPLAFEGTPEQKALVIGGEXXXWGEYVDNTNXVPRXXPRXGXXXERXXSNKLTSDLTFXYERXSHXRCEXLRRGVQAQPLNXGFCEQEFEQT

SEQ ID NO: 224 - protein, 575 aa, Homo sapiens
  SITE (369)..(369): Xaa at position 369 is Cys, Ala, Val, Gly, Ser, or Thr
  SITE (388)..(388): Xaa at position 388 is Cys, Ala, Val, Gly, Ser, or Thr
  SITE (390)..(390): Xaa at position 390 is Cys, Ala, Val, Gly, Ser, or Thr
  SITE (413)..(413): Xaa at position 413 is Cys, Ala, Val, Gly, Ser, or Thr
  SITE (439)..(439): Xaa at position 439 is Cys, Ala, Val, Gly, Ser, or Thr
  SITE (464)..(464): Xaa at position 464 is Cys, Ala, Val, Gly, Ser, or Thr
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPXFRANCEYQCQPLNQTSYLXVXAEGFAPIPHEPHRCQMFCNQTAXPADCDPNTQASCECPEGYILDDGFIXTDIDECENGGFCSGVCHNLPGTFEXICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 225 - protein, 676 aa, Homo sapiens
  SITE (212)..(212): Xaa at position 212 is Cys, Ala, Val, Gly, Ser, or Thr
  SITE (241)..(241): Xaa at position 241 is Cys, Ala, Val, Gly, Ser, or Thr
  SITE (265)..(265): Xaa at position 265 is Cys, Ala, Val, Gly, Ser, or Thr
  SITE (267)..(267): Xaa at position 267 is Cys, Ala, Val, Gly, Ser, or Thr
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSIXGTAVCKNIPGDFECECPEGYRYNLKSKSXEDIDECSENMCAQLCVNYPGGYTXYXDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 226 - protein, 261 aa, Homo sapiens
  SITE (25)..(25): Xaa at position 25 is Ile, Ala, Val, Leu, or Gly
  SITE (40)..(40): Xaa at position 40 is Val, Ala, Gly, Leu, or Ile
  SITE (42)..(42): Xaa at position 42 is Val, Ala, Gly, Leu, or Ile
  SITE (53)..(53): Xaa at position 53 is Val, Ala, Gly, Leu, or Ile
  SITE (54)..(54): Xaa at position 54 is Leu, Ala, Val, Gly, or Ile
  SITE (55)..(55): Xaa at position 55 is Val, Ala, Gly, Leu, or Ile
  SITE (60)..(60): Xaa at position 60 is Val, Ala, Gly, Leu, or Ile
  SITE (61)..(61): Xaa at position 61 is Leu, Ala, Val, Gly, or Ile
  SITE (63)..(63): Xaa at position 63 is Ala, Gly, or Pro
  SITE (64)..(64): Xaa at position 64 is Ala, Gly, or Pro
  SITE (66)..(66): Xaa at position 66 is Cys, Ala, Val, Gly, Ser, or Thr
  SITE (73)..(73): Xaa at position 73 is Ile, Ala, Val, Leu, or Gly
  SITE (75)..(75): Xaa at position 75 is Leu, Ala, Val, Gly, or Ile
  SITE (90)..(90): Xaa at position 90 is Phe, Tyr, Met, His, Ile, Leu, Val Ala, or Gly
  SITE (92)..(92): Xaa at position 92 is Val, Ala, Gly, Leu, or Ile
  SITE (121)..(121): Xaa at position 121 is Leu, Ala, Val, Gly, or Ile
  SITE (123)..(123): Xaa at position 123 is Leu, Ala, Val, Gly, or Ile
  SITE (124)..(124): Xaa at position 124 is Leu, Ala, Val, Gly, or Ile
  SITE (126)..(126): Xaa at position 126 is Leu, Ala, Val, Gly, or Ile
  SITE (132)..(132): Xaa at position 132 is Leu, Ala, Val, Gly, or Ile
  SITE (135)..(135): Xaa at position 135 is Ala, Gly, or Pro
  SITE (136)..(136): Xaa at position 136 is Val, Ala, Gly, Leu, or Ile
  SITE (152)..(152): Xaa at position 152 is Cys, Ala, Val, Gly, Ser, or Thr
  SITE (154)..(154): Xaa at position 154 is Ala, Gly, or Pro
  SITE (165)..(165): Xaa at position 165 is Phe, Tyr, Met, His, Ile, Leu, Val Ala, or Gly
  SITE (174)..(174): Xaa at position 174 is Val, Ala, Gly, Leu, or Ile
  SITE (176)..(176): Xaa at position 176 is Leu, Ala, Val, Gly, or Ile
  SITE (184)..(184): Xaa at position 184 is Cys, Ala, Val, Gly, Ser, or Thr
  SITE (198)..(198): Xaa at position 198 is Cys, Ala, Val, Gly, Ser, or Thr
  SITE (199)..(199): Xaa at position 199 is Ala, Gly, or Pro
  SITE (217)..(217): Xaa at position 217 is Leu, Ala, Val, Gly, or Ile
  SITE (219)..(219): Xaa at position 219 is Cys, Ala, Val, Gly, Ser, or Thr
  SITE (223)..(223): Xaa at position 223 is Leu, Ala, Val, Gly, or Ile
  SITE (226)..(226): Xaa at position 226 is Ile, Ala, Val, Leu, or Gly
  SITE (242)..(242): Xaa at position 242 is Leu, Ala, Val, Gly, or Ile
  SITE (243)..(243): Xaa at position 243 is Tyr, Phe, Met, His, Ile, Leu, Val Ala, or Gly
  SITE (246)..(246): Xaa at position 246 is Val, Ala, Gly, Leu, or Ile
MWVPVVFLTLSVTWIGAAPLILSRXVGGWECEKHSQPWQXLXASRGRAVCGGXXXHPQWXXTXXHXIRNKSVXLXGRHSLFHPEDTGQVXQXSHSFPHPLYDMSLLKNRFLRPGDDSSHDXMXXRXSEPAEXTDXXKVMDLPTQEPALGTTXYXSGWGSIEPEEXLTPKKLQCXDXHVISNDVXAQVHPQKVTKFMLXXGRWTGGKSTCSGDSGGPXVXNGVXQGXTSWGSEPCALPERPSXXTKXVHYRKWIKDTIVANP

SEQ ID NO: 227 - protein, 412 aa, Homo sapiens
  SITE (71)..(71): Xaa at position 71 is Leu, Ala, Val, Gly, or Ile
  SITE (83)..(83): Xaa at position 83 is Ile, Ala, Val, Leu, or Gly
  SITE (85)..(85): Xaa at position 85 is Ile, Ala, Val, Leu, or Gly
  SITE (92)..(92): Xaa at position 92 is Phe, Tyr, Met, His, Ile, Leu, Val Ala, or Gly
  SITE (94)..(94): Xaa at position 94 is Val, Ala, Gly, Leu, or Ile
  SITE (95)..(95): Xaa at position 95 is Val, Ala, Gly, Leu, or Ile
  SITE (104)..(104): Xaa at position 104 is Trp, Tyr, Phe, Met, His, Ile, Leu Val, Ala, or Gly
  SITE (105)..(105): Xaa at position 105 is Val, Ala, Gly, Leu, or Ile
  SITE (117)..(117): Xaa at position 117 is Cys, Ala, Val, Gly, Ser, or Thr
  SITE (123)..(123): Xaa at position 123 is Tyr, Phe, Met, His, Ile, Leu, Val Ala, or Gly
  SITE (147)..(147): Xaa at position 147 is Leu, Ala, Val, Gly, or Ile
  SITE (156)..(156): Xaa at position 156 is Val, Ala, Gly, Leu, or Ile
  SITE (179)..(179): Xaa at position 179 is Phe, Tyr, Met, His, Ile, Leu, Val Ala, or Gly
  SITE (190)..(190): Xaa at position 190 is Phe, Tyr, Met, His, Ile, Leu, Val Ala, or Gly
  SITE (195)..(195): Xaa at position 195 is Phe, Tyr, Met, His, Ile, Leu, Val Ala, or Gly
  SITE (198)..(198): Xaa at position 198 is Ile, Ala, Val, Leu, or Gly
  SITE (199)..(199): Xaa at position 199 is Leu, Ala, Val, Gly, or Ile
  SITE (201)..(201): Xaa at position 201 is Met, Ile, Leu, Val, Ala, or Gly
  SITE (214)..(214): Xaa at position 214 is Val, Ala, Gly, Leu, or Ile
  SITE (215)..(215): Xaa at position 215 is Phe, Tyr, Met, His, Ile, Leu, Val Ala, or Gly
  SITE (218)..(218): Xaa at position 218 is Leu, Ala, Val, Gly, or Ile
  SITE (229)..(229): Xaa at position 229 is Phe, Tyr, Met, His, Ile, Leu, Val Ala, or Gly
  SITE (268)..(268): Xaa at position 268 is Ala, Gly, or Pro
  SITE (270)..(270): Xaa at position 270 is Trp, Tyr, Phe, Met, His, Ile, Leu Val, Ala, or Gly
  SITE (272)..(272): Xaa at position 272 is Val, Ala, Gly, Leu, or Ile
  SITE (274)..(274): Xaa at position 274 is Leu, Ala, Val, Gly, or Ile
  SITE (277)..(277): Xaa at position 277 is Val, Ala, Gly, Leu, or Ile
  SITE (279)..(279): Xaa at position 279 is Val, Ala, Gly, Leu, or Ile
  SITE (285)..(285): Xaa at position 285 is Leu, Ala, Val, Gly, or Ile
  SITE (292)..(292): Xaa at position 292 is Ala, Gly, or Pro
  SITE (294)..(294): Xaa at position 294 is Val, Ala, Gly, Leu, or Ile
  SITE (301)..(301): Xaa at position 301 is Met, Ile, Leu, Val, Ala, or Gly
  SITE (308)..(308): Xaa at position 308 is Val, Ala, Gly, Leu, or Ile
  SITE (311)..(311): Xaa at position 311 is Leu, Ala, Val, Gly, or Ile
  SITE (317)..(317): Xaa at position 317 is Ala, Gly, or Pro
  SITE (327)..(327): Xaa at position 327 is Ile, Ala, Val, Leu, or Gly
  SITE (338)..(338): Xaa at position 338 is Ile, Ala, Val, Leu, or Gly
  SITE (340)..(340): Xaa at position 340 is Leu, Ala, Val, Gly, or Ile
  SITE (342)..(342): Xaa at position 342 is Leu, Ala, Val, Gly, or Ile
  SITE (349)..(349): Xaa at position 349 is Leu, Ala, Val, Gly, or Ile
  SITE (354)..(354): Xaa at position 354 is Tyr, Phe, Met, His, Ile, Leu, Val Ala, or Gly
  SITE (370)..(370): Xaa at position 370 is Phe, Tyr, Met, His, Ile, Leu, Val Ala, or Gly
  SITE (382)..(382): Xaa at position 382 is Leu, Ala, Val, Gly, or Ile
  SITE (385)..(385): Xaa at position 385 is Leu, Ala, Val, Gly, or Ile
  SITE (388)..(388): Xaa at position 388 is Val, Ala, Gly, Leu, or Ile
  SITE (389)..(389): Xaa at position 389 is Phe, Tyr, Met, His, Ile, Leu, Val Ala, or Gly
  SITE (390)..(390): Xaa at position 390 is Ile, Ala, Val, Leu, or Gly
  SITE (394)..(394): Xaa at position 394 is Tyr, Phe, Met, His, Ile, Leu, Val Ala, or Gly
  SITE (396)..(396): Xaa at position 396 is Val, Ala, Gly, Leu, or Ile
  SITE (397)..(397): Xaa at position 397 is Phe, Tyr, Met, His, Ile, Leu, Val Ala, or Gly
  SITE (404)..(404): Xaa at position 404 is Val, Ala, Gly, Leu, or Ile
  SITE (406)..(406): Xaa at position 406 is Phe, Tyr, Met, His, Ile, Leu, Val Ala, or Gly
  SITE (407)..(407): Xaa at position 407 is Ala, Gly, or Pro
MQPSSLLPLALCLLAAPASALVRIPLHKFTSIRRTMSEVGGSVEDLIAKGPVSKYSQAVPAVTEGPIPEVXKNYMDAQYYGEXGXGTPPQCXTXXFDTGSSNLXXPSIHCKLLDIAXWIHHKXNSDKSSTYVKNGTSFDIHYGSGSXSGYLSQDTXSVPCQSASSASALGGVKVERQVXGEATKQPGITXIAAKXDGXXGXAYPRISVNNVLPXXDNXMQQKLVDQNIXSFYLSRDPDAQPGGELMLGGTDSKYYKGSLSYLNVTRKXYXQXHXDQXEXASGLTXCKEGCEXIXDTGTSLXVGPVDEXREXQKAIGXVPLIQGEYMXPCEKVSTLPAXTXKXGGKGYKXSPEDXTLKVSQAGKTLCLSGXMGMDIPPPSGPXWIXGDXXXGRYXTXXDRDNNRXGXXEAARL

SEQ ID NO: 228 - protein, 247 aa, Homo sapiens
  SITE (24)..(24): Xaa at position 24 is Ile, Ala, Val, Leu, or Gly
  SITE (39)..(39): Xaa at position 39 is Val, Ala, Gly, Leu, or Ile
  SITE (41)..(41): Xaa at position 41 is Leu, Ala, Val, Gly, or Ile
  SITE (52)..(52): Xaa at position 52 is Leu, Ala, Val, Gly, or Ile
  SITE (57)..(57): Xaa at position 57 is Trp, Tyr, Phe, Met, His, Ile, Leu Val, Ala, or Gly
  SITE (58)..(58): Xaa at position 58 is Val, Ala, Gly, Leu, or Ile
  SITE (59)..(59): Xaa at position 59 is Val, Ala, Gly, Leu, or Ile
  SITE (61)..(61): Xaa at position 61 is Ala, Gly, or Pro
  SITE (64)..(64): Xaa at position 64 is Cys, Ala, Val, Gly, Ser, or Thr
  SITE (69)..(69): Xaa at position 69 is Ile, Ala, Val, Leu, or Gly
  SITE (71)..(71): Xaa at position 71 is Val, Ala, Gly, Leu, or Ile
  SITE (73)..(73): Xaa at position 73 is Leu, Ala, Val, Gly, or Ile
  SITE (80)..(80): Xaa at position 80 is Val, Ala, Gly, Leu, or Ile
  SITE (81)..(81): Xaa at position 81 is Leu, Ala, Val, Gly, or Ile
  SITE (87)..(87): Xaa at position 87 is Phe, Tyr, Met, His, Ile, Leu, Val Ala, or Gly
  SITE (88)..(88): Xaa at position 88 is Ile, Ala, Val, Leu, or Gly
  SITE (108)..(108): Xaa at position 108 is Ile, Ala, Val, Leu, or Gly
  SITE (109)..(109): Xaa at position 109 is Met, Ile, Leu, Val, Ala, or Gly
  SITE (110)..(110): Xaa at position 110 is Leu, Ala, Val, Gly, or Ile
  SITE (111)..(111): Xaa at position 111 is Ile, Ala, Val, Leu, or Gly
  SITE (113)..(113): Xaa at position 113 is Leu, Ala, Val, Gly, or Ile
  SITE (119)..(119): Xaa at position 119 is Ile, Ala, Val, Leu, or Gly
  SITE (123)..(123): Xaa at position 123 is Val, Ala, Gly, Leu, or Ile
  SITE (126)..(126): Xaa at position 126 is Ile, Ala, Val, Leu, or Gly
  SITE (128)..(128): Xaa at position 128 is Leu, Ala, Val, Gly, or Ile
  SITE (139)..(139): Xaa at position 139 is Cys, Ala, Val, Gly, Ser, or Thr
  SITE (141)..(141): Xaa at position 141 is Ile, Ala, Val, Leu, or Gly
  SITE (144)..(144): Xaa at position 144 is Trp, Tyr, Phe, Met, His, Ile, Leu Val, Ala, or Gly
  SITE (160)..(160): Xaa at position 160 is Cys, Ala, Val, Gly, Ser, or Thr
  SITE (163)..(163): Xaa at position 163 is Ala, Gly, or Pro
  SITE (171)..(171): Xaa at position 171 is Cys, Ala, Val, Gly, Ser, or Thr
  SITE (173)..(173): Xaa at position 173 is Ala, Gly, or Pro
  SITE (175)..(175): Xaa at position 175 is Tyr, Phe, Met, His, Ile, Leu, Val Ala, or Gly
  SITE (184)..(184): Xaa at position 184 is Phe, Tyr, Met, His, Ile, Leu, Val Ala, or Gly
  SITE (185)..(185): Xaa at position 185 is Cys, Ala, Val, Gly, Ser, or Thr
  SITE (186)..(186): Xaa at position 186 is Val, Ala, Gly, Leu, or Ile
  SITE (204)..(204): Xaa at position 204 is Val, Ala, Gly, Leu, or Ile
  SITE (206)..(206): Xaa at position 206 is Cys, Ala, Val, Gly, Ser, or Thr
  SITE (210)..(210): Xaa at position 210 is Leu, Ala, Val, Gly, or Ile
  SITE (213)..(213): Xaa at position 213 is Val, Ala, Gly, Leu, or Ile
  SITE (214)..(214): Xaa at position 214 is Val, Ala, Gly, Leu, or Ile
  SITE (228)..(228): Xaa at position 228 is Val, Ala, Gly, Leu, or Ile
  SITE (229)..(229): Xaa at position 229 is Tyr, Phe, Met, His, Ile, Leu, Val Ala, or Gly
  SITE (232)..(232): Xaa at position 232 is Val, Ala, Gly, Leu, or Ile
  SITE (235)..(235): Xaa at position 235 is Tyr, Phe, Met, His, Ile, Leu, Val Ala, or Gly
  SITE (236)..(236): Xaa at position 236 is Val, Ala, Gly, Leu, or Ile
  SITE (239)..(239): Xaa at position 239 is Ile, Ala, Val, Leu, or Gly
MNPLLILTFVAAALAAPFDDDDKXVGGYNCEENSVPYQXSXNSGYHFCGGSXINEQXXXSXGHXYKSRXQXRXGEHNIEXXEGNEQXXNAAKIIRHPQYDRKTLNNDXXXXKXSSRAVXNARXSTXSXPTAPPATGTKXLXSGXGNTASSGADYPDELQXLDXPVLSQAKXEXSXPGKITSNMXXXGFLEGGKDSCQGDSGGPXVXNGQXQGXXSWGDGCAQKNKPGXXTKXYNXXKWXKNTIAANS

SEQ ID NO: 229 - protein, 359 aa, Homo sapiens
  SITE (65)..(65): Xaa at position 65 is Val, Ala, Gly, Leu, or Ile
  SITE (67)..(67): Xaa at position 67 is Cys, Ala, Val, Gly, Ser, or Thr
  SITE (75)..(75): Xaa at position 75 is Val, Ala, Gly, Leu, or Ile
  SITE (86)..(86): Xaa at position 86 is Leu, Ala, Val, Gly, or Ile
  SITE (88)..(88): Xaa at position 88 is Leu, Ala, Val, Gly, or Ile
  SITE (93)..(93): Xaa at position 93 is Ile, Ala, Val, Leu, or Gly
  SITE (96)..(96): Xaa at position 96 is Ile, Ala, Val, Leu, or Gly
  SITE (101)..(101): Xaa at position 101 is Phe, Tyr, Met, His, Ile, Leu, Val Ala, or Gly
  SITE (107)..(107): Xaa at position 107 is Leu, Ala, Val, Gly, or Ile
  SITE (110)..(110): Xaa at position 110 is Leu, Ala, Val, Gly, or Ile
  SITE (112)..(112): Xaa at position 112 is Leu, Ala, Val, Gly, or Ile
  SITE (117)..(117): Xaa at position 117 is Ile, Ala, Val, Leu, or Gly
  SITE (124)..(124): Xaa at position 124 is Ala, Gly, or Pro
  SITE (125)..(125): Xaa at position 125 is Phe, Tyr, Met, His, Ile, Leu, Val Ala, or Gly
  SITE (128)..(128): Xaa at position 128 is Leu, Ala, Val, Gly, or Ile
  SITE (131)..(131): Xaa at position 131 is Leu, Ala, Val, Gly, or Ile
  SITE (134)..(134): Xaa at position 134 is Leu, Ala, Val, Gly, or Ile
  SITE (136)..(136): Xaa at position 136 is Leu, Ala, Val, Gly, or Ile
  SITE (144)..(144): Xaa at position 144 is Leu, Ala, Val, Gly, or Ile
  SITE (152)..(152): Xaa at position 152 is Leu, Ala, Val, Gly, or Ile
  SITE (155)..(155): Xaa at position 155 is Leu, Ala, Val, Gly, or Ile
  SITE (157)..(157): Xaa at position 157 is Ala, Gly, or Pro
  SITE (162)..(162): Xaa at position 162 is Ile, Ala, Val, Leu, or Gly
  SITE (165)..(165): Xaa at position 165 is Val, Ala, Gly, Leu, or Ile
  SITE (170)..(170): Xaa at position 170 is Phe, Tyr, Met, His, Ile, Leu, Val Ala, or Gly
  SITE (173)..(173): Xaa at position 173 is Leu, Ala, Val, Gly, or Ile
  SITE (176)..(176): Xaa at position 176 is Met, Ile, Leu, Val, Ala, or Gly
  SITE (179)..(179): Xaa at position 179 is Ile, Ala, Val, Leu, or Gly
  SITE (181)..(181): Xaa at position 181 is Leu, Ala, Val, Gly, or Ile
  SITE (186)..(186): Xaa at position 186 is Leu, Ala, Val, Gly, or Ile
  SITE (195)..(195): Xaa at position 195 is Ala, Gly, or Pro
  SITE (196)..(196): Xaa at position 196 is Phe, Tyr, Met, His, Ile, Leu, Val Ala, or Gly
  SITE (199)..(199): Xaa at position 199 is Met, Ile, Leu, Val, Ala, or Gly
  SITE (202)..(202): Xaa at position 202 is Leu, Ala, Val, Gly, or Ile
  SITE (205)..(205): Xaa at position 205 is Ile, Ala, Val, Leu, or Gly
  SITE (207)..(207): Xaa at position 207 is Ile, Ala, Val, Leu, or Gly
  SITE (208)..(208): Xaa at position 208 is Ala, Gly, or Pro
  SITE (212)..(212): Xaa at position 212 is Ile, Ala, Val, Leu, or Gly
  SITE (215)..(215): Xaa at position 215 is Ile, Ala, Val, Leu, or Gly
  SITE (223)..(223): Xaa at position 223 is Leu, Ala, Val, Gly, or Ile
  SITE (226)..(226): Xaa at position 226 is Leu, Ala, Val, Gly, or Ile
  SITE (228)..(228): Xaa at position 228 is Leu, Ala, Val, Gly, or Ile
  SITE (233)..(233): Xaa at position 233 is Ile, Ala, Val, Leu, or Gly
  SITE (236)..(236): Xaa at position 236 is Val, Ala, Gly, Leu, or Ile
  SITE (241)..(241): Xaa at position 241 is Leu, Ala, Val, Gly, or Ile
  SITE (244)..(244): Xaa at position 244 is Leu, Ala, Val, Gly, or Ile
  SITE (247)..(247): Xaa at position 247 is Leu, Ala, Val, Gly, or Ile
  SITE (250)..(250): Xaa at position 250 is Leu, Ala, Val, Gly, or Ile
  SITE (252)..(252): Xaa at position 252 is Leu, Ala, Val, Gly, or Ile
  SITE (257)..(257): Xaa at position 257 is Ile, Ala, Val, Leu, or Gly
  SITE (265)..(265): Xaa at position 265 is Leu, Ala, Val, Gly, or Ile
  SITE (271)..(271): Xaa at position 271 is Leu, Ala, Val, Gly, or Ile
  SITE (274)..(274): Xaa at position 274 is Leu, Ala, Val, Gly, or Ile
  SITE (276)..(276): Xaa at position 276 is Leu, Ala, Val, Gly, or Ile
  SITE (281)..(281): Xaa at position 281 is Leu, Ala, Val, Gly, or Ile
  SITE (288)..(288): Xaa at position 288 is Leu, Ala, Val, Gly, or Ile
  SITE (294)..(294): Xaa at position 294 is Ile, Ala, Val, Leu, or Gly
  SITE (297)..(297): Xaa at position 297 is Val, Ala, Gly, Leu, or Ile
  SITE (299)..(299): Xaa at position 299 is Leu, Ala, Val, Gly, or Ile
  SITE (304)..(304): Xaa at position 304 is Ile, Ala, Val, Leu, or Gly
  SITE (312)..(312): Xaa at position 312 is Phe, Tyr, Met, His, Ile, Leu, Val Ala, or Gly
  SITE (313)..(313): Xaa at position 313 is Cys, Ala, Val, Gly, Ser, or Thr
  SITE (324)..(324): Xaa at position 324 is Tyr, Phe, Met, His, Ile, Leu, Val Ala, or Gly
  SITE (327)..(327): Xaa at position 327 is Val, Ala, Gly, Leu, or Ile
  SITE (329)..(329): Xaa at position 329 is Leu, Ala, Val, Gly, or Ile
  SITE (352)..(352): Xaa at position 352 is Ala, Gly, or Pro
MKATIILLLLAQVSWAGPFQQRGLFDFMLEDEASGIGPEVPDDRDFEPSLGPVCPFRCQCHLRVXQXSDLGLDKXPKDLPPDTTLXDXQNNKXTEXKDGDXKNLKNXHAXIXVNNKXSKVSPGXXTPXVKXERXYXSKNQLKEXPEKMPKTXQEXRXHENEXTKXRKVTXNGXNQXIVXEXGTNPXKSSGIENGXXQGXKKXSYXRXXDTNXTSXPQGLPPSXTEXHXDGNKXSRXDAASXKGXNNXAKXGXSFNSXSAVDNGSXANTPHXREXHXDNNKXTRVPGGXAEHKYXQVXYXHNNNXSVVGSSDXXPPGHNTKKASXSGXSXFSNPVQYWEIQPSTFRCVYVRSXIQLGNYK

SEQ ID NO: 230 - protein, 524 aa, Homo sapiens
  SITE (66)..(66): Xaa at position 66 is Cys, Ala, Val, Gly, Ser, or Thr
  SITE (69)..(69): Xaa at position 69 is Val, Ala, Gly, Leu, or Ile
  SITE (70)..(70): Xaa at position 70 is Val, Ala, Gly, Leu, or Ile
  SITE (73)..(73): Xaa at position 73 is Ala, Gly, or Pro
  SITE (86)..(86): Xaa at position 86 is Ile, Ala, Val, Leu, or Gly
  SITE (90)..(90): Xaa at position 90 is Leu, Ala, Val, Gly, or Ile
  SITE (94)..(94): Xaa at position 94 is Cys, Ala, Val, Gly, Ser, or Thr
  SITE (110)..(110): Xaa at position 110 is Val, Ala, Gly, Leu, or Ile
  SITE (117)..(117): Xaa at position 117 is Ile, Ala, Val, Leu, or Gly
  SITE (118)..(118): Xaa at position 118 is Leu, Ala, Val, Gly, or Ile
  SITE (131)..(131): Xaa at position 131 is Val, Ala, Gly, Leu, or Ile
  SITE (132)..(132): Xaa at position 132 is Cys, Ala, Val, Gly, Ser, or Thr
  SITE (230)..(230): Xaa at position 230 is Cys, Ala, Val, Gly, Ser, or Thr
  SITE (265)..(265): Xaa at position 265 is Cys, Ala, Val, Gly, Ser, or Thr
  SITE (271)..(271): Xaa at position 271 is Cys, Ala, Val, Gly, Ser, or Thr
  SITE (317)..(317): Xaa at position 317 is Val, Ala, Gly, Leu, or Ile
  SITE (318)..(318): Xaa at position 318 is Cys, Ala, Val, Gly, Ser, or Thr
  SITE (321)..(321): Xaa at position 321 is Leu, Ala, Val, Gly, or Ile
  SITE (325)..(325): Xaa at position 325 is Val, Ala, Gly, Leu, or Ile
  SITE (338)..(338): Xaa at position 338 is Ile, Ala, Val, Leu, or Gly
  SITE (345)..(345): Xaa at position 345 is Met, Ile, Leu, Val, Ala, or Gly
  SITE (346)..(346): Xaa at position 346 is Cys, Ala, Val, Gly, Ser, or Thr
  SITE (357)..(357): Xaa at position 357 is Cys, Ala, Val, Gly, Ser, or Thr
  SITE (360)..(360): Xaa at position 360 is Val, Ala, Gly, Leu, or Ile
  SITE (368)..(368): Xaa at position 368 is Ile, Ala, Val, Leu, or Gly
  SITE (369)..(369): Xaa at position 369 is Leu, Ala, Val, Gly, or Ile
  SITE (381)..(381): Xaa at position 381 is Val, Ala, Gly, Leu, or Ile
  SITE (382)..(382): Xaa at position 382 is Cys, Ala, Val, Gly, Ser, or Thr
  SITE (411)..(411): Xaa at position 411 is Val, Ala, Gly, Leu, or Ile
  SITE (412)..(412): Xaa at position 412 is Cys, Ala, Val, Gly, Ser, or Thr
  SITE (415)..(415): Xaa at position 415 is Leu, Ala, Val, Gly, or Ile
  SITE (416)..(416): Xaa at position 416 is Val, Ala, Gly, Leu, or Ile
  SITE (419)..(419): Xaa at position 419 is Leu, Ala, Val, Gly, or Ile
  SITE (432)..(432): Xaa at position 432 is Ile, Ala, Val, Leu, or Gly
  SITE (436)..(436): Xaa at position 436 is Leu, Ala, Val, Gly, or Ile
  SITE (451)..(451): Xaa at position 451 is Cys, Ala, Val, Gly, Ser, or Thr
  SITE (454)..(454): Xaa at position 454 is Phe, Tyr, Met, His, Ile, Leu, Val Ala, or Gly
  SITE (462)..(462): Xaa at position 462 is Leu, Ala, Val, Gly, or Ile
  SITE (466)..(466): Xaa at position 466 is Leu, Ala, Val, Gly, or Ile
  SITE (470)..(470): Xaa at position 470 is Met, Ile, Leu, Val, Ala, or Gly
  SITE (475)..(475): Xaa at position 475 is Val, Ala, Gly, Leu, or Ile
  SITE (476)..(476): Xaa at position 476 is Cys, Ala, Val, Gly, Ser, or Thr
  SITE (481)..(481): Xaa at position 481 is Ala, Gly, or Pro
MYALFLLASLLGAALAGPVLGLKECTRGSAVWCQNVKTASDCGAVKHCLQTVWNKPTVKSLPCDIXKDXXTAXGDMLKDNATEEEXLVYXEKTXDWLPKPNMSASCKEIXDSYLPVXXDIIKGEMSRPGEXXSALNLCESLQKHLAELNHQKQLESNKIPELDMTEVVAPFMANIPLLLYPQDGPRSKPQPKDNGDVCQDCIQMVTDIQTAVRTNSTFVQALVEHVKEEXDRLGPGMADICKNYISQYSEIAIQMMMHMQPKEIXALVGFXDEVKEMPMQTLVPAKVASKNVIPALELVEPIKKHEVPAKSDVYCEXXEFXVKEXTKLIDNNKTEKEXLDAFDKXXSKLPKSLSEEXQEXVDTYGSSXXSILLEEVSPELXXSMLHLCSGTRLPALTVHVTQPKDGGFCEXXKKXXGYXDRNLEKNSTKQEXLAAXEKGCSFLPDPYQKQXDQXVAEYEPVXIEIXVEVXDPSFXXLKIGXCPSAHKPLLGTEKCIWGPSYWCQNTETAAQCNAVEHCKRHVWN

SEQ ID NO: 231 - protein, 556 aa, Homo sapiens
  SITE (55)..(55): Xaa at position 55 is Ala, Gly, or Pro
  SITE (57)..(57): Xaa at position 57 is Trp, Tyr, Phe, Met, His, Ile, Leu Val, Ala, or Gly
  SITE (70)..(70): Xaa at position 70 is Leu, Ala, Val, Gly, or Ile
  SITE (91)..(91): Xaa at position 91 is Cys, Ala, Val, Gly, Ser, or Thr
  SITE (93)..(93): Xaa at position 93 is Leu, Ala, Val, Gly, or Ile
  SITE (94)..(94): Xaa at position 94 is Leu, Ala, Val, Gly, or Ile
  SITE (97)..(97): Xaa at position 97 is Ala, Gly, or Pro
  SITE (124)..(124): Xaa at position 124 is Val, Ala, Gly, Leu, or Ile
  SITE (127)..(127): Xaa at position 127 is Leu, Ala, Val, Gly, or Ile
  SITE (129)..(129): Xaa at position 129 is Val, Ala, Gly, Leu, or Ile
  SITE (131)..(131): Xaa at position 131 is Ile, Ala, Val, Leu, or Gly
  SITE (139)..(139): Xaa at position 139 is Ala, Gly, or Pro
  SITE (149)..(149): Xaa at position 149 is Tyr, Phe, Met, His, Ile, Leu, Val Ala, or Gly
  SITE (151)..(151): Xaa at position 151 is Leu, Ala, Val, Gly, or Ile
  SITE (153)..(153): Xaa at position 153 is Val, Ala, Gly, Leu, or Ile
  SITE (158)..(158): Xaa at position 158 is Ala, Gly, or Pro
  SITE (160)..(160): Xaa at position 160 is Leu, Ala, Val, Gly, or Ile
  SITE (162)..(162): Xaa at position 162 is Ala, Gly, or Pro
  SITE (165)..(165): Xaa at position 165 is Val, Ala, Gly, Leu, or Ile
  SITE (166)..(166): Xaa at position 166 is Trp, Tyr, Phe, Met, His, Ile, Leu Val, Ala, or Gly
  SITE (168)..(168): Xaa at position 168 is Ala, Gly, or Pro
  SITE (169)..(169): Xaa at position 169 is Leu, Ala, Val, Gly, or Ile
  SITE (172)..(172): Xaa at position 172 is Leu, Ala, Val, Gly, or Ile
  SITE (175)..(175): Xaa at position 175 is Phe, Tyr, Met, His, Ile, Leu, Val Ala, or Gly
  SITE (189)..(189): Xaa at position 189 is Ile, Ala, Val, Leu, or Gly
  SITE (194)..(194): Xaa at position 194 is Ile, Ala, Val, Leu, or Gly
  SITE (202)..(202): Xaa at position 202 is His, Phe, Tyr, Lys, Arg, Gly, Ser Thr, Ala, Val, Leu, Ile, Asn, Met, or Gln
  SITE (205)..(205): Xaa at position 205 is Ile, Ala, Val, Leu, or Gly
  SITE (206)..(206): Xaa at position 206 is Leu, Ala, Val, Gly, or Ile
  SITE (207)..(207): Xaa at position 207 is Ile, Ala, Val, Leu, or Gly
  SITE (214)..(214): Xaa at position 214 is Leu, Ala, Val, Gly, or Ile
  SITE (219)..(219): Xaa at position 219 is Ile, Ala, Val, Leu, or Gly
  SITE (223)..(223): Xaa at position 223 is Leu, Ala, Val, Gly, or Ile
  SITE (225)..(225): Xaa at position 225 is Ala, Gly, or Pro
  SITE (226)..(226): Xaa at position 226 is Met, Ile, Leu, Val, Ala, or Gly
  SITE (228)..(228): Xaa at position 228 is Phe, Tyr, Met, His, Ile, Leu, Val Ala, or Gly
  SITE (231)..(231): Xaa at position 231 is Phe, Tyr, Met, His, Ile, Leu, Val Ala, or Gly
  SITE (233)..(233): Xaa at position 233 is Val, Ala, Gly, Leu, or Ile
  SITE (234)..(234): Xaa at position 234 is Leu, Ala, Val, Gly, or Ile
  SITE (235)..(235): Xaa at position 235 is His, Phe, Tyr, Lys, Arg, Gly, Ser Thr, Ala, Val, Leu, Ile, Asn, Met, or Gln
  SITE (236)..(236): Xaa at position 236 is Trp, Tyr, Phe, Met, His, Ile, Leu Val, Ala, or Gly
  SITE (237)..(237): Xaa at position 237 is His, Phe, Tyr, Lys, Arg, Gly, Ser Thr, Ala, Val, Leu, Ile, Asn, Met, or Gln
  SITE (238)..(238): Xaa at position 238 is Ile, Ala, Val, Leu, or Gly
  SITE (239)..(239): Xaa at position 239 is Val, Ala, Gly, Leu, or Ile
  SITE (244)..(244): Xaa at position 244 is Phe, Tyr, Met, His, Ile, Leu, Val Ala, or Gly
  SITE (249)..(249): Xaa at position 249 is Ile, Ala, Val, Leu, or Gly
  SITE (254)..(254): Xaa at position 254 is Leu, Ala, Val, Gly, or Ile
  SITE (266)..(266): Xaa at position 266 is Tyr, Phe, Met, His, Ile, Leu, Val Ala, or Gly
  SITE (271)..(271): Xaa at position 271 is Val, Ala, Gly, Leu, or Ile
  SITE (274)..(274): Xaa at position 274 is Val, Ala, Gly, Leu, or Ile
  SITE (278)..(278): Xaa at position 278 is Ala, Gly, or Pro
  SITE (283)..(283): Xaa at position 283 is Ile, Ala, Val, Leu, or Gly
  SITE (286)..(286): Xaa at position 286 is Leu, Ala, Val, Gly, or Ile
  SITE (289)..(289): Xaa at position 289 is Phe, Tyr, Met, His, Ile, Leu, Val Ala, or Gly
  SITE (296)..(296): Xaa at position 296 is Leu, Ala, Val, Gly, or Ile
  SITE (298)..(298): Xaa at position 298 is Trp, Tyr, Phe, Met, His, Ile, Leu Val, Ala, or Gly
  SITE (305)..(305): Xaa at position 305 is Leu, Ala, Val, Gly, or Ile
  SITE (322)..(322): Xaa at position 322 is Ile, Ala, Val, Leu, or Gly
  SITE (333)..(333): Xaa at position 333 is Leu, Ala, Val, Gly, or Ile
  SITE (336)..(336): Xaa at position 336 is Phe, Tyr, Met, His, Ile, Leu, Val Ala, or Gly
  SITE (337)..(337): Xaa at position 337 is Phe, Tyr, Met, His, Ile, Leu, Val Ala, or Gly
  SITE (340)..(340): Xaa at position 340 is Ile, Ala, Val, Leu, or Gly
  SITE (344)..(344): Xaa at position 344 is Phe, Tyr, Met, His, Ile, Leu, Val Ala, or Gly
  SITE (349)..(349): Xaa at position 349 is Ile, Ala, Val, Leu, or Gly
  SITE (350)..(350): Xaa at position 350 is His, Phe, Tyr, Lys, Arg, Gly, Ser Thr, Ala, Val, Leu, Ile, Asn, Met, or Gln
  SITE (351)..(351): Xaa at position 351 is Leu, Ala, Val, Gly, or Ile
  SITE (358)..(358): Xaa at position 358 is Phe, Tyr, Met, His, Ile, Leu, Val Ala, or Gly
  SITE (361)..(361): Xaa at position 361 is Trp, Tyr, Phe, Met, His, Ile, Leu Val, Ala, or Gly
  SITE (367)..(367): Xaa at position 367 is Ile, Ala, Val, Leu, or Gly
  SITE (371)..(371): Xaa at position 371 is Met, Ile, Leu, Val, Ala, or Gly
  SITE (383)..(383): Xaa at position 383 is Leu, Ala, Val, Gly, or Ile
  SITE (386)..(386): Xaa at position 386 is Phe, Tyr, Met, His, Ile, Leu, Val Ala, or Gly
  SITE (387)..(387): Xaa at position 387 is Tyr, Phe, Met, His, Ile, Leu, Val Ala, or Gly
  SITE (388)..(388): Xaa at position 388 is Ile, Ala, Val, Leu, or Gly
  SITE (391)..(391): Xaa at position 391 is Val, Ala, Gly, Leu, or Ile
  SITE (392)..(392): Xaa at position 392 is Leu, Ala, Val, Gly, or Ile
  SITE (395)..(395): Xaa at position 395 is Ile, Ala, Val, Leu, or Gly
  SITE (398)..(398): Xaa at position 398 is Ile, Ala, Val, Leu, or Gly
  SITE (403)..(403): Xaa at position 403 is Ile, Ala, Val, Leu, or Gly
  SITE (404)..(404): Xaa at position 404 is Val, Ala, Gly, Leu, or Ile
  SITE (405)..(405): Xaa at position 405 is Trp, Tyr, Phe, Met, His, Ile, Leu Val, Ala, or Gly
  SITE (421)..(421): Xaa at position 421 is Val, Ala, Gly, Leu, or Ile
  SITE (423)..(423): Xaa at position 423 is Val, Ala, Gly, Leu, or Ile
  SITE (429)..(429): Xaa at position 429 is Tyr, Phe, Met, His, Ile, Leu, Val Ala, or Gly
  SITE (433)..(433): Xaa at position 433 is Leu, Ala, Val, Gly, or Ile
  SITE (436)..(436): Xaa at position 436 is Val, Ala, Gly, Leu, or Ile
  SITE (443)..(443): Xaa at position 443 is Val, Ala, Gly, Leu, or Ile
  SITE (444)..(444): Xaa at position 444 is Ile, Ala, Val, Leu, or Gly
  SITE (445)..(445): Xaa at position 445 is Leu, Ala, Val, Gly, or Ile
  SITE (449)..(449): Xaa at position 449 is Trp, Tyr, Phe, Met, His, Ile, Leu Val, Ala, or Gly
  SITE (451)..(451): Xaa at position 451 is Leu, Ala, Val, Gly, or Ile
  SITE (463)..(463): Xaa at position 463 is Tyr, Phe, Met, His, Ile, Leu, Val Ala, or Gly
  SITE (464)..(464): Xaa at position 464 is Tyr, Phe, Met, His, Ile, Leu, Val Ala, or Gly
  SITE (486)..(486): Xaa at position 486 is Ala, Gly, or Pro
  SITE (487)..(487): Xaa at position 487 is Cys, Ala, Val, Gly, Ser, or Thr
  SITE (502)..(502): Xaa at position 502 is Leu, Ala, Val, Gly, or Ile
  SITE (503)..(503): Xaa at position 503 is Trp, Tyr, Phe, Met, His, Ile, Leu Val, Ala, or Gly
  SITE (506)..(506): Xaa at position 506 is Ala, Gly, or Pro
  SITE (508)..(508): Xaa at position 508 is Ala, Gly, or Pro
  SITE (509)..(509): Xaa at position 509 is Val, Ala, Gly, Leu, or Ile
  SITE (513)..(513): Xaa at position 513 is Leu, Ala, Val, Gly, or Ile
  SITE (514)..(514): Xaa at position 514 is Trp, Tyr, Phe, Met, His, Ile, Leu Val, Ala, or Gly
  SITE (525)..(525): Xaa at position 525 is Ala, Gly, or Pro
  SITE (529)..(529): Xaa at position 529 is Leu, Ala, Val, Gly, or Ile
  SITE (532)..(532): Xaa at position 532 is His, Phe, Tyr, Lys, Arg, Gly, Ser Thr, Ala, Val, Leu, Ile, Asn, Met, or Gln
  SITE (536)..(536): Xaa at position 536 is Met, Ile, Leu, Val, Ala, or Gly
  SITE (541)..(541): Xaa at position 541 is Ile, Ala, Val, Leu, or Gly
  SITE (548)..(548): Xaa at position 548 is Ala, Gly, or Pro
MELCGLGLPRPPMLLALLLATLLAAMLALLTQVALVVQVAEAARAPSVSAKPGPXLXPLPLSVKMTPNLXHLAPENFYISHSPNSTAGPSXTXXEEXFRRYHGYIFGFYKWHHEPAEFQAKTQXQQXLXSXTLQSECDXFPNISSDESXTXLXKEPVXVXKXNRXXGXXRGXETXSQLVYQDSYGTFTXNESTXIDSPRFSXRGXXXDTSRHYXPVKIXLKTXDXXAXNKXNXXXXXXXDDQSXPYQSXTFPEXSNKGSYSLSHVXTPNDXRMXIEYXRLRGXRVXPEXDTPGHTXSXGKGQKDXLTPCYSRQNKLDSFGPXNPTLNTTYSFXTTXXKEXSEVXPDQFXXXGGDEVEXKCXESNPKXQDFXRQKGFGTDFKKXESXXXQKXXDIXATXNKGSXXXQEVFDDKAKLAPGTIXEXWKDSAXPEEXSRXTASGFPXXXSAPXYXDLISYGQDWRKXXKVEPLDFGGTQKQKQLFIGGEXXLWGEYVDATNLTPRXXPRXSXXGERXXSSKDVRDMDDXYDRXTRXRCRXVERGXAAQPLYXGYCNHENM

SEQ ID NO: 232 - protein, 640 aa, Homo sapiens
  SITE (106)..(106): Xaa at position 106 is Cys, Ala, Val, Gly, Ser, or Thr
  SITE (315)..(315): Xaa at position 315 is Cys, Ala, Val, Gly, Ser, or Thr
  SITE (357)..(357): Xaa at position 357 is Val, Ala, Gly, Leu, or Ile
  SITE (369)..(369): Xaa at position 369 is Phe, Tyr, Met, His, Ile, Leu, Val Ala, or Gly
  SITE (424)..(424): Xaa at position 424 is Ala, Gly, or Pro
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGXTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHXQCKQDFNITDISLLEHRLECGANDMKVSLGKCQLKSLGFDKXFMYLSDSRCSGXNDRDNRDWVSVVTPARDGPCGTVLTRNETHATYSNTLYLADEIIIRDLNIKINFXCSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 233 - protein, 1114 aa, Homo sapiens
  SITE (30)..(30): Xaa at position 30 is Tyr, Phe, Met, His, Ile, Leu, Val Ala, or Gly
  SITE (31)..(31): Xaa at position 31 is Phe, Tyr, Met, His, Ile, Leu, Val Ala, or Gly
  SITE (36)..(36): Xaa at position 36 is Tyr, Phe, Met, His, Ile, Leu, Val Ala, or Gly
  SITE (40)..(40): Xaa at position 40 is Leu, Ala, Val, Gly, or Ile
  SITE (42)..(42): Xaa at position 42 is Val, Ala, Gly, Leu, or Ile
  SITE (50)..(50): Xaa at position 50 is Leu, Ala, Val, Gly, or Ile
  SITE (53)..(53): Xaa at position 53 is Val, Ala, Gly, Leu, or Ile
  SITE (68)..(68): Xaa at position 68 is Leu, Ala, Val, Gly, or Ile
  SITE (72)..(72): Xaa at position 72 is Leu, Ala, Val, Gly, or Ile
  SITE (80)..(80): Xaa at position 80 is Leu, Ala, Val, Gly, or Ile
  SITE (86)..(86): Xaa at position 86 is Ile, Ala, Val, Leu, or Gly
  SITE (95)..(95): Xaa at position 95 is Leu, Ala, Val, Gly, or Ile
  SITE (97)..(97): Xaa at position 97 is Leu, Ala, Val, Gly, or Ile
  SITE (109)..(109): Xaa at position 109 is Leu, Ala, Val, Gly, or Ile
  SITE (121)..(121): Xaa at position 121 is Val, Ala, Gly, Leu, or Ile
  SITE (123)..(123): Xaa at position 123 is Leu, Ala, Val, Gly, or Ile
  SITE (125)..(125): Xaa at position 125 is Val, Ala, Gly, Leu, or Ile
  SITE (143)..(143): Xaa at position 143 is Ala, Gly, or Pro
  SITE (145)..(145): Xaa at position 145 is Val, Ala, Gly, Leu, or Ile
  SITE (147)..(147): Xaa at position 147 is Phe, Tyr, Met, His, Ile, Leu, Val Ala, or Gly
  SITE (166)..(166): Xaa at position 166 is Cys, Ala, Val, Gly, Ser, or Thr
  SITE (174)..(174): Xaa at position 174 is Phe, Tyr, Met, His, Ile, Leu, Val Ala, or Gly
  SITE (185)..(185): Xaa at position 185 is Phe, Tyr, Met, His, Ile, Leu, Val Ala, or Gly
  SITE (197)..(197): Xaa at position 197 is Cys, Ala, Val, Gly, Ser, or Thr
  SITE (223)..(223): Xaa at position 223 is Val, Ala, Gly, Leu, or Ile
  SITE (229)..(229): Xaa at position 229 is Leu, Ala, Val, Gly, or Ile
  SITE (239)..(239): Xaa at position 239 is Leu, Ala, Val, Gly, or Ile
  SITE (241)..(241): Xaa at position 241 is Ala, Gly, or Pro
  SITE (242)..(242): Xaa at position 242 is Val, Ala, Gly, Leu, or Ile
  SITE (243)..(243): Xaa at position 243 is Cys, Ala, Val, Gly, Ser, or Thr
  SITE (245)..(245): Xaa at position 245 is Val, Ala, Gly, Leu, or Ile
  SITE (258)..(258): Xaa at position 258 is Phe, Tyr, Met, His, Ile, Leu, Val Ala, or Gly
  SITE (260)..(260): Xaa at position 260 is Val, Ala, Gly, Leu, or Ile
  SITE (262)..(262): Xaa at position 262 is Val, Ala, Gly, Leu, or Ile
  SITE (263)..(263): Xaa at position 263 is Tyr, Phe, Met, His, Ile, Leu, Val Ala, or Gly
  SITE (269)..(269): Xaa at position 269 is Ala, Gly, or Pro
  SITE (314)..(314): Xaa at position 314 is Tyr, Phe, Met, His, Ile, Leu, Val Ala, or Gly
  SITE (329)..(329): Xaa at position 329 is Phe, Tyr, Met, His, Ile, Leu, Val Ala, or Gly
  SITE (358)..(358): Xaa at position 358 is Leu, Ala, Val, Gly, or Ile
  SITE (372)..(372): Xaa at position 372 is Leu, Ala, Val, Gly, or Ile
MAKATSGAAGLRLLLLLLLPLLGKVALGLXXSRDAXWEKXYXDQAAGTPXLYXHALRDAPEEVPSFRXGQHXYGTYRTRXHENNWXCIQEDTGLXYXNRSLDHSSWEKXSVRNRGFPLLTXYXKXFLSPTSLREGECQWPGCXRXYXSFFNTSFPACSSLKPRELXFPETRPSXRIRENRPPGTXHQFRLLPVQFLXPNISVAYRLLEGEGLPFRCAPDSLEXSTRWAXDREQREKYEXVXXXTXHAGAREEVVMVPXPXTXXDEDDSXPTFPAGVDTASAVVEFKRKEDTVVATLRVFDADVVPASGELVRRXTSTLLPGDTWAQQTXRVEHWPNETSVQANGSFVRATVHDYRLVXNRNLSISENRTMQXAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 234 - protein, 510 aa, Homo sapiens
  SITE (62)..(62): Xaa at position 62 is Val, Ala, Gly, Leu, or Ile
  SITE (70)..(70): Xaa at position 70 is Ala, Gly, or Pro
  SITE (92)..(92): Xaa at position 92 is Val, Ala, Gly, Leu, or Ile
  SITE (93)..(93): Xaa at position 93 is Ile, Ala, Val, Leu, or Gly
  SITE (95)..(95): Xaa at position 95 is Ala, Gly, or Pro
  SITE (96)..(96): Xaa at position 96 is Phe, Tyr, Met, His, Ile, Leu, Val Ala, or Gly
  SITE (98)..(98): Xaa at position 98 is Ile, Ala, Val, Leu, or Gly
  SITE (99)..(99): Xaa at position 99 is Leu, Ala, Val, Gly, or Ile
  SITE (102)..(102): Xaa at position 102 is Ala, Gly, or Pro
  SITE (103)..(103): Xaa at position 103 is Ala, Gly, or Pro
  SITE (104)..(104): Xaa at position 104 is Ala, Gly, or Pro
  SITE (106)..(106): Xaa at position 106 is Val, Ala, Gly, Leu, or Ile
  SITE (117)..(117): Xaa at position 117 is Ala, Gly, or Pro
  SITE (119)..(119): Xaa at position 119 is Ala, Gly, or Pro
  SITE (120)..(120): Xaa at position 120 is Ile, Ala, Val, Leu, or Gly
  SITE (123)..(123): Xaa at position 123 is Ala, Gly, or Pro
  SITE (124)..(124): Xaa at position 124 is Ala, Gly, or Pro
  SITE (127)..(127): Xaa at position 127 is Val, Ala, Gly, Leu, or Ile
  SITE (138)..(138): Xaa at position 138 is Leu, Ala, Val, Gly, or Ile
  SITE (140)..(140): Xaa at position 140 is Val, Ala, Gly, Leu, or Ile
  SITE (153)..(153): Xaa at position 153 is Val, Ala, Gly, Leu, or Ile
  SITE (156)..(156): Xaa at position 156 is Val, Ala, Gly, Leu, or Ile
  SITE (157)..(157): Xaa at position 157 is Ile, Ala, Val, Leu, or Gly
  SITE (161)..(161): Xaa at position 161 is Ala, Gly, or Pro
  SITE (162)..(162): Xaa at position 162 is Ile, Ala, Val, Leu, or Gly
  SITE (175)..(175): Xaa at position 175 is Val, Ala, Gly, Leu, or Ile
  SITE (181)..(181): Xaa at position 181 is Val, Ala, Gly, Leu, or Ile
  SITE (191)..(191): Xaa at position 191 is Phe, Tyr, Met, His, Ile, Leu, Val Ala, or Gly
  SITE (194)..(194): Xaa at position 194 is Ala, Gly, or Pro
  SITE (195)..(195): Xaa at position 195 is Met, Ile, Leu, Val, Ala, or Gly
  SITE (196)..(196): Xaa at position 196 is His, Phe, Tyr, Lys, Arg, Gly, Ser Thr, Ala, Val, Leu, Ile, Asn, Met, or Gln
  SITE (197)..(197): Xaa at position 197 is Ile, Ala, Val, Leu, or Gly
  SITE (198)..(198): Xaa at position 198 is Ala, Gly, or Pro
  SITE (199)..(199): Xaa at position 199 is Ala, Gly, or Pro
  SITE (200)..(200): Xaa at position 200 is Ala, Gly, or Pro
  SITE (203)..(203): Xaa at position 203 is Val, Ala, Gly, Leu, or Ile
  SITE (207)..(207): Xaa at position 207 is Leu, Ala, Val, Gly, or Ile
  SITE (211)..(211): Xaa at position 211 is Leu, Ala, Val, Gly, or Ile
  SITE (214)..(214): Xaa at position 214 is Leu, Ala, Val, Gly, or Ile
  SITE (218)..(218): Xaa at position 218 is Leu, Ala, Val, Gly, or Ile
  SITE (220)..(220): Xaa at position 220 is Ala, Gly, or Pro
  SITE (225)..(225): Xaa at position 225 is Phe, Tyr, Met, His, Ile, Leu, Val Ala, or Gly
  SITE (228)..(228): Xaa at position 228 is Ile, Ala, Val, Leu, or Gly
  SITE (229)..(229): Xaa at position 229 is Ile, Ala, Val, Leu, or Gly
  SITE (231)..(231): Xaa at position 231 is Ile, Ala, Val, Leu, or Gly
  SITE (240)..(240): Xaa at position 240 is Val, Ala, Gly, Leu, or Ile
  SITE (242)..(242): Xaa at position 242 is Leu, Ala, Val, Gly, or Ile
  SITE (244)..(244): Xaa at position 244 is Leu, Ala, Val, Gly, or Ile
  SITE (248)..(248): Xaa at position 248 is Phe, Tyr, Met, His, Ile, Leu, Val Ala, or Gly
  SITE (251)..(251): Xaa at position 251 is Tyr, Phe, Met, His, Ile, Leu, Val Ala, or Gly
  SITE (255)..(255): Xaa at position 255 is Val, Ala, Gly, Leu, or Ile
  SITE (258)..(258): Xaa at position 258 is Ala, Gly, or Pro
  SITE (262)..(262): Xaa at position 262 is Ile, Ala, Val, Leu, or Gly
  SITE (266)..(266): Xaa at position 266 is Met, Ile, Leu, Val, Ala, or Gly
  SITE (269)..(269): Xaa at position 269 is Ile, Ala, Val, Leu, or Gly
  SITE (272)..(272): Xaa at position 272 is Leu, Ala, Val, Gly, or Ile
  SITE (273)..(273): Xaa at position 273 is Ala, Gly, or Pro
  SITE (274)..(274): Xaa at position 274 is Ala, Gly, or Pro
  SITE (278)..(278): Xaa at position 278 is Ala, Gly, or Pro
  SITE (289)..(289): Xaa at position 289 is Phe, Tyr, Met, His, Ile, Leu, Val Ala, or Gly
  SITE (293)..(293): Xaa at position 293 is Val, Ala, Gly, Leu, or Ile
  SITE (294)..(294): Xaa at position 294 is Ala, Gly, or Pro
  SITE (297)..(297): Xaa at position 297 is Val, Ala, Gly, Leu, or Ile
  SITE (303)..(303): Xaa at position 303 is Leu, Ala, Val, Gly, or Ile
  SITE (308)..(308): Xaa at position 308 is Ala, Gly, or Pro
  SITE (315)..(315): Xaa at position 315 is Leu, Ala, Val, Gly, or Ile
  SITE (317)..(317): Xaa at position 317 is Ala, Gly, or Pro
  SITE (318)..(318): Xaa at position 318 is His, Phe, Tyr, Lys, Arg, Gly, Ser Thr, Ala, Val, Leu, Ile, Asn, Met, or Gln
  SITE (320)..(320): Xaa at position 320 is Ala, Gly, or Pro
  SITE (321)..(321): Xaa at position 321 is Leu, Ala, Val, Gly, or Ile
  SITE (324)..(324): Xaa at position 324 is Leu, Ala, Val, Gly, or Ile
  SITE (328)..(328): Xaa at position 328 is Met, Ile, Leu, Val, Ala, or Gly
  SITE (332)..(332): Xaa at position 332 is Ala, Gly, or Pro
  SITE (335)..(335): Xaa at position 335 is Leu, Ala, Val, Gly, or Ile
  SITE (338)..(338): Xaa at position 338 is Ile, Ala, Val, Leu, or Gly
  SITE (339)..(339): Xaa at position 339 is Ala, Gly, or Pro
  SITE (342)..(342): Xaa at position 342 is Ile, Ala, Val, Leu, or Gly
  SITE (356)..(356): Xaa at position 356 is Leu, Ala, Val, Gly, or Ile
  SITE (358)..(358): Xaa at position 358 is Leu, Ala, Val, Gly, or Ile
  SITE (377)..(377): Xaa at position 377 is Cys, Ala, Val, Gly, Ser, or Thr
  SITE (380)..(380): Xaa at position 380 is Met, Ile, Leu, Val, Ala, or Gly
  SITE (383)..(383): Xaa at position 383 is Val, Ala, Gly, Leu, or Ile
  SITE (384)..(384): Xaa at position 384 is Ala, Gly, or Pro
  SITE (387)..(387): Xaa at position 387 is Val, Ala, Gly, Leu, or Ile
  SITE (388)..(388): Xaa at position 388 is Met, Ile, Leu, Val, Ala, or Gly
  SITE (392)..(392): Xaa at position 392 is Val, Ala, Gly, Leu, or Ile
  SITE (394)..(394): Xaa at position 394 is Val, Ala, Gly, Leu, or Ile
  SITE (407)..(407): Xaa at position 407 is Val, Ala, Gly, Leu, or Ile
  SITE (411)..(411): Xaa at position 411 is Met, Ile, Leu, Val, Ala, or Gly
  SITE (412)..(412): Xaa at position 412 is Met, Ile, Leu, Val, Ala, or Gly
  SITE (413)..(413): Xaa at position 413 is Ile, Ala, Val, Leu, or Gly
  SITE (416)..(416): Xaa at position 416 is Val, Ala, Gly, Leu, or Ile
  SITE (417)..(417): Xaa at position 417 is Leu, Ala, Val, Gly, or Ile
  SITE (420)..(420): Xaa at position 420 is Ala, Gly, or Pro
  SITE (422)..(422): Xaa at position 422 is Leu, Ala, Val, Gly, or Ile
  SITE (423)..(423): Xaa at position 423 is Leu, Ala, Val, Gly, or Ile
  SITE (430)..(430): Xaa at position 430 is Phe, Tyr, Met, His, Ile, Leu, Val Ala, or Gly
  SITE (434)..(434): Xaa at position 434 is Cys, Ala, Val, Gly, Ser, or Thr
  SITE (435)..(435): Xaa at position 435 is Val, Ala, Gly, Leu, or Ile
  SITE (436)..(436): Xaa at position 436 is Val, Ala, Gly, Leu, or Ile
  SITE (438)..(438): Xaa at position 438 is Ile, Ala, Val, Leu, or Gly
  SITE (440)..(440): Xaa at position 440 is Ala, Gly, or Pro
  SITE (445)..(445): Xaa at position 445 is Ile, Ala, Val, Leu, or Gly
  SITE (449)..(449): Xaa at position 449 is Met, Ile, Leu, Val, Ala, or Gly
  SITE (455)..(455): Xaa at position 455 is Leu, Ala, Val, Gly, or Ile
  SITE (459)..(459): Xaa at position 459 is Leu, Ala, Val, Gly, or Ile
  SITE (468)..(468): Xaa at position 468 is Ala, Gly, or Pro
  SITE (471)..(471): Xaa at position 471 is Ile, Ala, Val, Leu, or Gly
  SITE (475)..(475): Xaa at position 475 is Ala, Gly, or Pro
  SITE (482)..(482): Xaa at position 482 is Leu, Ala, Val, Gly, or Ile
  SITE (486)..(486): Xaa at position 486 is Ala, Gly, or Pro
  SITE (492)..(492): Xaa at position 492 is Leu, Ala, Val, Gly, or Ile
  SITE (497)..(497): Xaa at position 497 is Phe, Tyr, Met, His, Ile, Leu, Val Ala, or Gly
MYRALRLLARSRPLVRAPAAALASAPGLGGAAVPSFWPPNAARMASQNSFRIEYDTFGELKXPNDKYYGXQTVRSTMNFKIGGVTERMPTPXXKXXGXXKRXXXEXNQDYGLDPKIXNXXMKXXDEXAEGKLNDHFPXVXWQTGSGTQTNMNXNEXXSNRXXEMLGGELGSKIPXHPNDHXNKSQSSNDTXPTXXXXXXXIEXHEVXLPGXQKXHDAXDXKSKEXAQXXKXGRTHTQDAXPXTXGQEXSGXVQQXKYXMTRXKAAXPRXYEXXXGGTXVGTGLNTRIGXAEKXXAKXAALTGXPFVTXPNKFEAXAXXDXXVEXSGAXNTTXCSXMKXXNDXRFLGSGPRSGLGEXIXPENEPGSSIMPGKVNPTQXEAXTMXXAQXXGNHXAXTVGGSNGHFELNXFKPXXXKNXXHSXRXXGDASVSXTENXXXGXQXNTERXNKLXNESLMXVTAXNPHIGYDKXAKXAKTXHKNGSTXKETXIELGYXTAEQXDEWVKPKDMLGPK

SEQ ID NO: 235 - protein, 283 aa, Homo sapiens
  SITE (51)..(51): Xaa at position 51 is Phe, Tyr, Met, His, Ile, Leu, Val Ala, or Gly
  SITE (60)..(60): Xaa at position 60 is Cys, Ala, Val, Gly, Ser, or Thr
  SITE (64)..(64): Xaa at position 64 is Cys, Ala, Val, Gly, Ser, or Thr
  SITE (73)..(73): Xaa at position 73 is His, Phe, Tyr, Lys, Arg, Gly, Ser Thr, Ala, Val, Leu, Ile, Asn, Met, or Gln
  SITE (168)..(168): Xaa at position 168 is Cys, Ala, Val, Gly, Ser, or Thr
  SITE (170)..(170): Xaa at position 170 is Val, Ala, Gly, Leu, or Ile
  SITE (179)..(179): Xaa at position 179 is Cys, Ala, Val, Gly, Ser, or Thr
MNWTGLYTLLSGVNRHSTAIGRVWLSVIFIFRIMVLVVAAESVWGDEKSSXICNTLQPGXNSVXYDQFFPISXVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKXDXYPCPNTVDXFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 236 - protein, 348 aa, Homo sapiens
  SITE (11)..(11): Xaa at position 11 is Val, Ala, Gly, Leu, or Ile
  SITE (26)..(26): Xaa at position 26 is Tyr, Phe, Met, His, Ile, Leu, Val Ala, or Gly
  SITE (35)..(35): Xaa at position 35 is Trp, Tyr, Phe, Met, His, Ile, Leu Val, Ala, or Gly
  SITE (103)..(103): Xaa at position 103 is Phe, Tyr, Met, His, Ile, Leu, Val Ala, or Gly
  SITE (110)..(110): Xaa at position 110 is Cys, Ala, Val, Gly, Ser, or Thr
  SITE (112)..(112): Xaa at position 112 is Leu, Ala, Val, Gly, or Ile
  SITE (179)..(179): Xaa at position 179 is Ile, Ala, Val, Leu, or Gly
  SITE (185)..(185): Xaa at position 185 is Cys, Ala, Val, Gly, Ser, or Thr
MNGTEGPNFYXPFSNATGVVRSPFEXPQYYLAEPXQFSMLAAYMFLLIVLGFPINFLTLYVTVQHKKLRTPLNYILLNLAVADLFMVLGGFTSTLYTSLHGYXVFGPTGXNXEGFFATLGGEIALWSLVVLAIERYVVVCKPMSNFRFGENHAIMGVAFTWVMALACAAPPLAGWSRYXPEGLQXSCGIDYYTLKPEVNNESFVIYMFVVHFTIPMIIIFFCYGQLVFTVKEAAAQQQESATTQKAEKEVTRMVIIMVIAFLICWVPYASVAFYIFTHQGSNFGPIFMTIPAFFAKSAAIYNPVIYIMMNKQFRNCMLTTICCGKNPLGDDEASATVSKTETSQVAPA

SEQ ID NO: 237 - protein, 114 aa, Homo sapiens
  SITE (38)..(38): Xaa at position 38 is Cys, Ala, Val, Gly, Ser, or Thr
  SITE (57)..(57): Xaa at position 57 is Cys, Ala, Val, Gly, Ser, or Thr
  SITE (60)..(60): Xaa at position 60 is Cys, Ala, Val, Gly, Ser, or Thr
  SITE (62)..(62): Xaa at position 62 is Cys, Ala, Val, Gly, Ser, or Thr
  SITE (67)..(67): Xaa at position 67 is Ile, Ala, Val, Leu, or Gly
  SITE (84)..(84): Xaa at position 84 is Cys, Ala, Val, Gly, Ser, or Thr
  SITE (97)..(97): Xaa at position 97 is Val, Ala, Gly, Leu, or Ile
MNVLLGSVVIFATFVTLCNASCYFIPNEGVPGDSTRKXMDLKGNKHPINSEWQTDNXETXTXYETEXSCCTLVSTPVGYDKDNXQRIFKKEDCKYIXVEKKDPKKTCSVSEWII

SEQ ID NO: 238 - protein, 673 aa, Homo sapiens
  SITE (26)..(26): Xaa at position 26 is Ala, Gly, or Pro
  SITE (29)..(29): Xaa at position 29 is Leu, Ala, Val, Gly, or Ile
  SITE (32)..(32): Xaa at position 32 is Ala, Gly, or Pro
  SITE (33)..(33): Xaa at position 33 is Met, Ile, Leu, Val, Ala, or Gly
  SITE (43)..(43): Xaa at position 43 is Ile, Ala, Val, Leu, or Gly
  SITE (44)..(44): Xaa at position 44 is Leu, Ala, Val, Gly, or Ile
  SITE (47)..(47): Xaa at position 47 is Ile, Ala, Val, Leu, or Gly
  SITE (58)..(58): Xaa at position 58 is Val, Ala, Gly, Leu, or Ile
  SITE (62)..(62): Xaa at position 62 is Tyr, Phe, Met, His, Ile, Leu, Val Ala, or Gly
  SITE (70)..(70): Xaa at position 70 is Leu, Ala, Val, Gly, or Ile
  SITE (71)..(71): Xaa at position 71 is Ile, Ala, Val, Leu, or Gly
  SITE (74)..(74): Xaa at position 74 is Leu, Ala, Val, Gly, or Ile
  SITE (85)..(85): Xaa at position 85 is Leu, Ala, Val, Gly, or Ile
  SITE (86)..(86): Xaa at position 86 is Ile, Ala, Val, Leu, or Gly
  SITE (87)..(87): Xaa at position 87 is Val, Ala, Gly, Leu, or Ile
  SITE (89)..(89): Xaa at position 89 is Leu, Ala, Val, Gly, or Ile
  SITE (90)..(90): Xaa at position 90 is Met, Ile, Leu, Val, Ala, or Gly
  SITE (98)..(98): Xaa at position 98 is Ala, Gly, or Pro
  SITE (101)..(101): Xaa at position 101 is Ile, Ala, Val, Leu, or Gly
  SITE (104)..(104): Xaa at position 104 is Ala, Gly, or Pro
  SITE (105)..(105): Xaa at position 105 is Ile, Ala, Val, Leu, or Gly
  SITE (114)..(114): Xaa at position 114 is Cys, Ala, Val, Gly, Ser, or Thr
  SITE (115)..(115): Xaa at position 115 is Leu, Ala, Val, Gly, or Ile
  SITE (116)..(116): Xaa at position 116 is Ile, Ala, Val, Leu, or Gly
  SITE (118)..(118): Xaa at position 118 is Ile, Ala, Val, Leu, or Gly
  SITE (119)..(119): Xaa at position 119 is Leu, Ala, Val, Gly, or Ile
  SITE (127)..(127): Xaa at position 127 is Met, Ile, Leu, Val, Ala, or Gly
  SITE (130)..(130): Xaa at position 130 is Leu, Ala, Val, Gly, or Ile
  SITE (133)..(133): Xaa at position 133 is Ala, Gly, or Pro
  SITE (134)..(134): Xaa at position 134 is Tyr, Phe, Met, His, Ile, Leu, Val Ala, or Gly
  SITE (142)..(142): Xaa at position 142 is Leu, Ala, Val, Gly, or Ile
  SITE (146)..(146): Xaa at position 146 is Ile, Ala, Val, Leu, or Gly
  SITE (147)..(147): Xaa at position 147 is Ile, Ala, Val, Leu, or Gly
  SITE (157)..(157): Xaa at position 157 is Met, Ile, Leu, Val, Ala, or Gly
  SITE (158)..(158): Xaa at position 158 is Leu, Ala, Val, Gly, or Ile
  SITE (159)..(159): Xaa at position 159 is Val, Ala, Gly, Leu, or Ile
  SITE (162)..(162): Xaa at position 162 is Leu, Ala, Val, Gly, or Ile
  SITE (177)..(177): Xaa at position 177 is Val, Ala, Gly, Leu, or Ile
  SITE (181)..(181): Xaa at position 181 is Val, Ala, Gly, Leu, or Ile
  SITE (184)..(184): Xaa at position 184 is Leu, Ala, Val, Gly, or Ile
  SITE (187)..(187): Xaa at position 187 is Ala, Gly, or Pro
  SITE (199)..(199): Xaa at position 199 is Phe, Tyr, Met, His, Ile, Leu, Val Ala, or Gly
  SITE (200)..(200): Xaa at position 200 is Ile, Ala, Val, Leu, or Gly
  SITE (202)..(202): Xaa at position 202 is Ile, Ala, Val, Leu, or Gly
  SITE (203)..(203): Xaa at position 203 is Leu, Ala, Val, Gly, or Ile
  SITE (211)..(211): Xaa at position 211 is Leu, Ala, Val, Gly, or Ile
  SITE (214)..(214): Xaa at position 214 is Val, Ala, Gly, Leu, or Ile
  SITE (215)..(215): Xaa at position 215 is Phe, Tyr, Met, His, Ile, Leu, Val Ala, or Gly
  SITE (218)..(218): Xaa at position 218 is Tyr, Phe, Met, His, Ile, Leu, Val Ala, or Gly
  SITE (226)..(226): Xaa at position 226 is Ile, Ala, Val, Leu, or Gly
  SITE (230)..(230): Xaa at position 230 is Ile, Ala, Val, Leu, or Gly
  SITE (241)..(241): Xaa at position 241 is Leu, Ala, Val, Gly, or Ile
  SITE (242)..(242): Xaa at position 242 is Met, Ile, Leu, Val, Ala, or Gly
  SITE (243)..(243): Xaa at position 243 is Leu, Ala, Val, Gly, or Ile
  SITE (244)..(244): Xaa at position 244 is Ala, Gly, or Pro
  SITE (245)..(245): Xaa at position 245 is Val, Ala, Gly, Leu, or Ile
  SITE (246)..(246): Xaa at position 246 is Val, Ala, Gly, Leu, or Ile
  SITE (248)..(248): Xaa at position 248 is Cys, Ala, Val, Gly, Ser, or Thr
  SITE (249)..(249): Xaa at position 249 is Ile, Ala, Val, Leu, or Gly
  SITE (256)..(256): Xaa at position 256 is Phe, Tyr, Met, His, Ile, Leu, Val Ala, or Gly
  SITE (257)..(257): Xaa at position 257 is Ala, Gly, or Pro
  SITE (260)..(260): Xaa at position 260 is Leu, Ala, Val, Gly, or Ile
  SITE (263)..(263): Xaa at position 263 is Ala, Gly, or Pro
  SITE (264)..(264): Xaa at position 264 is Met, Ile, Leu, Val, Ala, or Gly
  SITE (274)..(274): Xaa at position 274 is Leu, Ala, Val, Gly, or Ile
  SITE (275)..(275): Xaa at position 275 is Ile, Ala, Val, Leu, or Gly
  SITE (277)..(277): Xaa at position 277 is Ile, Ala, Val, Leu, or Gly
  SITE (278)..(278): Xaa at position 278 is Met, Ile, Leu, Val, Ala, or Gly
  SITE (279)..(279): Xaa at position 279 is Val, Ala, Gly, Leu, or Ile
  SITE (284)..(284): Xaa at position 284 is Leu, Ala, Val, Gly, or Ile
  SITE (286)..(286): Xaa at position 286 is Met, Ile, Leu, Val, Ala, or Gly
  SITE (287)..(287): Xaa at position 287 is Leu, Ala, Val, Gly, or Ile
  SITE (289)..(289): Xaa at position 289 is Ile, Ala, Val, Leu, or Gly
  SITE (292)..(292): Xaa at position 292 is Ile, Ala, Val, Leu, or Gly
  SITE (293)..(293): Xaa at position 293 is Phe, Tyr, Met, His, Ile, Leu, Val Ala, or Gly
  SITE (301)..(301): Xaa at position 301 is Leu, Ala, Val, Gly, or Ile
  SITE (305)..(305): Xaa at position 305 is Ile, Ala, Val, Leu, or Gly
  SITE (317)..(317): Xaa at position 317 is Leu, Ala, Val, Gly, or Ile
  SITE (318)..(318): Xaa at position 318 is Leu, Ala, Val, Gly, or Ile
  SITE (320)..(320): Xaa at position 320 is Leu, Ala, Val, Gly, or Ile
  SITE (338)..(338): Xaa at position 338 is Val, Ala, Gly, Leu, or Ile
  SITE (339)..(339): Xaa at position 339 is Ala, Gly, or Pro
  SITE (343)..(343): Xaa at position 343 is Trp, Tyr, Phe, Met, His, Ile, Leu Val, Ala, or Gly
  SITE (357)..(357): Xaa at position 357 is Val, Ala, Gly, Leu, or Ile
  SITE (369)..(369): Xaa at position 369 is Ala, Gly, or Pro
  SITE (372)..(372): Xaa at position 372 is Leu, Ala, Val, Gly, or Ile
  SITE (375)..(375): Xaa at position 375 is Ala, Gly, or Pro
  SITE (376)..(376): Xaa at position 376 is Met, Ile, Leu, Val, Ala, or Gly
  SITE (386)..(386): Xaa at position 386 is Ile, Ala, Val, Leu, or Gly
  SITE (387)..(387): Xaa at position 387 is Ile, Ala, Val, Leu, or Gly
  SITE (390)..(390): Xaa at position 390 is Ile, Ala, Val, Leu, or Gly
  SITE (401)..(401): Xaa at position 401 is Ile, Ala, Val, Leu, or Gly
  SITE (405)..(405): Xaa at position 405 is Phe, Tyr, Met, His, Ile, Leu, Val Ala, or Gly
  SITE (413)..(413): Xaa at position 413 is Leu, Ala, Val, Gly, or Ile
  SITE (414)..(414): Xaa at position 414 is Met, Ile, Leu, Val, Ala, or Gly
  SITE (417)..(417): Xaa at position 417 is Leu, Ala, Val, Gly, or Ile
  SITE (428)..(428): Xaa at position 428 is Leu, Ala, Val, Gly, or Ile
  SITE (429)..(429): Xaa at position 429 is Ile, Ala, Val, Leu, or Gly
  SITE (432)..(432): Xaa at position 432 is Leu, Ala, Val, Gly, or Ile
  SITE (433)..(433): Xaa at position 433 is Met, Ile, Leu, Val, Ala, or Gly
  SITE (439)..(439): Xaa at position 439 is Tyr, Phe, Met, His, Ile, Leu, Val Ala, or Gly
  SITE (441)..(441): Xaa at position 441 is Ala, Gly, or Pro
  SITE (444)..(444): Xaa at position 444 is Leu, Ala, Val, Gly, or Ile
  SITE (447)..(447): Xaa at position 447 is Ala, Gly, or Pro
  SITE (448)..(448): Xaa at position 448 is Met, Ile, Leu, Val, Ala, or Gly
  SITE (457)..(457): Xaa at position 457 is Ala, Gly, or Pro
  SITE (458)..(458): Xaa at position 458 is Leu, Ala, Val, Gly, or Ile
  SITE (461)..(461): Xaa at position 461 is Ile, Ala, Val, Leu, or Gly
  SITE (462)..(462): Xaa at position 462 is Leu, Ala, Val, Gly, or Ile
  SITE (463)..(463): Xaa at position 463 is Ala, Gly, or Pro
  SITE (470)..(470): Xaa at position 470 is Ile, Ala, Val, Leu, or Gly
  SITE (473)..(473): Xaa at position 473 is Ile, Ala, Val, Leu, or Gly
  SITE (476)..(476): Xaa at position 476 is Ala, Gly, or Pro
  SITE (477)..(477): Xaa at position 477 is Tyr, Phe, Met, His, Ile, Leu, Val Ala, or Gly
  SITE (485)..(485): Xaa at position 485 is Leu, Ala, Val, Gly, or Ile
  SITE (489)..(489): Xaa at position 489 is Leu, Ala, Val, Gly, or Ile
  SITE (500)..(500): Xaa at position 500 is Ile, Ala, Val, Leu, or Gly
  SITE (501)..(501): Xaa at position 501 is Leu, Ala, Val, Gly, or Ile
  SITE (505)..(505): Xaa at position 505 is Ala, Gly, or Pro
  SITE (519)..(519): Xaa at position 519 is Ala, Gly, or Pro
  SITE (523)..(523): Xaa at position 523 is Ala, Gly, or Pro
  SITE (525)..(525): Xaa at position 525 is Val, Ala, Gly, Leu, or Ile
  SITE (526)..(526): Xaa at position 526 is Ala, Gly, or Pro
  SITE (529)..(529): Xaa at position 529 is Ile, Ala, Val, Leu, or Gly
  SITE (530)..(530): Xaa at position 530 is Leu, Ala, Val, Gly, or Ile
  SITE (532)..(532): Xaa at position 532 is Ile, Ala, Val, Leu, or Gly
  SITE (547)..(547): Xaa at position 547 is Phe, Tyr, Met, His, Ile, Leu, Val Ala, or Gly
  SITE (548)..(548): Xaa at position 548 is Met, Ile, Leu, Val, Ala, or Gly
  SITE (550)..(550): Xaa at position 550 is Ile, Ala, Val, Leu, or Gly
  SITE (551)..(551): Xaa at position 551 is Leu, Ala, Val, Gly, or Ile
  SITE (559)..(559): Xaa at position 559 is Leu, Ala, Val, Gly, or Ile
  SITE (562)..(562): Xaa at position 562 is Val, Ala, Gly, Leu, or Ile
  SITE (563)..(563): Xaa at position 563 is Phe, Tyr, Met, His, Ile, Leu, Val Ala, or Gly
  SITE (566)..(566): Xaa at position 566 is Phe, Tyr, Met, His, Ile, Leu, Val Ala, or Gly
  SITE (574)..(574): Xaa at position 574 is Val, Ala, Gly, Leu, or Ile
  SITE (578)..(578): Xaa at position 578 is Ile, Ala, Val, Leu, or Gly
  SITE (589)..(589): Xaa at position 589 is Ala, Gly, or Pro
  SITE (590)..(590): Xaa at position 590 is Phe, Tyr, Met, His, Ile, Leu, Val Ala, or Gly
  SITE (592)..(592): Xaa at position 592 is Ala, Gly, or Pro
  SITE (593)..(593): Xaa at position 593 is Ile, Ala, Val, Leu, or Gly
  SITE (594)..(594): Xaa at position 594 is Val, Ala, Gly, Leu, or Ile
  SITE (597)..(597): Xaa at position 597 is Val, Ala, Gly, Leu, or Ile
  SITE (602)..(602): Xaa at position 602 is Leu, Ala, Val, Gly, or Ile
  SITE (604)..(604): Xaa at position 604 is Phe, Tyr, Met, His, Ile, Leu, Val Ala, or Gly
  SITE (605)..(605): Xaa at position 605 is Ala, Gly, or Pro
  SITE (608)..(608): Xaa at position 608 is Leu, Ala, Val, Gly, or Ile
  SITE (612)..(612): Xaa at position 612 is Met, Ile, Leu, Val, Ala, or Gly
  SITE (622)..(622): Xaa at position 622 is Leu, Ala, Val, Gly, or Ile
  SITE (625)..(625): Xaa at position 625 is Ile, Ala, Val, Leu, or Gly
  SITE (626)..(626): Xaa at position 626 is Met, Ile, Leu, Val, Ala, or Gly
  SITE (632)..(632): Xaa at position 632 is Ile, Ala, Val, Leu, or Gly
  SITE (634)..(634): Xaa at position 634 is Leu, Ala, Val, Gly, or Ile
  SITE (635)..(635): Xaa at position 635 is Leu, Ala, Val, Gly, or Ile
  SITE (637)..(637): Xaa at position 637 is Ile, Ala, Val, Leu, or Gly
  SITE (641)..(641): Xaa at position 641 is Phe, Tyr, Met, His, Ile, Leu, Val Ala, or Gly
  SITE (649)..(649): Xaa at position 649 is Leu, Ala, Val, Gly, or Ile
  SITE (653)..(653): Xaa at position 653 is Ile, Ala, Val, Leu, or Gly
  SITE (664)..(664): Xaa at position 664 is Ala, Gly, or Pro
  SITE (665)..(665): Xaa at position 665 is Leu, Ala, Val, Gly, or Ile
  SITE (666)..(666): Xaa at position 666 is Leu, Ala, Val, Gly, or Ile
  SITE (668)..(668): Xaa at position 668 is Leu, Ala, Val, Gly, or Ile
  SITE (669)..(669): Xaa at position 669 is Cys, Ala, Val, Gly, Ser, or Thr
MAKPAQGAKYRGSIHDFPGFDPNQDXEAXYTXXKGFGSDKEAXXDIXTSRSNRQRQEXCQSXKSLYGKDXXADXKYELTGKFERXXXGXXRPPAYCDXKEXKDXXSGIGTDEKXXXEXXASRTNEQXHQXVAXXKDAYERDXEADXXGDTSGHFQKXXXVLXQGTREEDDVVSEDLXQQDXQDXYEXGELKWGTDEAQXXYXXGNRSKQHXRLXXDEXLKTTGKPXEASXRGELSGDFEKXXXXXXKXXRSTPEYXXERXFKXXKGLGTRDNTXXRXXXSRSEXDXXDXREXXRTKYEKSXYSMXKNDTSGEYKKTXXKXSGGDDDAAGQFFPEAAQXXYQMXELSAVARVELKGTXRPANDFNPDADXKAXRKXXKGLGTDEDTXXDIXTHRSNVQRQQXRQTXKSHFGRDXXTDXKSEISGDLARXXLGXXMPPAHXDXKQXKKXXEGAGTDEKXXIEXXXTRTNAEXRAXNEXXKEDYHKSXEDAXSSDTSGHFRRXXISLXTGHREEGGENLDQXREDXQXXAEXXEXADTPSGDKTSLETRXXTXXCTRSYPHXRRXXQEXIKMTNYDXEHTXKKEMSGDVRDXXVXXXQSXKNKPXFXXDKXYKSXKGAGTDEKTXTRXXVSRSEXDXXNXRREXIEKYDKSXHQAXEGDTSGDFLKXXXAXXGGED

SEQ ID NO: 239 - protein, 1280 aa, Homo sapiens
  SITE (58)..(58): Xaa at position 58 is Ala, Gly, or Pro
  SITE (75)..(75): Xaa at position 75 is Met, Ile, Leu, Val, Ala, or Gly
  SITE (107)..(107): Xaa at position 107 is Leu, Ala, Val, Gly, or Ile
  SITE (111)..(111): Xaa at position 111 is Met, Ile, Leu, Val, Ala, or Gly
  SITE (118)..(118): Xaa at position 118 is Tyr, Phe, Met, His, Ile, Leu, Val Ala, or Gly
  SITE (125)..(125): Xaa at position 125 is Val, Ala, Gly, Leu, or Ile
  SITE (129)..(129): Xaa at position 129 is Ala, Gly, or Pro
  SITE (135)..(135): Xaa at position 135 is Phe, Tyr, Met, His, Ile, Leu, Val Ala, or Gly
  SITE (137)..(137): Xaa at position 137 is Cys, Ala, Val, Gly, Ser, or Thr
  SITE (139)..(139): Xaa at position 139 is Ala, Gly, or Pro
  SITE (140)..(140): Xaa at position 140 is Ala, Gly, or Pro
  SITE (144)..(144): Xaa at position 144 is Ile, Ala, Val, Leu, or Gly
  SITE (147)..(147): Xaa at position 147 is Ile, Ala, Val, Leu, or Gly
  SITE (151)..(151): Xaa at position 151 is Phe, Tyr, Met, His, Ile, Leu, Val Ala, or Gly
  SITE (152)..(152): Xaa at position 152 is Phe, Tyr, Met, His, Ile, Leu, Val Ala, or Gly
  SITE (154)..(154): Xaa at position 154 is Ala, Gly, or Pro
  SITE (155)..(155): Xaa at position 155 is Ile, Ala, Val, Leu, or Gly
  SITE (156)..(156): Xaa at position 156 is Met, Ile, Leu, Val, Ala, or Gly
  SITE (160)..(160): Xaa at position 160 is Ile, Ala, Val, Leu, or Gly
  SITE (171)..(171): Xaa at position 171 is Leu, Ala, Val, Gly, or Ile
  SITE (175)..(175): Xaa at position 175 is Leu, Ala, Val, Gly, or Ile
  SITE (179)..(179): Xaa at position 179 is Val, Ala, Gly, Leu, or Ile
  SITE (182)..(182): Xaa at position 182 is Ile, Ala, Val, Leu, or Gly
  SITE (186)..(186): Xaa at position 186 is Ile, Ala, Val, Leu, or Gly
  SITE (198)..(198): Xaa at position 198 is Ala, Gly, or Pro
  SITE (206)..(206): Xaa at position 206 is Val, Ala, Gly, Leu, or Ile
  SITE (214)..(214): Xaa at position 214 is Leu, Ala, Val, Gly, or Ile
  SITE (218)..(218): Xaa at position 218 is Ile, Ala, Val, Leu, or Gly
  SITE (233)..(233): Xaa at position 233 is Ala, Gly, or Pro
  SITE (250)..(250): Xaa at position 250 is Ala, Gly, or Pro
  SITE (254)..(254): Xaa at position 254 is Ala, Gly, or Pro
  SITE (257)..(257): Xaa at position 257 is Val, Ala, Gly, Leu, or Ile
  SITE (260)..(260): Xaa at position 260 is Ala, Gly, or Pro
  SITE (264)..(264): Xaa at position 264 is Val, Ala, Gly, Leu, or Ile
  SITE (266)..(266): Xaa at position 266 is Ala, Gly, or Pro
  SITE (267)..(267): Xaa at position 267 is Phe, Tyr, Met, His, Ile, Leu, Val Ala, or Gly
  SITE (277)..(277): Xaa at position 277 is Tyr, Phe, Met, His, Ile, Leu, Val Ala, or Gly
  SITE (281)..(281): Xaa at position 281 is Leu, Ala, Val, Gly, or Ile
  SITE (284)..(284): Xaa at position 284 is Ala, Gly, or Pro
  SITE (292)..(292): Xaa at position 292 is Ala, Gly, or Pro
  SITE (301)..(301): Xaa at position 301 is Ala, Gly, or Pro
  SITE (302)..(302): Xaa at position 302 is Ala, Gly, or Pro
  SITE (308)..(308): Xaa at position 308 is Ala, Gly, or Pro
  SITE (311)..(311): Xaa at position 311 is Ala, Gly, or Pro
  SITE (313)..(313): Xaa at position 313 is Ala, Gly, or Pro
  SITE (314)..(314): Xaa at position 314 is Phe, Tyr, Met, His, Ile, Leu, Val Ala, or Gly
  SITE (332)..(332): Xaa at position 332 is Leu, Ala, Val, Gly, or Ile
  SITE (334)..(334): Xaa at position 334 is Val, Ala, Gly, Leu, or Ile
  SITE (335)..(335): Xaa at position 335 is Phe, Tyr, Met, His, Ile, Leu, Val Ala, or Gly
  SITE (338)..(338): Xaa at position 338 is Val, Ala, Gly, Leu, or Ile
  SITE (348)..(348): Xaa at position 348 is Ala, Gly, or Pro
  SITE (358)..(358): Xaa at position 358 is Ala, Gly, or Pro
  SITE (362)..(362): Xaa at position 362 is Ala, Gly, or Pro
  SITE (365)..(365): Xaa at position 365 is Ile, Ala, Val, Leu, or Gly
  SITE (369)..(369): Xaa at position 369 is Ile, Ala, Val, Leu, or Gly
  SITE (375)..(375): Xaa at position 375 is Ile, Ala, Val, Leu, or Gly
  SITE (392)..(392): Xaa at position 392 is Leu, Ala, Val, Gly, or Ile
  SITE (397)..(397): Xaa at position 397 is Val, Ala, Gly, Leu, or Ile
  SITE (410)..(410): Xaa at position 410 is Leu, Ala, Val, Gly, or Ile
  SITE (413)..(413): Xaa at position 413 is Leu, Ala, Val, Gly, or Ile
  SITE (417)..(417): Xaa at position 417 is Val, Ala, Gly, Leu, or Ile
  SITE (423)..(423): Xaa at position 423 is Val, Ala, Gly, Leu, or Ile
  SITE (424)..(424): Xaa at position 424 is Ala, Gly, or Pro
  SITE (425)..(425): Xaa at position 425 is Leu, Ala, Val, Gly, or Ile
  SITE (426)..(426): Xaa at position 426 is Val, Ala, Gly, Leu, or Ile
  SITE (431)..(431): Xaa at position 431 is Cys, Ala, Val, Gly, Ser, or Thr
  SITE (439)..(439): Xaa at position 439 is Leu, Ala, Val, Gly, or Ile
  SITE (440)..(440): Xaa at position 440 is Met, Ile, Leu, Val, Ala, or Gly
  SITE (451)..(451): Xaa at position 451 is Val, Ala, Gly, Leu, or Ile
  SITE (458)..(458): Xaa at position 458 is Ile, Ala, Val, Leu, or Gly
  SITE (461)..(461): Xaa at position 461 is Ile, Ala, Val, Leu, or Gly
  SITE (463)..(463): Xaa at position 463 is Val, Ala, Gly, Leu, or Ile
  SITE (466)..(466): Xaa at position 466 is Leu, Ala, Val, Gly, or Ile
  SITE (470)..(470): Xaa at position 470 is Ile, Ala, Val, Leu, or Gly
  SITE (473)..(473): Xaa at position 473 is Val, Ala, Gly, Leu, or Ile
  SITE (479)..(479): Xaa at position 479 is Leu, Ala, Val, Gly, or Ile
  SITE (480)..(480): Xaa at position 480 is Phe, Tyr, Met, His, Ile, Leu, Val Ala, or Gly
  SITE (484)..(484): Xaa at position 484 is Ile, Ala, Val, Leu, or Gly
  SITE (488)..(488): Xaa at position 488 is Ile, Ala, Val, Leu, or Gly
  SITE (500)..(500): Xaa at position 500 is Ile, Ala, Val, Leu, or Gly
  SITE (504)..(504): Xaa at position 504 is Val, Ala, Gly, Leu, or Ile
  SITE (507)..(507): Xaa at position 507 is Ala, Gly, or Pro
  SITE (509)..(509): Xaa at position 509 is Ala, Gly, or Pro
  SITE (513)..(513): Xaa at position 513 is Ile, Ala, Val, Leu, or Gly
  SITE (524)..(524): Xaa at position 524 is Val, Ala, Gly, Leu, or Ile
  SITE (539)..(539): Xaa at position 539 is Ile, Ala, Val, Leu, or Gly
  SITE (540)..(540): Xaa at position 540 is Ala, Gly, or Pro
  SITE (541)..(541): Xaa at position 541 is Ile, Ala, Val, Leu, or Gly
  SITE (542)..(542): Xaa at position 542 is Ala, Gly, or Pro
  SITE (544)..(544): Xaa at position 544 is Ala, Gly, or Pro
  SITE (551)..(551): Xaa at position 551 is Ile, Ala, Val, Leu, or Gly
  SITE (553)..(553): Xaa at position 553 is Leu, Ala, Val, Gly, or Ile
  SITE (554)..(554): Xaa at position 554 is Leu, Ala, Val, Gly, or Ile
  SITE (557)..(557): Xaa at position 557 is Ala, Gly, or Pro
  SITE (569)..(569): Xaa at position 569 is Val, Ala, Gly, Leu, or Ile
  SITE (572)..(572): Xaa at position 572 is Ala, Gly, or Pro
  SITE (573)..(573): Xaa at position 573 is Leu, Ala, Val, Gly, or Ile
  SITE (576)..(576): Xaa at position 576 is Ala, Gly, or Pro
  SITE (583)..(583): Xaa at position 583 is Ile, Ala, Val, Leu, or Gly
  SITE (585)..(585): Xaa at position 585 is Ile, Ala, Val, Leu, or Gly
  SITE (592)..(592): Xaa at position 592 is Val, Ala, Gly, Leu, or Ile
  SITE (598)..(598): Xaa at position 598 is Ile, Ala, Val, Leu, or Gly
  SITE (599)..(599): Xaa at position 599 is Ala, Gly, or Pro
  SITE (601)..(601): Xaa at position 601 is Phe, Tyr, Met, His, Ile, Leu, Val Ala, or Gly
  SITE (615)..(615): Xaa at position 615 is Leu, Ala, Val, Gly, or Ile
  SITE (622)..(622): Xaa at position 622 is Tyr, Phe, Met, His, Ile, Leu, Val Ala, or Gly
  SITE (700)..(700): Xaa at position 700 is Ile, Ala, Val, Leu, or Gly
  SITE (717)..(717): Xaa at position 717 is Cys, Ala, Val, Gly, Ser, or Thr
  SITE (718)..(718): Xaa at position 718 is Ala, Gly, or Pro
  SITE (735)..(735): Xaa at position 735 is Ile, Ala, Val, Leu, or Gly
  SITE (736)..(736): Xaa at position 736 is Ile, Ala, Val, Leu, or Gly
  SITE (754)..(754): Xaa at position 754 is Leu, Ala, Val, Gly, or Ile
  SITE (758)..(758): Xaa at position 758 is Leu, Ala, Val, Gly, or Ile
  SITE (759)..(759): Xaa at position 759 is Phe, Tyr, Met, His, Ile, Leu, Val Ala, or Gly
  SITE (762)..(762): Xaa at position 762 is Leu, Ala, Val, Gly, or Ile
  SITE (780)..(780): Xaa at position 780 is Ala, Gly, or Pro
  SITE (784)..(784): Xaa at position 784 is Leu, Ala, Val, Gly, or Ile
  SITE (788)..(788): Xaa at position 788 is Leu, Ala, Val, Gly, or Ile
  SITE (792)..(792): Xaa at position 792 is Val, Ala, Gly, Leu, or Ile
  SITE (793)..(793): Xaa at position 793 is Phe, Tyr, Met, His, Ile, Leu, Val Ala, or Gly
  SITE (796)..(796): Xaa at position 796 is Met, Ile, Leu, Val, Ala, or Gly
  SITE (797)..(797): Xaa at position 797 is Leu, Ala, Val, Gly, or Ile
  SITE (818)..(818): Xaa at position 818 is Leu, Ala, Val, Gly, or Ile
  SITE (822)..(822): Xaa at position 822 is Ala, Gly, or Pro
  SITE (825)..(825): Xaa at position 825 is Val, Ala, Gly, Leu, or Ile
  SITE (828)..(828): Xaa at position 828 is Ala, Gly, or Pro
  SITE (834)..(834): Xaa at position 834 is Ala, Gly, or Pro
  SITE (841)..(841): Xaa at position 841 is Ala, Gly, or Pro
  SITE (857)..(857): Xaa at position 857 is Leu, Ala, Val, Gly, or Ile
  SITE (897)..(897): Xaa at position 897 is Ala, Gly, or Pro
  SITE (900)..(900): Xaa at position 900 is Ala, Gly, or Pro
  SITE (901)..(901): Xaa at position 901 is Ile, Ala, Val, Leu, or Gly
  SITE (904)..(904): Xaa at position 904 is Phe, Tyr, Met, His, Ile, Leu, Val Ala, or Gly
  SITE (907)..(907): Xaa at position 907 is Val, Ala, Gly, Leu, or Ile
  SITE (916)..(916): Xaa at position 916 is Phe, Tyr, Met, His, Ile, Leu, Val Ala, or Gly
  SITE (935)..(935): Xaa at position 935 is Ala, Gly, or Pro
  SITE (956)..(956): Xaa at position 956 is Cys, Ala, Val, Gly, Ser, or Thr
  SITE (961)..(961): Xaa at position 961 is Ala, Gly, or Pro
  SITE (976)..(976): Xaa at position 976 is Leu, Ala, Val, Gly, or Ile
  SITE (977)..(977): Xaa at position 977 is Val, Ala, Gly, Leu, or Ile
  SITE (983)..(983): Xaa at position 983 is Phe, Tyr, Met, His, Ile, Leu, Val Ala, or Gly
  SITE (1001)..(1001): Xaa at position 1001 is Ala, Gly, or Pro
  SITE (1005)..(1005): Xaa at position 1005 is Ala, Gly, or Pro
  SITE (1007)..(1007): Xaa at position 1007 is His, Phe, Tyr, Lys, Arg, Gly Ser, Thr, Ala, Val, Leu, Ile, Asn, Met, or Gln
  SITE (1008)..(1008): Xaa at position 1008 is Ile, Ala, Val, Leu, or Gly
  SITE (1035)..(1035): Xaa at position 1035 is Val, Ala, Gly, Leu, or Ile
  SITE (1037)..(1037): Xaa at position 1037 is Phe, Tyr, Met, His, Ile, Leu Val, Ala, or Gly
  SITE (1040)..(1040): Xaa at position 1040 is Val, Ala, Gly, Leu, or Ile
  SITE (1042)..(1042): Xaa at position 1042 is Phe, Tyr, Met, His, Ile, Leu Val, Ala, or Gly
  SITE (1053)..(1053): Xaa at position 1053 is Leu, Ala, Val, Gly, or Ile
  SITE (1056)..(1056): Xaa at position 1056 is Leu, Ala, Val, Gly, or Ile
  SITE (1060)..(1060): Xaa at position 1060 is Val, Ala, Gly, Leu, or Ile
  SITE (1066)..(1066): Xaa at position 1066 is Leu, Ala, Val, Gly, or Ile
  SITE (1067)..(1067): Xaa at position 1067 is Ala, Gly, or Pro
  SITE (1068)..(1068): Xaa at position 1068 is Leu, Ala, Val, Gly, or Ile
  SITE (1069)..(1069): Xaa at position 1069 is Val, Ala, Gly, Leu, or Ile
  SITE (1079)..(1079): Xaa at position 1079 is Val, Ala, Gly, Leu, or Ile
  SITE (1082)..(1082): Xaa at position 1082 is Leu, Ala, Val, Gly, or Ile
  SITE (1083)..(1083): Xaa at position 1083 is Leu, Ala, Val, Gly, or Ile
  SITE (1094)..(1094): Xaa at position 1094 is Val, Ala, Gly, Leu, or Ile
  SITE (1101)..(1101): Xaa at position 1101 is Ile, Ala, Val, Leu, or Gly
  SITE (1104)..(1104): Xaa at position 1104 is Leu, Ala, Val, Gly, or Ile
  SITE (1106)..(1106): Xaa at position 1106 is Val, Ala, Gly, Leu, or Ile
  SITE (1109)..(1109): Xaa at position 1109 is Leu, Ala, Val, Gly, or Ile
  SITE (1113)..(1113): Xaa at position 1113 is Leu, Ala, Val, Gly, or Ile
  SITE (1116)..(1116): Xaa at position 1116 is Val, Ala, Gly, Leu, or Ile
  SITE (1123)..(1123): Xaa at position 1123 is Phe, Tyr, Met, His, Ile, Leu Val, Ala, or Gly
  SITE (1128)..(1128): Xaa at position 1128 is Ala, Gly, or Pro
  SITE (1131)..(1131): Xaa at position 1131 is Ile, Ala, Val, Leu, or Gly
  SITE (1145)..(1145): Xaa at position 1145 is Ile, Ala, Val, Leu, or Gly
  SITE (1148)..(1148): Xaa at position 1148 is Ala, Gly, or Pro
  SITE (1149)..(1149): Xaa at position 1149 is Ala, Gly, or Pro
  SITE (1152)..(1152): Xaa at position 1152 is Ala, Gly, or Pro
  SITE (1154)..(1154): Xaa at position 1154 is Ile, Ala, Val, Leu, or Gly
  SITE (1165)..(1165): Xaa at position 1165 is Tyr, Phe, Met, His, Ile, Leu Val, Ala, or Gly
  SITE (1169)..(1169): Xaa at position 1169 is Val, Ala, Gly, Leu, or Ile
  SITE (1185)..(1185): Xaa at position 1185 is Ala, Gly, or Pro
  SITE (1186)..(1186): Xaa at position 1186 is Ile, Ala, Val, Leu, or Gly
  SITE (1187)..(1187): Xaa at position 1187 is Ala, Gly, or Pro
  SITE (1190)..(1190): Xaa at position 1190 is Leu, Ala, Val, Gly, or Ile
  SITE (1198)..(1198): Xaa at position 1198 is Leu, Ala, Val, Gly, or Ile
  SITE (1199)..(1199): Xaa at position 1199 is Leu, Ala, Val, Gly, or Ile
  SITE (1214)..(1214): Xaa at position 1214 is Val, Ala, Gly, Leu, or Ile
  SITE (1217)..(1217): Xaa at position 1217 is Ala, Gly, or Pro
  SITE (1227)..(1227): Xaa at position 1227 is Cys, Ala, Val, Gly, Ser, or Thr
  SITE (1228)..(1228): Xaa at position 1228 is Ile, Ala, Val, Leu, or Gly
  SITE (1230)..(1230): Xaa at position 1230 is Ile, Ala, Val, Leu, or Gly
  SITE (1237)..(1237): Xaa at position 1237 is Ile, Ala, Val, Leu, or Gly
  SITE (1243)..(1243): Xaa at position 1243 is Ile, Ala, Val, Leu, or Gly
  SITE (1244)..(1244): Xaa at position 1244 is Val, Ala, Gly, Leu, or Ile
  SITE (1245)..(1245): Xaa at position 1245 is Val, Ala, Gly, Leu, or Ile
  SITE (1260)..(1260): Xaa at position 1260 is Leu, Ala, Val, Gly, or Ile
  SITE (1267)..(1267): Xaa at position 1267 is Tyr, Phe, Met, His, Ile, Leu Val, Ala, or Gly
MDLEGDRNGGAKKKNFFKLNNKSEKDKKEKKPTVSVFSMFRYSNWLDKLYMVVGTLAXIIHGAGLPLMMLVFGEXTDIFANAGNLEDLMSNITNRSDINDTGFFMNXEEDXTRYAYYXSGIGAGXLVAXYIQVSXWXLXXGRQXHKXRKQXXHXXXRQEXGWFDVHDVGEXNTRXTDDXSKXNEGXGDKIGMFFQSMXTFFTGFIXGFTRGWKXTLVXLAISPVLGLSAAVWXKILSSFTDKELLAYAKXGAVXEEXLAXIRTXIXXGGQKKELERXNKNXEEXKRIGIKKXITANISIGXXFLLIYXSYXLXXWYGTTLVLSGEYSIGQVXTXXFSXLIGAFSVGQXSPSIEAFANXRGAXYEXFKIXDNKPSXDSYSKSGHKPDNIKGNXEFRNXHFSYPSRKEVKIXKGXNLKXQSGQTXXXXGNSGXGKSTTVQXXQRLYDPTEGMXSVDGQDXRTXNXRFXREIXGVXSQEPVXXATTXAENXRYGRENVTMDEXEKAXKEXNXYDFXMKLPHKFDTLXGERGAQLSGGQKQRXXXXRXLVRNPKXLXXDEXTSALDTESEAVXQVXXDKXRKGRTTXVXAHRLSTXRNADVXXGXDDGVIVEKGNHDEXMKEKGIXFKLVTMQTAGNEVELENAADESKSEIDALEMSSNDSRSSLIRKRSTRRSVRGSQAQDRKLSTKEALDESIPPVSFWRXMKLNLTEWPYFVVGVFXXIINGGLQPAFAIIFSKXXGVFTRIDDPETKRQNSNXFSLXXLAXGIISFITFFLQGFTFGKXGEIXTKRXRYMXXRSXXRQDVSWFDDPKNTTGALTTRXANDXAQXKGXIGSRLXVITQNIXNLGTGIIISFIYGWQXTLLLLAIVPIIAIAGVVEMKMLSGQALKDKKELEGSGKIXTEXXENXRTXVSLTQEQKXEHMYAQSLQVPYRNSLRKXHIFGITFSFTQAMMYFSYAGXFRFGXYLVAHKLMSFEDVLXXFSAVVXGAMAVGQVSSFAPDYAKXKISXAXXIMIIEKTPLIDSYSTEGLMPNTLEGNXTXGEXVXNYPTRPDIPVXQGXSLEXKKGQTXXXXGSSGCGKSTXVQXXERFYDPLAGKXLLDGKEXKRXNXQWXRAHXGIXSQEPILXDCSIXENXAYGDNSRVVSQEEXVRXXKEXNXHAFIESLPNKXSTKXGDKGTQLSGGQKQRIXXXRAXVRQPHILXXDEATSALDTESEKVXQEXLDKAREGRTXXVXAHRLSTXQNADLXXXFQNGRVKEHGTHQQXLAQKGIXFSMVSVQAGTKRQ

SEQ ID NO: 240 - protein, 984 aa, Homo sapiens
  SITE (603)..(603): Xaa at position 603 is Cys, Ala, Val, Gly, Ser, or Thr
  SITE (605)..(605): Xaa at position 605 is Val, Ala, Gly, Leu, or Ile
  SITE (617)..(617): Xaa at position 617 is Val, Ala, Gly, Leu, or Ile
  SITE (620)..(620): Xaa at position 620 is Cys, Ala, Val, Gly, Ser, or Thr
  SITE (623)..(623): Xaa at position 623 is Cys, Ala, Val, Gly, Ser, or Thr
  SITE (627)..(627): Xaa at position 627 is Phe, Tyr, Met, His, Ile, Leu, Val Ala, or Gly
  SITE (630)..(630): Xaa at position 630 is Ala, Gly, or Pro
  SITE (645)..(645): Xaa at position 645 is Cys, Ala, Val, Gly, Ser, or Thr
  SITE (647)..(647): Xaa at position 647 is Ile, Ala, Val, Leu, or Gly
  SITE (657)..(657): Xaa at position 657 is Ala, Gly, or Pro
  SITE (658)..(658): Xaa at position 658 is Cys, Ala, Val, Gly, Ser, or Thr
  SITE (663)..(663): Xaa at position 663 is Cys, Ala, Val, Gly, Ser, or Thr
  SITE (668)..(668): Xaa at position 668 is Met, Ile, Leu, Val, Ala, or Gly
  SITE (742)..(742): Xaa at position 742 is Leu, Ala, Val, Gly, or Ile
  SITE (752)..(752): Xaa at position 752 is Ala, Gly, or Pro
  SITE (765)..(765): Xaa at position 765 is Leu, Ala, Val, Gly, or Ile
  SITE (769)..(769): Xaa at position 769 is Leu, Ala, Val, Gly, or Ile
  SITE (772)..(772): Xaa at position 772 is Leu, Ala, Val, Gly, or Ile
  SITE (777)..(777): Xaa at position 777 is Met, Ile, Leu, Val, Ala, or Gly
  SITE (783)..(783): Xaa at position 783 is Trp, Tyr, Phe, Met, His, Ile, Leu Val, Ala, or Gly
  SITE (784)..(784): Xaa at position 784 is Ala, Gly, or Pro
  SITE (787)..(787): Xaa at position 787 is Leu, Ala, Val, Gly, or Ile
  SITE (790)..(790): Xaa at position 790 is Phe, Tyr, Met, His, Ile, Leu, Val Ala, or Gly
  SITE (801)..(801): Xaa at position 801 is Leu, Ala, Val, Gly, or Ile
  SITE (806)..(806): Xaa at position 806 is Trp, Tyr, Phe, Met, His, Ile, Leu Val, Ala, or Gly
  SITE (809)..(809): Xaa at position 809 is Leu, Ala, Val, Gly, or Ile
  SITE (812)..(812): Xaa at position 812 is Phe, Tyr, Met, His, Ile, Leu, Val Ala, or Gly
  SITE (814)..(814): Xaa at position 814 is Leu, Ala, Val, Gly, or Ile
  SITE (827)..(827): Xaa at position 827 is Leu, Ala, Val, Gly, or Ile
  SITE (830)..(830): Xaa at position 830 is Ala, Gly, or Pro
  SITE (833)..(833): Xaa at position 833 is Leu, Ala, Val, Gly, or Ile
  SITE (835)..(835): Xaa at position 835 is Phe, Tyr, Met, His, Ile, Leu, Val Ala, or Gly
  SITE (849)..(849): Xaa at position 849 is Cys, Ala, Val, Gly, Ser, or Thr
  SITE (855)..(855): Xaa at position 855 is Ile, Ala, Val, Leu, or Gly
  SITE (859)..(859): Xaa at position 859 is Phe, Tyr, Met, His, Ile, Leu, Val Ala, or Gly
  SITE (862)..(862): Xaa at position 862 is Leu, Ala, Val, Gly, or Ile
  SITE (864)..(864): Xaa at position 864 is Leu, Ala, Val, Gly, or Ile
  SITE (866)..(866): Xaa at position 866 is Phe, Tyr, Met, His, Ile, Leu, Val Ala, or Gly
  SITE (869)..(869): Xaa at position 869 is Tyr, Phe, Met, His, Ile, Leu, Val Ala, or Gly
  SITE (871)..(871): Xaa at position 871 is Ile, Ala, Val, Leu, or Gly
  SITE (872)..(872): Xaa at position 872 is Met, Ile, Leu, Val, Ala, or Gly
  SITE (874)..(874): Xaa at position 874 is Val, Ala, Gly, Leu, or Ile
  SITE (875)..(875): Xaa at position 875 is Leu, Ala, Val, Gly, or Ile
  SITE (876)..(876): Xaa at position 876 is Leu, Ala, Val, Gly, or Ile
  SITE (877)..(877): Xaa at position 877 is Leu, Ala, Val, Gly, or Ile
  SITE (878)..(878): Xaa at position 878 is Leu, Ala, Val, Gly, or Ile
  SITE (892)..(892): Xaa at position 892 is Phe, Tyr, Met, His, Ile, Leu, Val Ala, or Gly
  SITE (895)..(895): Xaa at position 895 is Met, Ile, Leu, Val, Ala, or Gly
  SITE (903)..(903): Xaa at position 903 is Leu, Ala, Val, Gly, or Ile
  SITE (907)..(907): Xaa at position 907 is Val, Ala, Gly, Leu, or Ile
  SITE (924)..(924): Xaa at position 924 is Leu, Ala, Val, Gly, or Ile
  SITE (927)..(927): Xaa at position 927 is Leu, Ala, Val, Gly, or Ile
  SITE (928)..(928): Xaa at position 928 is Leu, Ala, Val, Gly, or Ile
  SITE (931)..(931): Xaa at position 931 is Met, Ile, Leu, Val, Ala, or Gly
  SITE (943)..(943): Xaa at position 943 is Phe, Tyr, Met, His, Ile, Leu, Val Ala, or Gly
  SITE (954)..(954): Xaa at position 954 is Val, Ala, Gly, Leu, or Ile
  SITE (960)..(960): Xaa at position 960 is Leu, Ala, Val, Gly, or Ile
  SITE (964)..(964): Xaa at position 964 is Ile, Ala, Val, Leu, or Gly
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAIVKSPIMCHEKSPSVCSPLNMTSSVCSPAGINSVSSTTASFGSFPVHSPITQGTPLTCSPNAENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKIXLXCGDEASGCHYGXVTXGSXKVFXKRXVEGQHNYLCAGRNDXIXDKIRRKNCPXXRLQKXLQAGXNLGARKSKKLGKLKGIHEEQPQQQQPPPPPPPPQSPEEGTTYIAPAKEPSVNTALVPQLSTISRALTPSPVMVXENIEPEIVYXGYDSSKPDTAENXLSTXNRXAGKQXIQVVKXXKVXPGXKNLPLEDQITXIQYSXMCXSSXAXSWRSYKHTNSQFXYFXPDXVXNEEKMHQSAMYELXQGMHQXSLQXVRXQXTXEEXTXXKXXXXXSTIPKDGLKSQAAXEEXRTNYIKEXRKMXTKCPNNSGQSWQRFYQXTKXXDSXHDLVSDLLEFCXYTFRESHALKXEFPAMXVEIXSDQLPKVESGNAKPLYFHRK

SEQ ID NO: 241 - protein, 651 aa, Homo sapiens
  SITE (45)..(45): Xaa at position 45 is Trp, Tyr, Phe, Met, His, Ile, Leu Val, Ala, or Gly
  SITE (47)..(47): Xaa at position 47 is Phe, Tyr, Met, His, Ile, Leu, Val Ala, or Gly
  SITE (68)..(68): Xaa at position 68 is Leu, Ala, Val, Gly, or Ile
  SITE (99)..(99): Xaa at position 99 is Val, Ala, Gly, Leu, or Ile
  SITE (100)..(100): Xaa at position 100 is Trp, Tyr, Phe, Met, His, Ile, Leu Val, Ala, or Gly
  SITE (101)..(101): Xaa at position 101 is Tyr, Phe, Met, His, Ile, Leu, Val Ala, or Gly
  SITE (119)..(119): Xaa at position 119 is Val, Ala, Gly, Leu, or Ile
  SITE (120)..(120): Xaa at position 120 is Val, Ala, Gly, Leu, or Ile
  SITE (123)..(123): Xaa at position 123 is Ile, Ala, Val, Leu, or Gly
  SITE (130)..(130): Xaa at position 130 is Ala, Gly, or Pro
  SITE (132)..(132): Xaa at position 132 is Val, Ala, Gly, Leu, or Ile
  SITE (147)..(147): Xaa at position 147 is Leu, Ala, Val, Gly, or Ile
  SITE (168)..(168): Xaa at position 168 is Ile, Ala, Val, Leu, or Gly
  SITE (170)..(170): Xaa at position 170 is Ile, Ala, Val, Leu, or Gly
  SITE (171)..(171): Xaa at position 171 is Ala, Gly, or Pro
  SITE (172)..(172): Xaa at position 172 is Ile, Ala, Val, Leu, or Gly
  SITE (176)..(176): Xaa at position 176 is Leu, Ala, Val, Gly, or Ile
  SITE (208)..(208): Xaa at position 208 is Phe, Tyr, Met, His, Ile, Leu, Val Ala, or Gly
  SITE (211)..(211): Xaa at position 211 is Tyr, Phe, Met, His, Ile, Leu, Val Ala, or Gly
  SITE (214)..(214): Xaa at position 214 is Leu, Ala, Val, Gly, or Ile
  SITE (218)..(218): Xaa at position 218 is Val, Ala, Gly, Leu, or Ile
  SITE (220)..(220): Xaa at position 220 is Leu, Ala, Val, Gly, or Ile
  SITE (244)..(244): Xaa at position 244 is Val, Ala, Gly, Leu, or Ile
  SITE (258)..(258): Xaa at position 258 is Leu, Ala, Val, Gly, or Ile
  SITE (260)..(260): Xaa at position 260 is Val, Ala, Gly, Leu, or Ile
  SITE (262)..(262): Xaa at position 262 is Leu, Ala, Val, Gly, or Ile
  SITE (282)..(282): Xaa at position 282 is Val, Ala, Gly, Leu, or Ile
  SITE (288)..(288): Xaa at position 288 is Trp, Tyr, Phe, Met, His, Ile, Leu Val, Ala, or Gly
  SITE (303)..(303): Xaa at position 303 is Leu, Ala, Val, Gly, or Ile
  SITE (305)..(305): Xaa at position 305 is Val, Ala, Gly, Leu, or Ile
  SITE (307)..(307): Xaa at position 307 is Leu, Ala, Val, Gly, or Ile
  SITE (309)..(309): Xaa at position 309 is Ala, Gly, or Pro
  SITE (324)..(324): Xaa at position 324 is Val, Ala, Gly, Leu, or Ile
  SITE (336)..(336): Xaa at position 336 is Phe, Tyr, Met, His, Ile, Leu, Val Ala, or Gly
  SITE (338)..(338): Xaa at position 338 is Ile, Ala, Val, Leu, or Gly
  SITE (345)..(345): Xaa at position 345 is Phe, Tyr, Met, His, Ile, Leu, Val Ala, or Gly
  SITE (346)..(346): Xaa at position 346 is His, Phe, Tyr, Lys, Arg, Gly, Ser Thr, Ala, Val, Leu, Ile, Asn, Met, or Gln
  SITE (348)..(348): Xaa at position 348 is Val, Ala, Gly, Leu, or Ile
  SITE (373)..(373): Xaa at position 373 is Leu, Ala, Val, Gly, or Ile
  SITE (376)..(376): Xaa at position 376 is Leu, Ala, Val, Gly, or Ile
  SITE (378)..(378): Xaa at position 378 is Ala, Gly, or Pro
  SITE (380)..(380): Xaa at position 380 is Ala, Gly, or Pro
  SITE (381)..(381): Xaa at position 381 is Phe, Tyr, Met, His, Ile, Leu, Val Ala, or Gly
  SITE (386)..(386): Xaa at position 386 is Tyr, Phe, Met, His, Ile, Leu, Val Ala, or Gly
  SITE (388)..(388): Xaa at position 388 is Tyr, Phe, Met, His, Ile, Leu, Val Ala, or Gly
  SITE (395)..(395): Xaa at position 395 is Met, Ile, Leu, Val, Ala, or Gly
  SITE (402)..(402): Xaa at position 402 is Val, Ala, Gly, Leu, or Ile
  SITE (403)..(403): Xaa at position 403 is Val, Ala, Gly, Leu, or Ile
  SITE (404)..(404): Xaa at position 404 is Ile, Ala, Val, Leu, or Gly
  SITE (407)..(407): Xaa at position 407 is Cys, Ala, Val, Gly, Ser, or Thr
  SITE (412)..(412): Xaa at position 412 is Leu, Ala, Val, Gly, or Ile
  SITE (426)..(426): Xaa at position 426 is His, Phe, Tyr, Lys, Arg, Gly, Ser Thr, Ala, Val, Leu, Ile, Asn, Met, or Gln
  SITE (430)..(430): Xaa at position 430 is Met, Ile, Leu, Val, Ala, or Gly
  SITE (433)..(433): Xaa at position 433 is Val, Ala, Gly, Leu, or Ile
  SITE (442)..(442): Xaa at position 442 is Ala, Gly, or Pro
  SITE (444)..(444): Xaa at position 444 is Val, Ala, Gly, Leu, or Ile
  SITE (445)..(445): Xaa at position 445 is Met, Ile, Leu, Val, Ala, or Gly
  SITE (446)..(446): Xaa at position 446 is Trp, Tyr, Phe, Met, His, Ile, Leu Val, Ala, or Gly
  SITE (448)..(448): Xaa at position 448 is Val, Ala, Gly, Leu, or Ile
  SITE (449)..(449): Xaa at position 449 is Ala, Gly, or Pro
  SITE (459)..(459): Xaa at position 459 is Ala, Gly, or Pro
  SITE (463)..(463): Xaa at position 463 is Leu, Ala, Val, Gly, or Ile
  SITE (465)..(465): Xaa at position 465 is Met, Ile, Leu, Val, Ala, or Gly
  SITE (466)..(466): Xaa at position 466 is Val, Ala, Gly, Leu, or Ile
  SITE (479)..(479): Xaa at position 479 is Val, Ala, Gly, Leu, or Ile
  SITE (482)..(482): Xaa at position 482 is Val, Ala, Gly, Leu, or Ile
  SITE (493)..(493): Xaa at position 493 is Ala, Gly, or Pro
  SITE (498)..(498): Xaa at position 498 is Val, Ala, Gly, Leu, or Ile
  SITE (517)..(517): Xaa at position 517 is Ile, Ala, Val, Leu, or Gly
  SITE (521)..(521): Xaa at position 521 is Leu, Ala, Val, Gly, or Ile
  SITE (525)..(525): Xaa at position 525 is Phe, Tyr, Met, His, Ile, Leu, Val Ala, or Gly
  SITE (536)..(536): Xaa at position 536 is Ile, Ala, Val, Leu, or Gly
  SITE (537)..(537): Xaa at position 537 is Ile, Ala, Val, Leu, or Gly
  SITE (541)..(541): Xaa at position 541 is Tyr, Phe, Met, His, Ile, Leu, Val Ala, or Gly
  SITE (543)..(543): Xaa at position 543 is Ala, Gly, or Pro
  SITE (561)..(561): Xaa at position 561 is Tyr, Phe, Met, His, Ile, Leu, Val Ala, or Gly
  SITE (565)..(565): Xaa at position 565 is Leu, Ala, Val, Gly, or Ile
  SITE (566)..(566): Xaa at position 566 is Leu, Ala, Val, Gly, or Ile
  SITE (569)..(569): Xaa at position 569 is Tyr, Phe, Met, His, Ile, Leu, Val Ala, or Gly
  SITE (573)..(573): Xaa at position 573 is Leu, Ala, Val, Gly, or Ile
  SITE (581)..(581): Xaa at position 581 is Val, Ala, Gly, Leu, or Ile
  SITE (585)..(585): Xaa at position 585 is Leu, Ala, Val, Gly, or Ile
  SITE (586)..(586): Xaa at position 586 is Ile, Ala, Val, Leu, or Gly
  SITE (589)..(589): Xaa at position 589 is Phe, Tyr, Met, His, Ile, Leu, Val Ala, or Gly
  SITE (592)..(592): Xaa at position 592 is Phe, Tyr, Met, His, Ile, Leu, Val Ala, or Gly
  SITE (601)..(601): Xaa at position 601 is Val, Ala, Gly, Leu, or Ile
  SITE (608)..(608): Xaa at position 608 is Ile, Ala, Val, Leu, or Gly
  SITE (609)..(609): Xaa at position 609 is Phe, Tyr, Met, His, Ile, Leu, Val Ala, or Gly
  SITE (618)..(618): Xaa at position 618 is Ala, Gly, or Pro
  SITE (619)..(619): Xaa at position 619 is Ala, Gly, or Pro
  SITE (622)..(622): Xaa at position 622 is Leu, Ala, Val, Gly, or Ile
  SITE (626)..(626): Xaa at position 626 is Tyr, Phe, Met, His, Ile, Leu, Val Ala, or Gly
MARGSAVAWAALGPLLWGCALGLQGGMLYPQESPSRECKELDGLXSXRADFSDNRRRGFEEQWYRRPXWESGPTVDMPVPSSFNDISQDWRLRHFVGWXXXEREVILPERWTQDLRTRXXLRXGSAHSYXIXWVNGVDTLEHEGGYXPFEADISNLVQVGPLPSRLRXTXXXNNTXTPTTLPPGTIQYLTDTSKYPKGYFVQNTYFDXFNXAGXQRSXLXYTTPTTYIDDITVTTSVEQDSGLXNYQISVKGSNLFKXEXRXLDAENKVVANGTGTQGQLKXPGVSLXWPYLMHERPAYLYSXEXQXTXQTSLGPVSDFYTLPXGIRTVAVTKSQXLXNGKPFYXXGXNKHEDADIRGKGFDWPLLVKDFNLXRWXGXNXXRTSHXPXAEEVMQXCDRYGIXXXDEXPGVGXALPQFFNNVSLHHXMQVXEEXVRRDKNHPXVXXXSXXNEPASHLESXGYYXKXXIAHTKSLDPSRPXTFXSNSNYAADKGXPYVDXICLNSYYSWYHDYGHLELXQLQXATQXENWYKKYQKPXXQSEXGXETIAGFHQDPPLMFTEEXQKSXXEQXHLGXDQKRRKYXVGEXXWNXADXMTEQSPTRXLGNKKGXXTRQRQPKSXXFLXRERXWKIANETRYPHSVAKSQCLENSLFT

SEQ ID NO: 242 - protein, 780 aa, Homo sapiens
  SITE (18)..(18): Xaa at position 18 is Ile, Ala, Val, Leu, or Gly
  SITE (19)..(19): Xaa at position 19 is Ala, Gly, or Pro
  SITE (20)..(20): Xaa at position 20 is Val, Ala, Gly, Leu, or Ile
  SITE (21)..(21): Xaa at position 21 is Leu, Ala, Val, Gly, or Ile
  SITE (27)..(27): Xaa at position 27 is Ala, Gly, or Pro
  SITE (30)..(30): Xaa at position 30 is Met, Ile, Leu, Val, Ala, or Gly
  SITE (32)..(32): Xaa at position 32 is Ala, Gly, or Pro
  SITE (33)..(33): Xaa at position 33 is Ala, Gly, or Pro
  SITE (34)..(34): Xaa at position 34 is Val, Ala, Gly, Leu, or Ile
  SITE (36)..(36): Xaa at position 36 is Ala, Gly, or Pro
  SITE (37)..(37): Xaa at position 37 is Val, Ala, Gly, Leu, or Ile
  SITE (38)..(38): Xaa at position 38 is Val, Ala, Gly, Leu, or Ile
  SITE (46)..(46): Xaa at position 46 is Ala, Gly, or Pro
  SITE (48)..(48): Xaa at position 48 is Val, Ala, Gly, Leu, or Ile
  SITE (51)..(51): Xaa at position 51 is Val, Ala, Gly, Leu, or Ile
  SITE (58)..(58): Xaa at position 58 is Leu, Ala, Val, Gly, or Ile
  SITE (59)..(59): Xaa at position 59 is Val, Ala, Gly, Leu, or Ile
  SITE (73)..(73): Xaa at position 73 is Val, Ala, Gly, Leu, or Ile
  SITE (77)..(77): Xaa at position 77 is Leu, Ala, Val, Gly, or Ile
  SITE (101)..(101): Xaa at position 101 is Ala, Gly, or Pro
  SITE (102)..(102): Xaa at position 102 is Ala, Gly, or Pro
  SITE (105)..(105): Xaa at position 105 is Leu, Ala, Val, Gly, or Ile
  SITE (113)..(113): Xaa at position 113 is Leu, Ala, Val, Gly, or Ile
  SITE (114)..(114): Xaa at position 114 is Cys, Ala, Val, Gly, Ser, or Thr
  SITE (115)..(115): Xaa at position 115 is Val, Ala, Gly, Leu, or Ile
  SITE (116)..(116): Xaa at position 116 is Ile, Ala, Val, Leu, or Gly
  SITE (122)..(122): Xaa at position 122 is Leu, Ala, Val, Gly, or Ile
  SITE (128)..(128): Xaa at position 128 is Phe, Tyr, Met, His, Ile, Leu, Val Ala, or Gly
  SITE (135)..(135): Xaa at position 135 is Leu, Ala, Val, Gly, or Ile
  SITE (159)..(159): Xaa at position 159 is Val, Ala, Gly, Leu, or Ile
  SITE (161)..(161): Xaa at position 161 is Leu, Ala, Val, Gly, or Ile
  SITE (162)..(162): Xaa at position 162 is Val, Ala, Gly, Leu, or Ile
  SITE (165)..(165): Xaa at position 165 is Ile, Ala, Val, Leu, or Gly
  SITE (169)..(169): Xaa at position 169 is Phe, Tyr, Met, His, Ile, Leu, Val Ala, or Gly
  SITE (176)..(176): Xaa at position 176 is Ile, Ala, Val, Leu, or Gly
  SITE (181)..(181): Xaa at position 181 is Ala, Gly, or Pro
  SITE (185)..(185): Xaa at position 185 is Ile, Ala, Val, Leu, or Gly
  SITE (186)..(186): Xaa at position 186 is Met, Ile, Leu, Val, Ala, or Gly
  SITE (189)..(189): Xaa at position 189 is Val, Ala, Gly, Leu, or Ile
  SITE (196)..(196): Xaa at position 196 is Ala, Gly, or Pro
  SITE (203)..(203): Xaa at position 203 is Phe, Tyr, Met, His, Ile, Leu, Val Ala, or Gly
  SITE (204)..(204): Xaa at position 204 is Val, Ala, Gly, Leu, or Ile
  SITE (205)..(205): Xaa at position 205 is Leu, Ala, Val, Gly, or Ile
  SITE (207)..(207): Xaa at position 207 is Val, Ala, Gly, Leu, or Ile
  SITE (212)..(212): Xaa at position 212 is Cys, Ala, Val, Gly, Ser, or Thr
  SITE (215)..(215): Xaa at position 215 is Leu, Ala, Val, Gly, or Ile
  SITE (216)..(216): Xaa at position 216 is Ala, Gly, or Pro
  SITE (217)..(217): Xaa at position 217 is Leu, Ala, Val, Gly, or Ile
  SITE (229)..(229): Xaa at position 229 is Phe, Tyr, Met, His, Ile, Leu, Val Ala, or Gly
  SITE (230)..(230): Xaa at position 230 is Ile, Ala, Val, Leu, or Gly
  SITE (243)..(243): Xaa at position 243 is Leu, Ala, Val, Gly, or Ile
  SITE (244)..(244): Xaa at position 244 is Cys, Ala, Val, Gly, Ser, or Thr
  SITE (247)..(247): Xaa at position 247 is Leu, Ala, Val, Gly, or Ile
  SITE (260)..(260): Xaa at position 260 is Ile, Ala, Val, Leu, or Gly
  SITE (261)..(261): Xaa at position 261 is Ile, Ala, Val, Leu, or Gly
  SITE (262)..(262): Xaa at position 262 is Val, Ala, Gly, Leu, or Ile
  SITE (263)..(263): Xaa at position 263 is Ala, Gly, or Pro
  SITE (266)..(266): Xaa at position 266 is Ala, Gly, or Pro
  SITE (279)..(279): Xaa at position 279 is Ile, Ala, Val, Leu, or Gly
  SITE (283)..(283): Xaa at position 283 is Val, Ala, Gly, Leu, or Ile
  SITE (284)..(284): Xaa at position 284 is Val, Ala, Gly, Leu, or Ile
  SITE (293)..(293): Xaa at position 293 is Val, Ala, Gly, Leu, or Ile
  SITE (296)..(296): Xaa at position 296 is Leu, Ala, Val, Gly, or Ile
  SITE (307)..(307): Xaa at position 307 is Ala, Gly, or Pro
  SITE (312)..(312): Xaa at position 312 is Leu, Ala, Val, Gly, or Ile
  SITE (320)..(320): Xaa at position 320 is Ala, Gly, or Pro
  SITE (321)..(321): Xaa at position 321 is Val, Ala, Gly, Leu, or Ile
  SITE (324)..(324): Xaa at position 324 is Leu, Ala, Val, Gly, or Ile
  SITE (325)..(325): Xaa at position 325 is Leu, Ala, Val, Gly, or Ile
  SITE (333)..(333): Xaa at position 333 is Ala, Gly, or Pro
  SITE (335)..(335): Xaa at position 335 is Val, Ala, Gly, Leu, or Ile
  SITE (336)..(336): Xaa at position 336 is Val, Ala, Gly, Leu, or Ile
  SITE (348)..(348): Xaa at position 348 is Leu, Ala, Val, Gly, or Ile
  SITE (358)..(358): Xaa at position 358 is Val, Ala, Gly, Leu, or Ile
  SITE (370)..(370): Xaa at position 370 is Ala, Gly, or Pro
  SITE (389)..(389): Xaa at position 389 is Ala, Gly, or Pro
  SITE (404)..(404): Xaa at position 404 is Ala, Gly, or Pro
  SITE (405)..(405): Xaa at position 405 is Val, Ala, Gly, Leu, or Ile
  SITE (406)..(406): Xaa at position 406 is Met, Ile, Leu, Val, Ala, or Gly
  SITE (408)..(408): Xaa at position 408 is Val, Ala, Gly, Leu, or Ile
  SITE (412)..(412): Xaa at position 412 is Ala, Gly, or Pro
  SITE (413)..(413): Xaa at position 413 is Ala, Gly, or Pro
  SITE (415)..(415): Xaa at position 415 is Met, Ile, Leu, Val, Ala, or Gly
  SITE (417)..(417): Xaa at position 417 is Ala, Gly, or Pro
  SITE (418)..(418): Xaa at position 418 is Ala, Gly, or Pro
  SITE (419)..(419): Xaa at position 419 is Val, Ala, Gly, Leu, or Ile
  SITE (423)..(423): Xaa at position 423 is Val, Ala, Gly, Leu, or Ile
  SITE (433)..(433): Xaa at position 433 is Val, Ala, Gly, Leu, or Ile
  SITE (434)..(434): Xaa at position 434 is Leu, Ala, Val, Gly, or Ile
  SITE (435)..(435): Xaa at position 435 is Val, Ala, Gly, Leu, or Ile
  SITE (436)..(436): Xaa at position 436 is Val, Ala, Gly, Leu, or Ile
  SITE (440)..(440): Xaa at position 440 is Phe, Tyr, Met, His, Ile, Leu, Val Ala, or Gly
  SITE (456)..(456): Xaa at position 456 is Val, Ala, Gly, Leu, or Ile
  SITE (481)..(481): Xaa at position 481 is Ile, Ala, Val, Leu, or Gly
  SITE (494)..(494): Xaa at position 494 is Val, Ala, Gly, Leu, or Ile
  SITE (495)..(495): Xaa at position 495 is Ile, Ala, Val, Leu, or Gly
  SITE (496)..(496): Xaa at position 496 is Ile, Ala, Val, Leu, or Gly
  SITE (501)..(501): Xaa at position 501 is Ala, Gly, or Pro
  SITE (502)..(502): Xaa at position 502 is Tyr, Phe, Met, His, Ile, Leu, Val Ala, or Gly
  SITE (506)..(506): Xaa at position 506 is Leu, Ala, Val, Gly, or Ile
  SITE (519)..(519): Xaa at position 519 is Cys, Ala, Val, Gly, Ser, or Thr
  SITE (522)..(522): Xaa at position 522 is Phe, Tyr, Met, His, Ile, Leu, Val Ala, or Gly
  SITE (523)..(523): Xaa at position 523 is Val, Ala, Gly, Leu, or Ile
  SITE (524)..(524): Xaa at position 524 is Val, Ala, Gly, Leu, or Ile
  SITE (525)..(525): Xaa at position 525 is Ile, Ala, Val, Leu, or Gly
  SITE (527)..(527): Xaa at position 527 is Ala, Gly, or Pro
  SITE (533)..(533): Xaa at position 533 is Val, Ala, Gly, Leu, or Ile
  SITE (540)..(540): Xaa at position 540 is Val, Ala, Gly, Leu, or Ile
  SITE (542)..(542): Xaa at position 542 is Ala, Gly, or Pro
  SITE (545)..(545): Xaa at position 545 is Ala, Gly, or Pro
  SITE (550)..(550): Xaa at position 550 is Cys, Ala, Val, Gly, Ser, or Thr
  SITE (553)..(553): Xaa at position 553 is Cys, Ala, Val, Gly, Ser, or Thr
  SITE (560)..(560): Xaa at position 560 is Ala, Gly, or Pro
  SITE (567)..(567): Xaa at position 567 is Val, Ala, Gly, Leu, or Ile
  SITE (568)..(568): Xaa at position 568 is Phe, Tyr, Met, His, Ile, Leu, Val Ala, or Gly
  SITE (569)..(569): Xaa at position 569 is Ile, Ala, Val, Leu, or Gly
  SITE (570)..(570): Xaa at position 570 is Ile, Ala, Val, Leu, or Gly
  SITE (577)..(577): Xaa at position 577 is Cys, Ala, Val, Gly, Ser, or Thr
  SITE (580)..(580): Xaa at position 580 is Leu, Ala, Val, Gly, or Ile
  SITE (581)..(581): Xaa at position 581 is Ala, Gly, or Pro
  SITE (584)..(584): Xaa at position 584 is Ala, Gly, or Pro
  SITE (586)..(586): Xaa at position 586 is Leu, Ala, Val, Gly, or Ile
  SITE (587)..(587): Xaa at position 587 is Ala, Gly, or Pro
  SITE (595)..(595): Xaa at position 595 is Ile, Ala, Val, Leu, or Gly
  SITE (605)..(605): Xaa at position 605 is Leu, Ala, Val, Gly, or Ile
  SITE (609)..(609): Xaa at position 609 is Val, Ala, Gly, Leu, or Ile
  SITE (612)..(612): Xaa at position 612 is Leu, Ala, Val, Gly, or Ile
  SITE (616)..(616): Xaa at position 616 is Met, Ile, Leu, Val, Ala, or Gly
  SITE (624)..(624): Xaa at position 624 is Leu, Ala, Val, Gly, or Ile
  SITE (625)..(625): Xaa at position 625 is Val, Ala, Gly, Leu, or Ile
  SITE (626)..(626): Xaa at position 626 is Leu, Ala, Val, Gly, or Ile
  SITE (640)..(640): Xaa at position 640 is Ile, Ala, Val, Leu, or Gly
  SITE (644)..(644): Xaa at position 644 is Tyr, Phe, Met, His, Ile, Leu, Val Ala, or Gly
  SITE (676)..(676): Xaa at position 676 is Ala, Gly, or Pro
  SITE (679)..(679): Xaa at position 679 is Met, Ile, Leu, Val, Ala, or Gly
  SITE (683)..(683): Xaa at position 683 is Ala, Gly, or Pro
  SITE (684)..(684): Xaa at position 684 is Met, Ile, Leu, Val, Ala, or Gly
  SITE (687)..(687): Xaa at position 687 is Met, Ile, Leu, Val, Ala, or Gly
  SITE (691)..(691): Xaa at position 691 is Ile, Ala, Val, Leu, or Gly
  SITE (702)..(702): Xaa at position 702 is Ala, Gly, or Pro
  SITE (710)..(710): Xaa at position 710 is Val, Ala, Gly, Leu, or Ile
  SITE (711)..(711): Xaa at position 711 is Leu, Ala, Val, Gly, or Ile
  SITE (723)..(723): Xaa at position 723 is Val, Ala, Gly, Leu, or Ile
  SITE (726)..(726): Xaa at position 726 is Leu, Ala, Val, Gly, or Ile
  SITE (742)..(742): Xaa at position 742 is Trp, Tyr, Phe, Met, His, Ile, Leu Val, Ala, or Gly
  SITE (745)..(745): Xaa at position 745 is Leu, Ala, Val, Gly, or Ile
MTHEEHHAAKTLGIGKAXXXXTSGGDXQGXNXXXRXXXRVGIFTGXRXFFXHEGYQGXXDGGDHIKEATWESXSMMXQLGGTVIGSARCKDFREREGRLRXXYNXVKRGITNXXXXGGDGSXTGADTXRSEWSDXLSDLQKAGKITDEEATKSSYLNIXGXXGSXDNDXCGTDMTXGTDSXLHRXXEIXDAITTTXQSHQRTXXXEXMGRHXGYXXXVTSLSCGADWVXXPECPPDDDWEEHXXRRXSETRTRGSRLNIXXXXEGXIDKNGKPITSEDXKNLXXKRLGYDTRXTVXGHVQRGGTPSXFDRIXGSRMGVEXXMAXXEGTPDTPXCXXSLSGNQAVRLPXMECVQVTKDXTKAMDEKKFDEXLKLRGRSFMNNWEVYKLLXHVRPPVSKSGSHTVXXXNXGAPXXGXNXXXRSTXRIGLIQGNRXXXXHDGXEGLAKGQIEEAGWSYXGGWTGQGGSKLGTKRTLPKKSFEQXSANITKFNIQGLXXXGGFEXXTGGXELMEGRKQFDELXIPXXXXPXTVSNNXPGSDFSXGXDTXLNTIXTTXDRIKQSXAGTKRRXXXXETMGGYXGYXXTMXGXXAGADAAYXFEEPFTIRDXQANXEHXVQKXKTTVKRGXXXRNEKCNENYTTDFXFNLXSEEGKGIFDSRKNVLGHMQQGGSPTPFDRNFXTKXGAKXXNWXSGKXKESYRNGRIFXNTPDSGCXXGMRKRALVFQPXAEXKDQTDFEHRIPKEQWXLKXRPILKILAKYEIDLDTSDHAHLEHITRKRSGEAAV

SEQ ID NO: 243 - protein, 267 aa, Homo sapiens
  SITE (30)..(30): Xaa at position 30 is Ile, Ala, Val, Leu, or Gly
  SITE (45)..(45): Xaa at position 45 is Val, Ala, Gly, Leu, or Ile
  SITE (47)..(47): Xaa at position 47 is Leu, Ala, Val, Gly, or Ile
  SITE (57)..(57): Xaa at position 57 is Ala, Gly, or Pro
  SITE (59)..(59): Xaa at position 59 is Leu, Ala, Val, Gly, or Ile
  SITE (65)..(65): Xaa at position 65 is Val, Ala, Gly, Leu, or Ile
  SITE (66)..(66): Xaa at position 66 is Met, Ile, Leu, Val, Ala, or Gly
  SITE (68)..(68): Xaa at position 68 is Ala, Gly, or Pro
  SITE (69)..(69): Xaa at position 69 is Ala, Gly, or Pro
  SITE (72)..(72): Xaa at position 72 is Val, Ala, Gly, Leu, or Ile
  SITE (73)..(73): Xaa at position 73 is Ala, Gly, or Pro
  SITE (79)..(79): Xaa at position 79 is Ala, Gly, or Pro
  SITE (80)..(80): Xaa at position 80 is Val, Ala, Gly, Leu, or Ile
  SITE (82)..(82): Xaa at position 82 is Val, Ala, Gly, Leu, or Ile
  SITE (84)..(84): Xaa at position 84 is Leu, Ala, Val, Gly, or Ile
  SITE (118)..(118): Xaa at position 118 is Ile, Ala, Val, Leu, or Gly
  SITE (119)..(119): Xaa at position 119 is Val, Ala, Gly, Leu, or Ile
  SITE (120)..(120): Xaa at position 120 is Ile, Ala, Val, Leu, or Gly
  SITE (121)..(121): Xaa at position 121 is Leu, Ala, Val, Gly, or Ile
  SITE (133)..(133): Xaa at position 133 is Val, Ala, Gly, Leu, or Ile
  SITE (153)..(153): Xaa at position 153 is Ala, Gly, or Pro
  SITE (154)..(154): Xaa at position 154 is Met, Ile, Leu, Val, Ala, or Gly
  SITE (156)..(156): Xaa at position 156 is Trp, Tyr, Phe, Met, His, Ile, Leu Val, Ala, or Gly
  SITE (166)..(166): Xaa at position 166 is Ala, Gly, or Pro
  SITE (172)..(172): Xaa at position 172 is Leu, Ala, Val, Gly, or Ile
  SITE (174)..(174): Xaa at position 174 is Val, Ala, Gly, Leu, or Ile
  SITE (187)..(187): Xaa at position 187 is Cys, Ala, Val, Gly, Ser, or Thr
  SITE (206)..(206): Xaa at position 206 is Leu, Ala, Val, Gly, or Ile
  SITE (207)..(207): Xaa at position 207 is Val, Ala, Gly, Leu, or Ile
  SITE (208)..(208): Xaa at position 208 is Cys, Ala, Val, Gly, Ser, or Thr
  SITE (212)..(212): Xaa at position 212 is Ile, Ala, Val, Leu, or Gly
  SITE (215)..(215): Xaa at position 215 is Ile, Ala, Val, Leu, or Gly
  SITE (216)..(216): Xaa at position 216 is Ala, Gly, or Pro
  SITE (223)..(223): Xaa at position 223 is Cys, Ala, Val, Gly, Ser, or Thr
  SITE (231)..(231): Xaa at position 231 is Ala, Gly, or Pro
  SITE (232)..(232): Xaa at position 232 is Phe, Tyr, Met, His, Ile, Leu, Val Ala, or Gly
  SITE (233)..(233): Xaa at position 233 is Ala, Gly, or Pro
  SITE (235)..(235): Xaa at position 235 is Val, Ala, Gly, Leu, or Ile
  SITE (242)..(242): Xaa at position 242 is Ile, Ala, Val, Leu, or Gly
MTLGRRLACLFLACVLPALLLGGTALASEXVGGRRARPHAWPFMXSXQLRGGHFCGXTXIAPNFXXSXXHCXXNVNVRXXRXVXGAHNLSRREPTRQVFAVQRIFENGYDPVNLLNDXXXXQLNGSATINANXQVAQLPAQGRRLGNGVQCLXXGXGLLGRNRGIXSVLQEXNXTVVTSLCRRSNVXTLVRGRQAGVCFGDSGSPXXXNGLXHGXXSFVRGGXASGLYPDXXXPXAQFVNWXDSIIQRSEDNPCPHPRDPDPASRTH

SEQ ID NO: 244 - protein, 660 aa, Homo sapiens
  SITE (50)..(50): Xaa at position 50 is Ala, Gly, or Pro
  SITE (54)..(54): Xaa at position 54 is Leu, Ala, Val, Gly, or Ile
  SITE (60)..(60): Xaa at position 60 is Cys, Ala, Val, Gly, Ser, or Thr
  SITE (74)..(74): Xaa at position 74 is Leu, Ala, Val, Gly, or Ile
  SITE (77)..(77): Xaa at position 77 is Met, Ile, Leu, Val, Ala, or Gly
  SITE (83)..(83): Xaa at position 83 is Leu, Ala, Val, Gly, or Ile
  SITE (124)..(124): Xaa at position 124 is Ile, Ala, Val, Leu, or Gly
  SITE (135)..(135): Xaa at position 135 is Leu, Ala, Val, Gly, or Ile
  SITE (140)..(140): Xaa at position 140 is Val, Ala, Gly, Leu, or Ile
  SITE (143)..(143): Xaa at position 143 is Ala, Gly, or Pro
  SITE (144)..(144): Xaa at position 144 is Phe, Tyr, Met, His, Ile, Leu, Val Ala, or Gly
  SITE (147)..(147): Xaa at position 147 is Ala, Gly, or Pro
  SITE (148)..(148): Xaa at position 148 is Phe, Tyr, Met, His, Ile, Leu, Val Ala, or Gly
  SITE (151)..(151): Xaa at position 151 is Trp, Tyr, Phe, Met, His, Ile, Leu Val, Ala, or Gly
  SITE (157)..(157): Xaa at position 157 is Leu, Ala, Val, Gly, or Ile
  SITE (167)..(167): Xaa at position 167 is Ala, Gly, or Pro
  SITE (169)..(169): Xaa at position 169 is Ile, Ala, Val, Leu, or Gly
  SITE (171)..(171): Xaa at position 171 is Ile, Ala, Val, Leu, or Gly
  SITE (173)..(173): Xaa at position 173 is Phe, Tyr, Met, His, Ile, Leu, Val Ala, or Gly
  SITE (184)..(184): Xaa at position 184 is Phe, Tyr, Met, His, Ile, Leu, Val Ala, or Gly
  SITE (192)..(192): Xaa at position 192 is Ala, Gly, or Pro
  SITE (195)..(195): Xaa at position 195 is Phe, Tyr, Met, His, Ile, Leu, Val Ala, or Gly
  SITE (207)..(207): Xaa at position 207 is Phe, Tyr, Met, His, Ile, Leu, Val Ala, or Gly
  SITE (212)..(212): Xaa at position 212 is Leu, Ala, Val, Gly, or Ile
  SITE (213)..(213): Xaa at position 213 is Trp, Tyr, Phe, Met, His, Ile, Leu Val, Ala, or Gly
  SITE (221)..(221): Xaa at position 221 is Val, Ala, Gly, Leu, or Ile
  SITE (223)..(223): Xaa at position 223 is Val, Ala, Gly, Leu, or Ile
  SITE (225)..(225): Xaa at position 225 is Tyr, Phe, Met, His, Ile, Leu, Val Ala, or Gly
  SITE (226)..(226): Xaa at position 226 is Gly, Ala, or Pro
  SITE (228)..(228): Xaa at position 228 is Ala, Gly, or Pro
  SITE (233)..(233): Xaa at position 233 is Cys, Ala, Val, Gly, Ser, or Thr
  SITE (235)..(235): Xaa at position 235 is Phe, Tyr, Met, His, Ile, Leu, Val Ala, or Gly
  SITE (237)..(237): Xaa at position 237 is Phe, Tyr, Met, His, Ile, Leu, Val Ala, or Gly
  SITE (247)..(247): Xaa at position 247 is Cys, Ala, Val, Gly, Ser, or Thr
  SITE (258)..(258): Xaa at position 258 is Trp, Tyr, Phe, Met, His, Ile, Leu Val, Ala, or Gly
  SITE (259)..(259): Xaa at position 259 is Cys, Ala, Val, Gly, Ser, or Thr
  SITE (274)..(274): Xaa at position 274 is Cys, Ala, Val, Gly, Ser, or Thr
  SITE (286)..(286): Xaa at position 286 is Ala, Gly, or Pro
  SITE (291)..(291): Xaa at position 291 is Cys, Ala, Val, Gly, Ser, or Thr
  SITE (295)..(295): Xaa at position 295 is Phe, Tyr, Met, His, Ile, Leu, Val Ala, or Gly
  SITE (305)..(305): Xaa at position 305 is Cys, Ala, Val, Gly, Ser, or Thr
  SITE (316)..(316): Xaa at position 316 is Trp, Tyr, Phe, Met, His, Ile, Leu Val, Ala, or Gly
  SITE (317)..(317): Xaa at position 317 is Cys, Ala, Val, Gly, Ser, or Thr
  SITE (332)..(332): Xaa at position 332 is Cys, Ala, Val, Gly, Ser, or Thr
  SITE (347)..(347): Xaa at position 347 is Ala, Gly, or Pro
  SITE (349)..(349): Xaa at position 349 is Cys, Ala, Val, Gly, Ser, or Thr
  SITE (353)..(353): Xaa at position 353 is Phe, Tyr, Met, His, Ile, Leu, Val Ala, or Gly
  SITE (355)..(355): Xaa at position 355 is Phe, Tyr, Met, His, Ile, Leu, Val Ala, or Gly
  SITE (374)..(374): Xaa at position 374 is Trp, Tyr, Phe, Met, His, Ile, Leu Val, Ala, or Gly
  SITE (375)..(375): Xaa at position 375 is Cys, Ala, Val, Gly, Ser, or Thr
  SITE (376)..(376): Xaa at position 376 is Ala, Gly, or Pro
  SITE (379)..(379): Xaa at position 379 is Ala, Gly, or Pro
  SITE (381)..(381): Xaa at position 381 is Tyr, Phe, Met, His, Ile, Leu, Val Ala, or Gly
  SITE (387)..(387): Xaa at position 387 is Trp, Tyr, Phe, Met, His, Ile, Leu Val, Ala, or Gly
  SITE (390)..(390): Xaa at position 390 is Cys, Ala, Val, Gly, Ser, or Thr
  SITE (397)..(397): Xaa at position 397 is Leu, Ala, Val, Gly, or Ile
  SITE (398)..(398): Xaa at position 398 is Phe, Tyr, Met, His, Ile, Leu, Val Ala, or Gly
  SITE (400)..(400): Xaa at position 400 is Val, Ala, Gly, Leu, or Ile
  SITE (401)..(401): Xaa at position 401 is Ala, Gly, or Pro
  SITE (402)..(402): Xaa at position 402 is Ala, Gly, or Pro
  SITE (405)..(405): Xaa at position 405 is Phe, Tyr, Met, His, Ile, Leu, Val Ala, or Gly
  SITE (407)..(407): Xaa at position 407 is His, Phe, Tyr, Lys, Arg, Gly, Ser Thr, Ala, Val, Leu, Ile, Asn, Met, or Gln
  SITE (408)..(408): Xaa at position 408 is Ala, Gly, or Pro
  SITE (409)..(409): Xaa at position 409 is Met, Ile, Leu, Val, Ala, or Gly
  SITE (411)..(411): Xaa at position 411 is Leu, Ala, Val, Gly, or Ile
  SITE (419)..(419): Xaa at position 419 is Ala, Gly, or Pro
  SITE (420)..(420): Xaa at position 420 is Leu, Ala, Val, Gly, or Ile
  SITE (421)..(421): Xaa at position 421 is Met, Ile, Leu, Val, Ala, or Gly
  SITE (422)..(422): Xaa at position 422 is Ala, Gly, or Pro
  SITE (427)..(427): Xaa at position 427 is Tyr, Phe, Met, His, Ile, Leu, Val Ala, or Gly
  SITE (433)..(433): Xaa at position 433 is Leu, Ala, Val, Gly, or Ile
  SITE (441)..(441): Xaa at position 441 is Ile, Ala, Val, Leu, or Gly
  SITE (444)..(444): Xaa at position 444 is Leu, Ala, Val, Gly, or Ile
  SITE (478)..(478): Xaa at position 478 is Ile, Ala, Val, Leu, or Gly
  SITE (479)..(479): Xaa at position 479 is Ala, Gly, or Pro
  SITE (485)..(485): Xaa at position 485 is Ile, Ala, Val, Leu, or Gly
  SITE (487)..(487): Xaa at position 487 is Phe, Tyr, Met, His, Ile, Leu, Val Ala, or Gly
  SITE (488)..(488): Xaa at position 488 is Phe, Tyr, Met, His, Ile, Leu, Val Ala, or Gly
  SITE (493)..(493): Xaa at position 493 is Ile, Ala, Val, Leu, or Gly
  SITE (494)..(494): Xaa at position 494 is Trp, Tyr, Phe, Met, His, Ile, Leu Val, Ala, or Gly
  SITE (522)..(522): Xaa at position 522 is Ala, Gly, or Pro
  SITE (523)..(523): Xaa at position 523 is Val, Ala, Gly, Leu, or Ile
  SITE (524)..(524): Xaa at position 524 is Tyr, Phe, Met, His, Ile, Leu, Val Ala, or Gly
  SITE (526)..(526): Xaa at position 526 is Ala, Gly, or Pro
  SITE (533)..(533): Xaa at position 533 is Val, Ala, Gly, Leu, or Ile
  SITE (534)..(534): Xaa at position 534 is Phe, Tyr, Met, His, Ile, Leu, Val Ala, or Gly
  SITE (535)..(535): Xaa at position 535 is Phe, Tyr, Met, His, Ile, Leu, Val Ala, or Gly
  SITE (543)..(543): Xaa at position 543 is Tyr, Phe, Met, His, Ile, Leu, Val Ala, or Gly
  SITE (556)..(556): Xaa at position 556 is Leu, Ala, Val, Gly, or Ile
  SITE (568)..(568): Xaa at position 568 is Val, Ala, Gly, Leu, or Ile
  SITE (570)..(570): Xaa at position 570 is Ala, Gly, or Pro
  SITE (571)..(571): Xaa at position 571 is Ala, Gly, or Pro
  SITE (572)..(572): Xaa at position 572 is Phe, Tyr, Met, His, Ile, Leu, Val Ala, or Gly
  SITE (582)..(582): Xaa at position 582 is Ile, Ala, Val, Leu, or Gly
  SITE (583)..(583): Xaa at position 583 is Phe, Tyr, Met, His, Ile, Leu, Val Ala, or Gly
  SITE (606)..(606): Xaa at position 606 is Ile, Ala, Val, Leu, or Gly
  SITE (617)..(617): Xaa at position 617 is Leu, Ala, Val, Gly, or Ile
  SITE (619)..(619): Xaa at position 619 is Ala, Gly, or Pro
  SITE (620)..(620): Xaa at position 620 is Val, Ala, Gly, Leu, or Ile
  SITE (621)..(621): Xaa at position 621 is Val, Ala, Gly, Leu, or Ile
  SITE (631)..(631): Xaa at position 631 is Phe, Tyr, Met, His, Ile, Leu, Val Ala, or Gly
  SITE (632)..(632): Xaa at position 632 is Phe, Tyr, Met, His, Ile, Leu, Val Ala, or Gly
  SITE (640)..(640): Xaa at position 640 is Leu, Ala, Val, Gly, or Ile
  SITE (657)..(657): Xaa at position 657 is Trp, Tyr, Phe, Met, His, Ile, Leu Val, Ala, or Gly
MEALMARGALTGPLRALCLLGCLLSHAAAAPSPIIKFPGDVAPKTDKELXVQYXNTFYGXPKESCNLFVLKDTXKKXQKFFGXPQTGDLDQNTIETMRKPRCGNPDVANYNFFPRKPKWDKNQXTYRIIGYTPDXDPETXDDXXARXXQVXSDVTPXRFSRIHDGEXDXMXNXGRWEHGDGYPXDGKDGLLXHAXAPGTGVGGDSHXDDDEXXTLGEGQVXRXKXXNXDGEYXKXPXLFNGKEYNSXTDTGRSDGFLXXSTTYNFEKDGKYGFXPHEALFTMGGNXEGQPXKFPXRFQGTSYDSXTTEGRTDGYRXXGTTEDYDRDKKYGFXPETAMSTVGGNSEGXPXVFPXTXLGNKYESCTSAGRSDGKMXXXTTXNXDDDRKXGFXPDQGYSXXLXXXHEXGXXXGXEHSQDPGXXXXPIYTXTKNFRXSQDDIKGXQEXYGASPDIDLGTGPTPTLGPVTPEICKQDIVFDGXXQIRGEXFXXKDRFXXRTVTPRDKPMGPLLVATFWPELPEKIDXXXEXPQEEKAXXXAGNEYWIXSASTLERGYPKPXTSLGLPPDVQRXDXXXNWSKNKKTYXXAGDKFWRYNEVKKKMDPGFPKLXADAWNAIPDNXDXXXDLQGGGHSYXXKGAYYLKXENQSLKSVKFGSIKSDXLGC

SEQ ID NO: 245 - protein, 470 aa, Influenza A virus
  strain A/Equine/Kentucky/1/1981
  SITE (104)..(104): Xaa at position 104 is Ile, Ala, Val, Leu, or Gly
  SITE (112)..(112): Xaa at position 112 is Val, Ala, Gly, Leu, or Ile
  SITE (114)..(114): Xaa at position 114 is Val, Ala, Gly, Leu, or Ile
  SITE (119)..(119): Xaa at position 119 is Phe, Tyr, Met, His, Ile, Leu, Val Ala, or Gly
  SITE (120)..(120): Xaa at position 120 is Val, Ala, Gly, Leu, or Ile
  SITE (130)..(130): Xaa at position 130 is Phe, Tyr, Met, His, Ile, Leu, Val Ala, or Gly
  SITE (131)..(131): Xaa at position 131 is Phe, Tyr, Met, His, Ile, Leu, Val Ala, or Gly
  SITE (132)..(132): Xaa at position 132 is Leu, Ala, Val, Gly, or Ile
  SITE (156)..(156): Xaa at position 156 is Leu, Ala, Val, Gly, or Ile
  SITE (159)..(159): Xaa at position 159 is Val, Ala, Gly, Leu, or Ile
  SITE (176)..(176): Xaa at position 176 is Ala, Gly, or Pro
  SITE (177)..(177): Xaa at position 177 is Trp, Tyr, Phe, Met, His, Ile, Leu Val, Ala, or Gly
  SITE (179)..(179): Xaa at position 179 is Ala, Gly, or Pro
  SITE (181)..(181): Xaa at position 181 is Ala, Gly, or Pro
  SITE (182)..(182): Xaa at position 182 is Cys, Ala, Val, Gly, Ser, or Thr
  SITE (189)..(189): Xaa at position 189 is Met, Ile, Leu, Val, Ala, or Gly
  SITE (191)..(191): Xaa at position 191 is Val, Ala, Gly, Leu, or Ile
  SITE (193)..(193): Xaa at position 193 is Val, Ala, Gly, Leu, or Ile
  SITE (200)..(200): Xaa at position 200 is Ala, Gly, or Pro
  SITE (201)..(201): Xaa at position 201 is Val, Ala, Gly, Leu, or Ile
  SITE (202)..(202): Xaa at position 202 is Ala, Gly, or Pro
  SITE (204)..(204): Xaa at position 204 is Val, Ala, Gly, Leu, or Ile
  SITE (222)..(222): Xaa at position 222 is Leu, Ala, Val, Gly, or Ile
  SITE (231)..(231): Xaa at position 231 is Cys, Ala, Val, Gly, Ser, or Thr
  SITE (232)..(232): Xaa at position 232 is Ile, Ala, Val, Leu, or Gly
  SITE (237)..(237): Xaa at position 237 is Tyr, Phe, Met, His, Ile, Leu, Val Ala, or Gly
  SITE (239)..(239): Xaa at position 239 is Val, Ala, Gly, Leu, or Ile
  SITE (240)..(240): Xaa at position 240 is Met, Ile, Leu, Val, Ala, or Gly
  SITE (249)..(249): Xaa at position 249 is Ala, Gly, or Pro
  SITE (251)..(251): Xaa at position 251 is Tyr, Phe, Met, His, Ile, Leu, Val Ala, or Gly
  SITE (253)..(253): Xaa at position 253 is Ile, Ala, Val, Leu, or Gly
  SITE (256)..(256): Xaa at position 256 is Ala, Gly, or Pro
  SITE (261)..(261): Xaa at position 261 is Ile, Ala, Val, Leu, or Gly
  SITE (273)..(273): Xaa at position 273 is His, Phe, Tyr, Lys, Arg, Gly, Ser Thr, Ala, Val, Leu, Ile, Asn, Met, or Gln
  SITE (274)..(274): Xaa at position 274 is Ile, Ala, Val, Leu, or Gly
  SITE (277)..(277): Xaa at position 277 is Cys, Ala, Val, Gly, Ser, or Thr
  SITE (279)..(279): Xaa at position 279 is Cys, Ala, Val, Gly, Ser, or Thr
  SITE (280)..(280): Xaa at position 280 is Tyr, Phe, Met, His, Ile, Leu, Val Ala, or Gly
  SITE (286)..(286): Xaa at position 286 is Val, Ala, Gly, Leu, or Ile
  SITE (288)..(288): Xaa at position 288 is Cys, Ala, Val, Gly, Ser, or Thr
  SITE (289)..(289): Xaa at position 289 is Val, Ala, Gly, Leu, or Ile
  SITE (290)..(290): Xaa at position 290 is Cys, Ala, Val, Gly, Ser, or Thr
  SITE (302)..(302): Xaa at position 302 is Leu, Ala, Val, Gly, or Ile
  SITE (304)..(304): Xaa at position 304 is Ile, Ala, Val, Leu, or Gly
  SITE (316)..(316): Xaa at position 316 is Cys, Ala, Val, Gly, Ser, or Thr
  SITE (319)..(319): Xaa at position 319 is Ile, Ala, Val, Leu, or Gly
  SITE (349)..(349): Xaa at position 349 is Phe, Tyr, Met, His, Ile, Leu, Val Ala, or Gly
  SITE (351)..(351): Xaa at position 351 is Phe, Tyr, Met, His, Ile, Leu, Val Ala, or Gly
  SITE (357)..(357): Xaa at position 357 is Val, Ala, Gly, Leu, or Ile
  SITE (358)..(358): Xaa at position 358 is Trp, Tyr, Phe, Met, His, Ile, Leu Val, Ala, or Gly
  SITE (359)..(359): Xaa at position 359 is Ala, Gly, or Pro
  SITE (363)..(363): Xaa at position 363 is Ile, Ala, Val, Leu, or Gly
  SITE (371)..(371): Xaa at position 371 is Phe, Tyr, Met, His, Ile, Leu, Val Ala, or Gly
  SITE (373)..(373): Xaa at position 373 is Ile, Ala, Val, Leu, or Gly
  SITE (374)..(374): Xaa at position 374 is Ile, Ala, Val, Leu, or Gly
  SITE (393)..(393): Xaa at position 393 is Ile, Ala, Val, Leu, or Gly
  SITE (394)..(394): Xaa at position 394 is Ile, Ala, Val, Leu, or Gly
  SITE (397)..(397): Xaa at position 397 is Leu, Ala, Val, Gly, or Ile
  SITE (406)..(406): Xaa at position 406 is Phe, Tyr, Met, His, Ile, Leu, Val Ala, or Gly
  SITE (418)..(418): Xaa at position 418 is Leu, Ala, Val, Gly, or Ile
  SITE (421)..(421): Xaa at position 421 is Cys, Ala, Val, Gly, Ser, or Thr
  SITE (422)..(422): Xaa at position 422 is Phe, Tyr, Met, His, Ile, Leu, Val Ala, or Gly
  SITE (423)..(423): Xaa at position 423 is Trp, Tyr, Phe, Met, His, Ile, Leu Val, Ala, or Gly
  SITE (424)..(424): Xaa at position 424 is Val, Ala, Gly, Leu, or Ile
  SITE (426)..(426): Xaa at position 426 is Met, Ile, Leu, Val, Ala, or Gly
  SITE (437)..(437): Xaa at position 437 is Trp, Tyr, Phe, Met, His, Ile, Leu Val, Ala, or Gly
  SITE (443)..(443): Xaa at position 443 is Ile, Ala, Val, Leu, or Gly
  SITE (445)..(445): Xaa at position 445 is Met, Ile, Leu, Val, Ala, or Gly
MNPNQKIIAIGSASLGILILNVILHVVSIIVTVLVLNNNGTGLNCNGTIIREYNETVRVERITQWYNTNTIEYIERPSNEYYMNNTEPLCEAQGFAPFSKDNGXRIGSRGHXFXIREPXXSCSPLECRTXXXTQGSLLNDKHSNGTVKDRSPYRTXMSXKVGQSPNVYQARFESVXXSXTXXHDGKKWXTXGXTGPDNQXXXVXNYGGVPVDIINSWGRDIXRTQESSCTXXKGDCXWXXTDGPANRQXKXRXFKXKDGRXIGQTDISFNGGXXEEXSXXPNEGKXEXXXRDNWTGTNRPIXVXSPDLSYTVGYLXAGXPTDTPRGEDSQFTGSCTSPLGNKGYGVKGXGXRQGNDXXXGRTXSRTSRSGXEXXKIRNGWTQNSKDQIRKQVXXDNXNWSGYSGSXTLPVELTKKGCXVPXXXXEXIRGKPEDTTIXTSSSSXVXCGVDHKIASWSWHDGAILPFDIDKI

SEQ ID NO: 246 - protein, 750 aa, Homo sapiens
  SITE (66)..(66): Xaa at position 66 is Ala, Gly, or Pro
  SITE (69)..(69): Xaa at position 69 is Leu, Ala, Val, Gly, or Ile
  SITE (83)..(83): Xaa at position 83 is Phe, Tyr, Met, His, Ile, Leu, Val Ala, or Gly
  SITE (87)..(87): Xaa at position 87 is Ala, Gly, or Pro
  SITE (88)..(88): Xaa at position 88 is Cys, Ala, Val, Gly, Ser, or Thr
  SITE (118)..(118): Xaa at position 118 is Leu, Ala, Val, Gly, or Ile
  SITE (122)..(122): Xaa at position 122 is Leu, Ala, Val, Gly, or Ile
  SITE (132)..(132): Xaa at position 132 is Ala, Gly, or Pro
  SITE (136)..(136): Xaa at position 136 is Ala, Gly, or Pro
  SITE (138)..(138): Xaa at position 138 is Ala, Gly, or Pro
  SITE (139)..(139): Xaa at position 139 is Leu, Ala, Val, Gly, or Ile
  SITE (157)..(157): Xaa at position 157 is Leu, Ala, Val, Gly, or Ile
  SITE (158)..(158): Xaa at position 158 is Leu, Ala, Val, Gly, or Ile
  SITE (164)..(164): Xaa at position 164 is Ile, Ala, Val, Leu, or Gly
  SITE (167)..(167): Xaa at position 167 is Trp, Tyr, Phe, Met, His, Ile, Leu Val, Ala, or Gly
  SITE (169)..(169): Xaa at position 169 is Val, Ala, Gly, Leu, or Ile
  SITE (174)..(174): Xaa at position 174 is Trp, Tyr, Phe, Met, His, Ile, Leu Val, Ala, or Gly
  SITE (184)..(184): Xaa at position 184 is Ala, Gly, or Pro
  SITE (187)..(187): Xaa at position 187 is Ala, Gly, or Pro
  SITE (188)..(188): Xaa at position 188 is Ile, Ala, Val, Leu, or Gly
  SITE (189)..(189): Xaa at position 189 is Ala, Gly, or Pro
  SITE (191)..(191): Xaa at position 191 is Leu, Ala, Val, Gly, or Ile
  SITE (201)..(201): Xaa at position 201 is Ile, Ala, Val, Leu, or Gly
  SITE (203)..(203): Xaa at position 203 is Leu, Ala, Val, Gly, or Ile
  SITE (217)..(217): Xaa at position 217 is Ile, Ala, Val, Leu, or Gly
  SITE (218)..(218): Xaa at position 218 is His, Phe, Tyr, Lys, Arg, Gly, Ser Thr, Ala, Val, Leu, Ile, Asn, Met, or Gln
  SITE (219)..(219): Xaa at position 219 is Ile, Ala, Val, Leu, or Gly
  SITE (231)..(231): Xaa at position 231 is Tyr, Phe, Met, His, Ile, Leu, Val Ala, or Gly
  SITE (244)..(244): Xaa at position 244 is Ala, Gly, or Pro
  SITE (245)..(245): Xaa at position 245 is Tyr, Phe, Met, His, Ile, Leu, Val Ala, or Gly
  SITE (248)..(248): Xaa at position 248 is Phe, Tyr, Met, His, Ile, Leu, Val Ala, or Gly
  SITE (249)..(249): Xaa at position 249 is Met, Ile, Leu, Val, Ala, or Gly
  SITE (252)..(252): Xaa at position 252 is Val, Ala, Gly, Leu, or Ile
  SITE (253)..(253): Xaa at position 253 is Ala, Gly, or Pro
  SITE (256)..(256): Xaa at position 256 is Ile, Ala, Val, Leu, or Gly
  SITE (273)..(273): Xaa at position 273 is Met, Ile, Leu, Val, Ala, or Gly
  SITE (276)..(276): Xaa at position 276 is Val, Ala, Gly, Leu, or Ile
  SITE (279)..(279): Xaa at position 279 is Leu, Ala, Val, Gly, or Ile
  SITE (283)..(283): Xaa at position 283 is Ile, Ala, Val, Leu, or Gly
  SITE (284)..(284): Xaa at position 284 is Ala, Gly, or Pro
  SITE (286)..(286): Xaa at position 286 is Ala, Gly, or Pro
  SITE (303)..(303): Xaa at position 303 is Met, Ile, Leu, Val, Ala, or Gly
  SITE (305)..(305): Xaa at position 305 is Leu, Ala, Val, Gly, or Ile
  SITE (306)..(306): Xaa at position 306 is Ala, Gly, or Pro
  SITE (308)..(308): Xaa at position 308 is Ile, Ala, Val, Leu, or Gly
  SITE (314)..(314): Xaa at position 314 is Leu, Ala, Val, Gly, or Ile
  SITE (316)..(316): Xaa at position 316 is Ile, Ala, Val, Leu, or Gly
  SITE (323)..(323): Xaa at position 323 is Trp, Tyr, Phe, Met, His, Ile, Leu Val, Ala, or Gly
  SITE (326)..(326): Xaa at position 326 is Phe, Tyr, Met, His, Ile, Leu, Val Ala, or Gly
  SITE (330)..(330): Xaa at position 330 is Ile, Ala, Val, Leu, or Gly
  SITE (331)..(331): Xaa at position 331 is Met, Ile, Leu, Val, Ala, or Gly
  SITE (336)..(336): Xaa at position 336 is Ile, Ala, Val, Leu, or Gly
  SITE (344)..(344): Xaa at position 344 is Val, Ala, Gly, Leu, or Ile
  SITE (345)..(345): Xaa at position 345 is Val, Ala, Gly, Leu, or Ile
  SITE (346)..(346): Xaa at position 346 is Val, Ala, Gly, Leu, or Ile
  SITE (348)..(348): Xaa at position 348 is Ala, Gly, or Pro
  SITE (351)..(351): Xaa at position 351 is Tyr, Phe, Met, His, Ile, Leu, Val Ala, or Gly
  SITE (352)..(352): Xaa at position 352 is Leu, Ala, Val, Gly, or Ile
  SITE (355)..(355): Xaa at position 355 is Leu, Ala, Val, Gly, or Ile
  SITE (359)..(359): Xaa at position 359 is Leu, Ala, Val, Gly, or Ile
  SITE (367)..(367): Xaa at position 367 is Leu, Ala, Val, Gly, or Ile
  SITE (371)..(371): Xaa at position 371 is Met, Ile, Leu, Val, Ala, or Gly
  SITE (373)..(373): Xaa at position 373 is Trp, Tyr, Phe, Met, His, Ile, Leu Val, Ala, or Gly
  SITE (376)..(376): Xaa at position 376 is Ile, Ala, Val, Leu, or Gly
  SITE (380)..(380): Xaa at position 380 is Val, Ala, Gly, Leu, or Ile
  SITE (383)..(383): Xaa at position 383 is Leu, Ala, Val, Gly, or Ile
  SITE (387)..(387): Xaa at position 387 is Tyr, Phe, Met, His, Ile, Leu, Val Ala, or Gly
  SITE (394)..(394): Xaa at position 394 is Phe, Tyr, Met, His, Ile, Leu, Val Ala, or Gly
  SITE (411)..(411): Xaa at position 411 is Cys, Ala, Val, Gly, Ser, or Thr
  SITE (412)..(412): Xaa at position 412 is Ala, Gly, or Pro
  SITE (415)..(415): Xaa at position 415 is Val, Ala, Gly, Leu, or Ile
  SITE (419)..(419): Xaa at position 419 is Met, Ile, Leu, Val, Ala, or Gly
  SITE (422)..(422): Xaa at position 422 is Ala, Gly, or Pro
  SITE (423)..(423): Xaa at position 423 is Val, Ala, Gly, Leu, or Ile
  SITE (427)..(427): Xaa at position 427 is Tyr, Phe, Met, His, Ile, Leu, Val Ala, or Gly
  SITE (440)..(440): Xaa at position 440 is Val, Ala, Gly, Leu, or Ile
  SITE (444)..(444): Xaa at position 444 is Ile, Ala, Val, Leu, or Gly
  SITE (447)..(447): Xaa at position 447 is Ile, Ala, Val, Leu, or Gly
  SITE (450)..(450): Xaa at position 450 is Val, Ala, Gly, Leu, or Ile
  SITE (451)..(451): Xaa at position 451 is Phe, Tyr, Met, His, Ile, Leu, Val Ala, or Gly
  SITE (455)..(455): Xaa at position 455 is Leu, Ala, Val, Gly, or Ile
  SITE (463)..(463): Xaa at position 463 is Ala, Gly, or Pro
  SITE (469)..(469): Xaa at position 469 is Ala, Gly, or Pro
  SITE (473)..(473): Xaa at position 473 is Ala, Gly, or Pro
  SITE (475)..(475): Xaa at position 475 is Ala, Gly, or Pro
  SITE (493)..(493): Xaa at position 493 is Leu, Ala, Val, Gly, or Ile
  SITE (497)..(497): Xaa at position 497 is Tyr, Phe, Met, His, Ile, Leu, Val Ala, or Gly
  SITE (500)..(500): Xaa at position 500 is Leu, Ala, Val, Gly, or Ile
  SITE (539)..(539): Xaa at position 539 is Ala, Gly, or Pro
  SITE (553)..(553): Xaa at position 553 is Ile, Ala, Val, Leu, or Gly
  SITE (554)..(554): Xaa at position 554 is Val, Ala, Gly, Leu, or Ile
  SITE (555)..(555): Xaa at position 555 is Phe, Tyr, Met, His, Ile, Leu, Val Ala, or Gly
  SITE (564)..(564): Xaa at position 564 is Phe, Tyr, Met, His, Ile, Leu, Val Ala, or Gly
  SITE (565)..(565): Xaa at position 565 is Phe, Tyr, Met, His, Ile, Leu, Val Ala, or Gly
  SITE (573)..(573): Xaa at position 573 is Leu, Ala, Val, Gly, or Ile
  SITE (578)..(578): Xaa at position 578 is Ile, Ala, Val, Leu, or Gly
  SITE (580)..(580): Xaa at position 580 is Met, Ile, Leu, Val, Ala, or Gly
  SITE (582)..(582): Xaa at position 582 is Ile, Ala, Val, Leu, or Gly
  SITE (586)..(586): Xaa at position 586 is Ile, Ala, Val, Leu, or Gly
  SITE (590)..(590): Xaa at position 590 is Phe, Tyr, Met, His, Ile, Leu, Val Ala, or Gly
  SITE (615)..(615): Xaa at position 615 is Phe, Tyr, Met, His, Ile, Leu, Val Ala, or Gly
  SITE (622)..(622): Xaa at position 622 is Met, Ile, Leu, Val, Ala, or Gly
  SITE (626)..(626): Xaa at position 626 is Tyr, Phe, Met, His, Ile, Leu, Val Ala, or Gly
  SITE (634)..(634): Xaa at position 634 is Ala, Gly, or Pro
  SITE (649)..(649): Xaa at position 649 is Ile, Ala, Val, Leu, or Gly
  SITE (650)..(650): Xaa at position 650 is Ala, Gly, or Pro
  SITE (658)..(658): Xaa at position 658 is Ala, Gly, or Pro
  SITE (661)..(661): Xaa at position 661 is Ala, Gly, or Pro
  SITE (662)..(662): Xaa at position 662 is Tyr, Phe, Met, His, Ile, Leu, Val Ala, or Gly
  SITE (685)..(685): Xaa at position 685 is Leu, Ala, Val, Gly, or Ile
  SITE (686)..(686): Xaa at position 686 is Phe, Tyr, Met, His, Ile, Leu, Val Ala, or Gly
  SITE (687)..(687): Xaa at position 687 is Phe, Tyr, Met, His, Ile, Leu, Val Ala, or Gly
  SITE (688)..(688): Xaa at position 688 is Leu, Ala, Val, Gly, or Ile
  SITE (690)..(690): Xaa at position 690 is Phe, Tyr, Met, His, Ile, Leu, Val Ala, or Gly
  SITE (691)..(691): Xaa at position 691 is Ala, Gly, or Pro
  SITE (693)..(693): Xaa at position 693 is Val, Ala, Gly, Leu, or Ile
  SITE (695)..(695): Xaa at position 695 is Cys, Ala, Val, Gly, Ser, or Thr
  SITE (703)..(703): Xaa at position 703 is Ala, Gly, or Pro
  SITE (719)..(719): Xaa at position 719 is Ile, Ala, Val, Leu, or Gly
  SITE (723)..(723): Xaa at position 723 is Leu, Ala, Val, Gly, or Ile
  SITE (729)..(729): Xaa at position 729 is Phe, Tyr, Met, His, Ile, Leu, Val Ala, or Gly
  SITE (735)..(735): Xaa at position 735 is Cys, Ala, Val, Gly, Ser, or Thr
  SITE (741)..(741): Xaa at position 741 is Met, Ile, Leu, Val, Ala, or Gly
  SITE (749)..(749): Xaa at position 749 is Val, Ala, Gly, Leu, or Ile
MGKSESQMDITDINTPKPKKKQRWTPLEISLSVLVLLLTIIAVTMIALYATYDDGICKSSDCIKSXARXIQNMDATTEPCTDXFKYXXGGWLKRNVIPETSSRYGNFDILRDELEVVXKDVXQEPKTEDIVXVQKXKXXYRSCINESAIDSRGGEPXXKLLPDXYGXPXATENXEQKYGASWTXEKXXXQXNSKYGKKVLXNXFVGTDDKNSVNHVXXXDQPRLGLPSRDXYECTGIYKEACTXXVDXXISXXRLXRQEERLPIDENQLALEXNKXMEXEKEXXNXTAKPEDRNDPMLLYNKXTXXQXQNNFSXEXNGKPFSXLNXTNEXXSTVNXSITNEEDXXXYXPEXXTKXKPIXTKYSARDXQNLXSXRFXMDLXSSXSRTXKESRNAXRKALYGTTSETATWRRXXNYXNGNXENXXGRLXVEAAFAGESKHVXEDLXAQXREXXIQTXDDLTWMDXETKKRXEEKXLXIKERIGYPDDIVSNDNKXNNEXLEXNYKEDEYFENIIQNLKFSQSKQLKKLREKVDKDEWISGXAVVNAFYSSGRNQXXXPAGILQPPXXSAQQSNSXNYGGXGXVXGHEXTHGXDDNGRNFNKDGDLVDWWTQQSASNXKEQSQCXVYQXGNFSWDLXGGQHLNGINTLGENXXDNGGLGQXYRXXQNYIKKNGEEKLLPGLDLNHKQXXXXNXXQXWXGTYRPEYXVNSIKTDVHSPGNFRXIGTXQNSAEXSEAFHXRKNSYXNPEKKCRXW

SEQ ID NO: 247 - protein, 1039 aa, Homo sapiens
  SITE (34)..(34): Xaa at position 34 is Leu, Ala, Val, Gly, or Ile
  SITE (42)..(42): Xaa at position 42 is Tyr, Phe, Met, His, Ile, Leu, Val Ala, or Gly
  SITE (50)..(50): Xaa at position 50 is Phe, Tyr, Met, His, Ile, Leu, Val Ala, or Gly
  SITE (54)..(54): Xaa at position 54 is Leu, Ala, Val, Gly, or Ile
  SITE (57)..(57): Xaa at position 57 is His, Phe, Tyr, Lys, Arg, Gly, Ser Thr, Ala, Val, Leu, Ile, Asn, Met, or Gln
  SITE (66)..(66): Xaa at position 66 is Ile, Ala, Val, Leu, or Gly
  SITE (67)..(67): Xaa at position 67 is Val, Ala, Gly, Leu, or Ile
  SITE (68)..(68): Xaa at position 68 is Val, Ala, Gly, Leu, or Ile
  SITE (70)..(70): Xaa at position 70 is Ala, Gly, or Pro
  SITE (84)..(84): Xaa at position 84 is Val, Ala, Gly, Leu, or Ile
  SITE (87)..(87): Xaa at position 87 is Cys, Ala, Val, Gly, Ser, or Thr
  SITE (115)..(115): Xaa at position 115 is Leu, Ala, Val, Gly, or Ile
  SITE (124)..(124): Xaa at position 124 is Leu, Ala, Val, Gly, or Ile
  SITE (128)..(128): Xaa at position 128 is Val, Ala, Gly, Leu, or Ile
  SITE (135)..(135): Xaa at position 135 is Ile, Ala, Val, Leu, or Gly
  SITE (136)..(136): Xaa at position 136 is Val, Ala, Gly, Leu, or Ile
  SITE (137)..(137): Xaa at position 137 is Ala, Gly, or Pro
  SITE (138)..(138): Xaa at position 138 is Cys, Ala, Val, Gly, Ser, or Thr
  SITE (139)..(139): Xaa at position 139 is Ala, Gly, or Pro
  SITE (144)..(144): Xaa at position 144 is Trp, Tyr, Phe, Met, His, Ile, Leu Val, Ala, or Gly
  SITE (146)..(146): Xaa at position 146 is Val, Ala, Gly, Leu, or Ile
  SITE (153)..(153): Xaa at position 153 is Ala, Gly, or Pro
  SITE (158)..(158): Xaa at position 158 is Val, Ala, Gly, Leu, or Ile
  SITE (161)..(161): Xaa at position 161 is Cys, Ala, Val, Gly, Ser, or Thr
  SITE (163)..(163): Xaa at position 163 is Leu, Ala, Val, Gly, or Ile
  SITE (164)..(164): Xaa at position 164 is Ala, Gly, or Pro
  SITE (172)..(172): Xaa at position 172 is Ala, Gly, or Pro
  SITE (174)..(174): Xaa at position 174 is Tyr, Phe, Met, His, Ile, Leu, Val Ala, or Gly
  SITE (198)..(198): Xaa at position 198 is Cys, Ala, Val, Gly, Ser, or Thr
  SITE (200)..(200): Xaa at position 200 is Ala, Gly, or Pro
  SITE (212)..(212): Xaa at position 212 is Leu, Ala, Val, Gly, or Ile
  SITE (213)..(213): Xaa at position 213 is Val, Ala, Gly, Leu, or Ile
  SITE (214)..(214): Xaa at position 214 is Leu, Ala, Val, Gly, or Ile
  SITE (216)..(216): Xaa at position 216 is Ala, Gly, or Pro
  SITE (225)..(225): Xaa at position 225 is Leu, Ala, Val, Gly, or Ile
  SITE (226)..(226): Xaa at position 226 is Leu, Ala, Val, Gly, or Ile
  SITE (227)..(227): Xaa at position 227 is Ala, Gly, or Pro
  SITE (229)..(229): Xaa at position 229 is Ala, Gly, or Pro
  SITE (231)..(231): Xaa at position 231 is Val, Ala, Gly, Leu, or Ile
  SITE (234)..(234): Xaa at position 234 is Ile, Ala, Val, Leu, or Gly
  SITE (243)..(243): Xaa at position 243 is Leu, Ala, Val, Gly, or Ile
  SITE (247)..(247): Xaa at position 247 is Val, Ala, Gly, Leu, or Ile
  SITE (284)..(284): Xaa at position 284 is Tyr, Phe, Met, His, Ile, Leu, Val Ala, or Gly
  SITE (285)..(285): Xaa at position 285 is Val, Ala, Gly, Leu, or Ile
  SITE (286)..(286): Xaa at position 286 is Val, Ala, Gly, Leu, or Ile
  SITE (288)..(288): Xaa at position 288 is Ala, Gly, or Pro
  SITE (291)..(291): Xaa at position 291 is Trp, Tyr, Phe, Met, His, Ile, Leu Val, Ala, or Gly
  SITE (297)..(297): Xaa at position 297 is Ala, Gly, or Pro
  SITE (298)..(298): Xaa at position 298 is Val, Ala, Gly, Leu, or Ile
  SITE (300)..(300): Xaa at position 300 is Ile, Ala, Val, Leu, or Gly
  SITE (301)..(301): Xaa at position 301 is Leu, Ala, Val, Gly, or Ile
  SITE (320)..(320): Xaa at position 320 is Phe, Tyr, Met, His, Ile, Leu, Val Ala, or Gly
  SITE (325)..(325): Xaa at position 325 is Ala, Gly, or Pro
  SITE (329)..(329): Xaa at position 329 is Val, Ala, Gly, Leu, or Ile
  SITE (337)..(337): Xaa at position 337 is Leu, Ala, Val, Gly, or Ile
  SITE (338)..(338): Xaa at position 338 is Leu, Ala, Val, Gly, or Ile
  SITE (339)..(339): Xaa at position 339 is Val, Ala, Gly, Leu, or Ile
  SITE (341)..(341): Xaa at position 341 is Ala, Gly, or Pro
  SITE (354)..(354): Xaa at position 354 is Ala, Gly, or Pro
  SITE (356)..(356): Xaa at position 356 is Val, Ala, Gly, Leu, or Ile
  SITE (359)..(359): Xaa at position 359 is Val, Ala, Gly, Leu, or Ile
  SITE (360)..(360): Xaa at position 360 is Tyr, Phe, Met, His, Ile, Leu, Val Ala, or Gly
  SITE (361)..(361): Xaa at position 361 is Leu, Ala, Val, Gly, or Ile
  SITE (378)..(378): Xaa at position 378 is Leu, Ala, Val, Gly, or Ile
  SITE (387)..(387): Xaa at position 387 is Phe, Tyr, Met, His, Ile, Leu, Val Ala, or Gly
  SITE (392)..(392): Xaa at position 392 is Ala, Gly, or Pro
  SITE (394)..(394): Xaa at position 394 is Leu, Ala, Val, Gly, or Ile
  SITE (397)..(397): Xaa at position 397 is Leu, Ala, Val, Gly, or Ile
  SITE (405)..(405): Xaa at position 405 is Ile, Ala, Val, Leu, or Gly
  SITE (406)..(406): Xaa at position 406 is Ala, Gly, or Pro
  SITE (407)..(407): Xaa at position 407 is Val, Ala, Gly, Leu, or Ile
  SITE (408)..(408): Xaa at position 408 is Ala, Gly, or Pro
  SITE (420)..(420): Xaa at position 420 is Val, Ala, Gly, Leu, or Ile
  SITE (422)..(422): Xaa at position 422 is Val, Ala, Gly, Leu, or Ile
  SITE (438)..(438): Xaa at position 438 is Leu, Ala, Val, Gly, or Ile
  SITE (447)..(447): Xaa at position 447 is Ala, Gly, or Pro
  SITE (448)..(448): Xaa at position 448 is Phe, Tyr, Met, His, Ile, Leu, Val Ala, or Gly
  SITE (463)..(463): Xaa at position 463 is Tyr, Phe, Met, His, Ile, Leu, Val Ala, or Gly
  SITE (466)..(466): Xaa at position 466 is Leu, Ala, Val, Gly, or Ile
  SITE (467)..(467): Xaa at position 467 is Ile, Ala, Val, Leu, or Gly
  SITE (468)..(468): Xaa at position 468 is Val, Ala, Gly, Leu, or Ile
  SITE (470)..(470): Xaa at position 470 is Ala, Gly, or Pro
  SITE (476)..(476): Xaa at position 476 is Val, Ala, Gly, Leu, or Ile
  SITE (477)..(477): Xaa at position 477 is Ala, Gly, or Pro
  SITE (478)..(478): Xaa at position 478 is Val, Ala, Gly, Leu, or Ile
  SITE (479)..(479): Xaa at position 479 is Tyr, Phe, Met, His, Ile, Leu, Val Ala, or Gly
  SITE (481)..(481): Xaa at position 481 is Ala, Gly, or Pro
  SITE (485)..(485): Xaa at position 485 is Val, Ala, Gly, Leu, or Ile
  SITE (518)..(518): Xaa at position 518 is Ile, Ala, Val, Leu, or Gly
  SITE (522)..(522): Xaa at position 522 is Val, Ala, Gly, Leu, or Ile
  SITE (535)..(535): Xaa at position 535 is Leu, Ala, Val, Gly, or Ile
  SITE (537)..(537): Xaa at position 537 is Ala, Gly, or Pro
  SITE (539)..(539): Xaa at position 539 is Leu, Ala, Val, Gly, or Ile
  SITE (541)..(541): Xaa at position 541 is Leu, Ala, Val, Gly, or Ile
  SITE (552)..(552): Xaa at position 552 is Val, Ala, Gly, Leu, or Ile
  SITE (581)..(581): Xaa at position 581 is Ala, Gly, or Pro
  SITE (596)..(596): Xaa at position 596 is Ile, Ala, Val, Leu, or Gly
  SITE (598)..(598): Xaa at position 598 is Leu, Ala, Val, Gly, or Ile
  SITE (600)..(600): Xaa at position 600 is Leu, Ala, Val, Gly, or Ile
  SITE (633)..(633): Xaa at position 633 is Cys, Ala, Val, Gly, Ser, or Thr
  SITE (662)..(662): Xaa at position 662 is Leu, Ala, Val, Gly, or Ile
  SITE (664)..(664): Xaa at position 664 is Leu, Ala, Val, Gly, or Ile
  SITE (675)..(675): Xaa at position 675 is Ala, Gly, or Pro
  SITE (681)..(681): Xaa at position 681 is Ala, Gly, or Pro
  SITE (682)..(682): Xaa at position 682 is Val, Ala, Gly, Leu, or Ile
  SITE (688)..(688): Xaa at position 688 is Ala, Gly, or Pro
  SITE (693)..(693): Xaa at position 693 is Ala, Gly, or Pro
  SITE (715)..(715): Xaa at position 715 is Val, Ala, Gly, Leu, or Ile
  SITE (716)..(716): Xaa at position 716 is Val, Ala, Gly, Leu, or Ile
  SITE (724)..(724): Xaa at position 724 is Met, Ile, Leu, Val, Ala, or Gly
  SITE (734)..(734): Xaa at position 734 is Met, Ile, Leu, Val, Ala, or Gly
  SITE (736)..(736): Xaa at position 736 is Val, Ala, Gly, Leu, or Ile
  SITE (750)..(750): Xaa at position 750 is Phe, Tyr, Met, His, Ile, Leu, Val Ala, or Gly
  SITE (752)..(752): Xaa at position 752 is Leu, Ala, Val, Gly, or Ile
  SITE (754)..(754): Xaa at position 754 is Ile, Ala, Val, Leu, or Gly
  SITE (775)..(775): Xaa at position 775 is Ala, Gly, or Pro
  SITE (815)..(815): Xaa at position 815 is Tyr, Phe, Met, His, Ile, Leu, Val Ala, or Gly
  SITE (817)..(817): Xaa at position 817 is Leu, Ala, Val, Gly, or Ile
  SITE (825)..(825): Xaa at position 825 is Val, Ala, Gly, Leu, or Ile
  SITE (828)..(828): Xaa at position 828 is Leu, Ala, Val, Gly, or Ile
  SITE (832)..(832): Xaa at position 832 is Ile, Ala, Val, Leu, or Gly
  SITE (919)..(919): Xaa at position 919 is Val, Ala, Gly, Leu, or Ile
  SITE (921)..(921): Xaa at position 921 is Cys, Ala, Val, Gly, Ser, or Thr
  SITE (926)..(926): Xaa at position 926 is Met, Ile, Leu, Val, Ala, or Gly
  SITE (934)..(934): Xaa at position 934 is Val, Ala, Gly, Leu, or Ile
  SITE (940)..(940): Xaa at position 940 is Leu, Ala, Val, Gly, or Ile
  SITE (945)..(945): Xaa at position 945 is Leu, Ala, Val, Gly, or Ile
  SITE (955)..(955): Xaa at position 955 is Leu, Ala, Val, Gly, or Ile
  SITE (959)..(959): Xaa at position 959 is Ala, Gly, or Pro
  SITE (982)..(982): Xaa at position 982 is Val, Ala, Gly, Leu, or Ile
  SITE (986)..(986): Xaa at position 986 is Leu, Ala, Val, Gly, or Ile
MARALCPLQALWLLEWVLLLLGPCAAPPAWALNXDPVQLTFXAGPNGSQXGFSXDFXKDSHGRVAXXXGXPRTLGPSQEETGGXFLXPWRAEGGQCPSLLFDLRDETRNVGSQTXQTFKARQGXGASXVSWSDVXXXXXPWQHXNXLEKTEEXEKTPXGSXFXXQPESGRRXEXSPCRGNTLSRIYVENDFSWDKRYXEXGFSSVVTQAGEXXXGXPGGYYFLGXXXQXPXADXFSSYRPGIXLWHXSSQSLSFDSSNPEYFDGYWGYSVAVGEFDGDLNTTEXXXGXPTXSWTLGXXEXXDSYYQRLHRLRGEQMASYXGHSVXVTDXNGDGRHDXXXGXPLYMESRADRKLXEXGRXXXFLQPRGPHALGAPSLLXTGTQLYGRXGSAIXPXGDXDRDGYNDXXXXAPYGGPSGRGQXLXFLGQSEGLRSRPSQVXDSPFPTGSXXGFSLRGAVDIDDNGXPDXXXGXYGANQXXXXRXQPVXKASVQLLVQDSLNPAVKSCVLPQTKTPVSCFNXQMCXGATGHNIPQKLSXNXEXQXDRQKPRQGRRXLLLGSQQAGTTLNLDLGGKHSPICHTTMXFLRDEADFRDKLSPXVXSXNVSLPPTEAGMAPAVVLHGDTHVQEQTRIVLDXGEDDVCVPQLQLTASVTGSPLLVGADNVXEXQMDAANEGEGXYEAELXXHLPQGXHYMRXLSNVEGFERLICNQKKENETRXXLCELGNPXKKNAQIGIAXLXSVGNLEEAGESVSXQXQXRSKNSQNPNSKIVLLDVPVRXEAQVELRGNSFPASLVVAAEEGEREQNSLDSWGPKVEHTXEXHNNGPGTXNGXHLSXHLPGQSQPSDLLYILDIQPQGGLQCFPQPPVNPLKVDWGLPIPSPSPIHPAHHKRDRRQIFLPEPEQPSRLQDPVLVSCDSAPCTVXQXDLQEXARGQRAMXTVLAFXWLPSXYQRPLDQFVXQSHXWFNVSSLPYAVPPLSLPRGEAQXWTQXLRALEERAIPIWWVLVGVLGGLLLLTILVLAMWKVGFFKRNRPPLEEDDEEGE

SEQ ID NO: 248 - protein, 4548 aa, Homo sapiens
  SITE (4145)..(4145): Xaa at position 4145 is Cys, Ala, Val, Gly, Ser, or Thr
  SITE (4148)..(4148): Xaa at position 4148 is Trp, Tyr, Phe, Met, His, Ile Leu, Val, Ala, or Gly
  SITE (4173)..(4173): Xaa at position 4173 is Cys, Ala, Val, Gly, Ser, or Thr
  SITE (4184)..(4184): Xaa at position 4184 is Cys, Ala, Val, Gly, Ser, or Thr
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTXQSXSSMTPHRHQRTPENYPNDGLTMNYXRNPDADTGPWXFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 249 - protein, 350 aa, Homo sapiens
  SITE (26)..(26): Xaa at position 26 is Val, Ala, Gly, Leu, or Ile
  SITE (27)..(27): Xaa at position 27 is Val, Ala, Gly, Leu, or Ile
  SITE (28)..(28): Xaa at position 28 is Leu, Ala, Val, Gly, or Ile
  SITE (33)..(33): Xaa at position 33 is Ile, Ala, Val, Leu, or Gly
  SITE (35)..(35): Xaa at position 35 is Phe, Tyr, Met, His, Ile, Leu, Val Ala, or Gly
  SITE (48)..(48): Xaa at position 48 is Ile, Ala, Val, Leu, or Gly
  SITE (68)..(68): Xaa at position 68 is Val, Ala, Gly, Leu, or Ile
  SITE (69)..(69): Xaa at position 69 is Phe, Tyr, Met, His, Ile, Leu, Val Ala, or Gly
  SITE (71)..(71): Xaa at position 71 is Ile, Ala, Val, Leu, or Gly
  SITE (79)..(79): Xaa at position 79 is His, Phe, Tyr, Lys, Arg, Gly, Ser Thr, Ala, Val, Leu, Ile, Asn, Met, or Gln
  SITE (81)..(81): Xaa at position 81 is Phe, Tyr, Met, His, Ile, Leu, Val Ala, or Gly
  SITE (92)..(92): Xaa at position 92 is Trp, Tyr, Phe, Met, His, Ile, Leu Val, Ala, or Gly
  SITE (96)..(96): Xaa at position 96 is Ile, Ala, Val, Leu, or Gly
  SITE (100)..(100): Xaa at position 100 is Ile, Ala, Val, Leu, or Gly
  SITE (133)..(133): Xaa at position 133 is Met, Ile, Leu, Val, Ala, or Gly
  SITE (140)..(140): Xaa at position 140 is Ile, Ala, Val, Leu, or Gly
  SITE (155)..(155): Xaa at position 155 is Cys, Ala, Val, Gly, Ser, or Thr
  SITE (156)..(156): Xaa at position 156 is Phe, Tyr, Met, His, Ile, Leu, Val Ala, or Gly
  SITE (161)..(161): Xaa at position 161 is Val, Ala, Gly, Leu, or Ile
  SITE (162)..(162): Xaa at position 162 is Ile, Ala, Val, Leu, or Gly
  SITE (165)..(165): Xaa at position 165 is Leu, Ala, Val, Gly, or Ile
  SITE (181)..(181): Xaa at position 181 is Ala, Gly, or Pro
  SITE (184)..(184): Xaa at position 184 is Leu, Ala, Val, Gly, or Ile
  SITE (190)..(190): Xaa at position 190 is Leu, Ala, Val, Gly, or Ile
  SITE (200)..(200): Xaa at position 200 is Ala, Gly, or Pro
  SITE (209)..(209): Xaa at position 209 is Phe, Tyr, Met, His, Ile, Leu, Val Ala, or Gly
  SITE (215)..(215): Xaa at position 215 is Ala, Gly, or Pro
  SITE (217)..(217): Xaa at position 217 is Tyr, Phe, Met, His, Ile, Leu, Val Ala, or Gly
  SITE (219)..(219): Xaa at position 219 is Phe, Tyr, Met, His, Ile, Leu, Val Ala, or Gly
  SITE (251)..(251): Xaa at position 251 is Leu, Ala, Val, Gly, or Ile
  SITE (266)..(266): Xaa at position 266 is Phe, Tyr, Met, His, Ile, Leu, Val Ala, or Gly
  SITE (268)..(268): Xaa at position 268 is Leu, Ala, Val, Gly, or Ile
  SITE (273)..(273): Xaa at position 273 is Ala, Gly, or Pro
  SITE (275)..(275): Xaa at position 275 is Leu, Ala, Val, Gly, or Ile
  SITE (276)..(276): Xaa at position 276 is His, Phe, Tyr, Lys, Arg, Gly, Ser Thr, Ala, Val, Leu, Ile, Asn, Met, or Gln
  SITE (290)..(290): Xaa at position 290 is Ile, Ala, Val, Leu, or Gly
  SITE (292)..(292): Xaa at position 292 is Leu, Ala, Val, Gly, or Ile
  SITE (314)..(314): Xaa at position 314 is Leu, Ala, Val, Gly, or Ile
  SITE (315)..(315): Xaa at position 315 is Phe, Tyr, Met, His, Ile, Leu, Val Ala, or Gly
  SITE (317)..(317): Xaa at position 317 is Ile, Ala, Val, Leu, or Gly
  SITE (327)..(327): Xaa at position 327 is Leu, Ala, Val, Gly, or Ile
  SITE (329)..(329): Xaa at position 329 is Ala, Gly, or Pro
  SITE (338)..(338): Xaa at position 338 is Trp, Tyr, Phe, Met, His, Ile, Leu Val, Ala, or Gly
  SITE (342)..(342): Xaa at position 342 is Ile, Ala, Val, Leu, or Gly
  SITE (345)..(345): Xaa at position 345 is Ala, Gly, or Pro
MEPKRIREGYLVKKGSVFNTWKPMWXXXLEDGXEXYKKKSDNSPKGMXPLKGSTLTSPCQDFGKRMFXXKXTTTKQQDXFXQAAFLEERDAXVRDXKKAXKCIEGGQKFARKSTRRSIRLPETIDLGALYLSXKDTEKGXKELNLEKDKKIFNHXXTGNCXXDWXVSNQSVRNRQEGLMIXSSXLNEGYXQPAGDMSKSXVDGTAENPXLDNPDXFXYXPDSGFFCEENSSDDDVILKEEFRGVIIKQGCXLKQGHRRKNWKVRKXIXREDPXYXXYYDPAGAEDPLGAXHXRGCVVTSVESNSNGRKSEEENXXEXITADEVHYFXQXATPKERTEXIRAXQMXSRTGK

SEQ ID NO: 250 - protein, 1712 aa, Homo sapiens
  SITE (1492)..(1492): Xaa at position 1492 is Leu, Ala, Val, Gly, or Ile
  SITE (1518)..(1518): Xaa at position 1518 is Leu, Ala, Val, Gly, or Ile
  SITE (1519)..(1519): Xaa at position 1519 is Tyr, Phe, Met, His, Ile, Leu Val, Ala, or Gly
  SITE (1531)..(1531): Xaa at position 1531 is Leu, Ala, Val, Gly, or Ile
  SITE (1565)..(1565): Xaa at position 1565 is Tyr, Phe, Met, His, Ile, Leu Val, Ala, or Gly
  SITE (1566)..(1566): Xaa at position 1566 is Trp, Tyr, Phe, Met, His, Ile Leu, Val, Ala, or Gly
  SITE (1567)..(1567): Xaa at position 1567 is Leu, Ala, Val, Gly, or Ile
  SITE (1587)..(1587): Xaa at position 1587 is Ile, Ala, Val, Leu, or Gly
  SITE (1590)..(1590): Xaa at position 1590 is Cys, Ala, Val, Gly, Ser, or Thr
  SITE (1592)..(1592): Xaa at position 1592 is Val, Ala, Gly, Leu, or Ile
  SITE (1593)..(1593): Xaa at position 1593 is Cys, Ala, Val, Gly, Ser, or Thr
  SITE (1595)..(1595): Xaa at position 1595 is Ala, Gly, or Pro
  SITE (1625)..(1625): Xaa at position 1625 is Phe, Tyr, Met, His, Ile, Leu Val, Ala, or Gly
  SITE (1628)..(1628): Xaa at position 1628 is His, Phe, Tyr, Lys, Arg, Gly Ser, Thr, Ala, Val, Leu, Ile, Asn, Met, or Gln
  SITE (1630)..(1630): Xaa at position 1630 is Ala, Gly, or Pro
  SITE (1646)..(1646): Xaa at position 1646 is Cys, Ala, Val, Gly, Ser, or Thr
  SITE (1655)..(1655): Xaa at position 1655 is Phe, Tyr, Met, His, Ile, Leu Val, Ala, or Gly
  SITE (1656)..(1656): Xaa at position 1656 is Ile, Ala, Val, Leu, or Gly
  SITE (1658)..(1658): Xaa at position 1658 is Cys, Ala, Val, Gly, Ser, or Thr
  SITE (1665)..(1665): Xaa at position 1665 is Cys, Ala, Val, Gly, Ser, or Thr
  SITE (1705)..(1705): Xaa at position 1705 is Cys, Ala, Val, Gly, Ser, or Thr
  SITE (1707)..(1707): Xaa at position 1707 is Val, Ala, Gly, Leu, or Ile
  SITE (1708)..(1708): Xaa at position 1708 is Cys, Ala, Val, Gly, Ser, or Thr
  SITE (1709)..(1709): Xaa at position 1709 is Met, Ile, Leu, Val, Ala, or Gly
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLXVKHSQTDQEPMCPVGMNKLWSGYSLXXFEGQEKAHNQDXGLAGSCLARFSTMPFLYCNPGDVCYYASRNDKSXXXSTTAPLPMMPVAEDEIKPYXSRXSXXEXPAIAIAVHSQDVSIPHCPAGWRSLWIGYSXLMXTXAGDEGGGQSLVSPGSXLEDFRATPXXEXNGGRGTXHYYANKYSFWLTTIPEQSFQGSPSADTLKAGLIRTHISRXQXXXKNL

SEQ ID NO: 251 - protein, 1304 aa, Homo sapiens
  SITE (226)..(226): Xaa at position 226 is Cys, Ala, Val, Gly, Ser, or Thr
  SITE (246)..(246): Xaa at position 246 is Phe, Tyr, Met, His, Ile, Leu, Val Ala, or Gly
  SITE (248)..(248): Xaa at position 248 is Ala, Gly, or Pro
  SITE (279)..(279): Xaa at position 279 is Val, Ala, Gly, Leu, or Ile
  SITE (281)..(281): Xaa at position 281 is Ile, Ala, Val, Leu, or Gly
  SITE (295)..(295): Xaa at position 295 is Leu, Ala, Val, Gly, or Ile
  SITE (297)..(297): Xaa at position 297 is Val, Ala, Gly, Leu, or Ile
  SITE (301)..(301): Xaa at position 301 is Val, Ala, Gly, Leu, or Ile
  SITE (319)..(319): Xaa at position 319 is Ile, Ala, Val, Leu, or Gly
  SITE (321)..(321): Xaa at position 321 is Leu, Ala, Val, Gly, or Ile
  SITE (340)..(340): Xaa at position 340 is Phe, Tyr, Met, His, Ile, Leu, Val Ala, or Gly
  SITE (365)..(365): Xaa at position 365 is Cys, Ala, Val, Gly, Ser, or Thr
  SITE (369)..(369): Xaa at position 369 is Ile, Ala, Val, Leu, or Gly
  SITE (408)..(408): Xaa at position 408 is Ile, Ala, Val, Leu, or Gly
  SITE (410)..(410): Xaa at position 410 is Trp, Tyr, Phe, Met, His, Ile, Leu Val, Ala, or Gly
  SITE (420)..(420): Xaa at position 420 is Phe, Tyr, Met, His, Ile, Leu, Val Ala, or Gly
  SITE (422)..(422): Xaa at position 422 is Leu, Ala, Val, Gly, or Ile
  SITE (444)..(444): Xaa at position 444 is Leu, Ala, Val, Gly, or Ile
  SITE (455)..(455): Xaa at position 455 is Leu, Ala, Val, Gly, or Ile
  SITE (457)..(457): Xaa at position 457 is Leu, Ala, Val, Gly, or Ile
  SITE (459)..(459): Xaa at position 459 is Ala, Gly, or Pro
  SITE (463)..(463): Xaa at position 463 is Ala, Gly, or Pro
  SITE (499)..(499): Xaa at position 499 is Met, Ile, Leu, Val, Ala, or Gly
  SITE (501)..(501): Xaa at position 501 is Val, Ala, Gly, Leu, or Ile
  SITE (518)..(518): Xaa at position 518 is Leu, Ala, Val, Gly, or Ile
  SITE (520)..(520): Xaa at position 520 is Val, Ala, Gly, Leu, or Ile
  SITE (537)..(537): Xaa at position 537 is Phe, Tyr, Met, His, Ile, Leu, Val Ala, or Gly
  SITE (550)..(550): Xaa at position 550 is Phe, Tyr, Met, His, Ile, Leu, Val Ala, or Gly
  SITE (552)..(552): Xaa at position 552 is Ala, Gly, or Pro
  SITE (554)..(554): Xaa at position 554 is Phe, Tyr, Met, His, Ile, Leu, Val Ala, or Gly
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTXDEKYANITVDYLYNKETKLXTXKLNVNENVECGNNTCTNNEVHNLTECKNASXSXSHNSCTAPDKTLIXDXPPGXEKFQLHDCTQVEKADTTXCXKWKNIETFTCDTQNITYRXQCGNMIFDNKEIKLENLEPEHEYKXDSEXLYNNHKFTNASKIIKTDFGSPGEPQIIFCRSEAAHQGVXTXNPPQRSFHNXTXCYIKETEKDCLNLDKNLIKYDXQNLKPYTKYVXSXHXYIIXKVQRNGSAAMCHFTTKSAPPSQVWNMTVSMTSDNSXHXKCRPPRDRNGPHERYHXEXEAGNTLVRNESHKNCDXRVKDLQYSTDYTXKXYXHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 252 - protein, 1390 aa, Homo sapiens
  SITE (48)..(48): Xaa at position 48 is Ala, Gly, or Pro
  SITE (62)..(62): Xaa at position 62 is Ile, Ala, Val, Leu, or Gly
  SITE (63)..(63): Xaa at position 63 is Phe, Tyr, Met, His, Ile, Leu, Val Ala, or Gly
  SITE (64)..(64): Xaa at position 64 is Leu, Ala, Val, Gly, or Ile
  SITE (66)..(66): Xaa at position 66 is Ala, Gly, or Pro
  SITE (70)..(70): Xaa at position 70 is Ile, Ala, Val, Leu, or Gly
  SITE (71)..(71): Xaa at position 71 is Tyr, Phe, Met, His, Ile, Leu, Val Ala, or Gly
  SITE (72)..(72): Xaa at position 72 is Val, Ala, Gly, Leu, or Ile
  SITE (73)..(73): Xaa at position 73 is Leu, Ala, Val, Gly, or Ile
  SITE (78)..(78): Xaa at position 78 is Leu, Ala, Val, Gly, or Ile
  SITE (130)..(130): Xaa at position 130 is Leu, Ala, Val, Gly, or Ile
  SITE (131)..(131): Xaa at position 131 is Ile, Ala, Val, Leu, or Gly
  SITE (133)..(133): Xaa at position 133 is Cys, Ala, Val, Gly, Ser, or Thr
  SITE (141)..(141): Xaa at position 141 is Cys, Ala, Val, Gly, Ser, or Thr
  SITE (144)..(144): Xaa at position 144 is His, Phe, Tyr, Lys, Arg, Gly, Ser Thr, Ala, Val, Leu, Ile, Asn, Met, or Gln
  SITE (154)..(154): Xaa at position 154 is Ile, Ala, Val, Leu, or Gly
  SITE (161)..(161): Xaa at position 161 is Ile, Ala, Val, Leu, or Gly
  SITE (175)..(175): Xaa at position 175 is Cys, Ala, Val, Gly, Ser, or Thr
  SITE (176)..(176): Xaa at position 176 is Val, Ala, Gly, Leu, or Ile
  SITE (177)..(177): Xaa at position 177 is Val, Ala, Gly, Leu, or Ile
  SITE (193)..(193): Xaa at position 193 is Ile, Ala, Val, Leu, or Gly
  SITE (195)..(195): Xaa at position 195 is Phe, Tyr, Met, His, Ile, Leu, Val Ala, or Gly
  SITE (196)..(196): Xaa at position 196 is Phe, Tyr, Met, His, Ile, Leu, Val Ala, or Gly
  SITE (197)..(197): Xaa at position 197 is Val, Ala, Gly, Leu, or Ile
  SITE (214)..(214): Xaa at position 214 is Ile, Ala, Val, Leu, or Gly
  SITE (216)..(216): Xaa at position 216 is Val, Ala, Gly, Leu, or Ile
  SITE (219)..(219): Xaa at position 219 is Leu, Ala, Val, Gly, or Ile
  SITE (235)..(235): Xaa at position 235 is Ile, Ala, Val, Leu, or Gly
  SITE (237)..(237): Xaa at position 237 is Val, Ala, Gly, Leu, or Ile
  SITE (245)..(245): Xaa at position 245 is Tyr, Phe, Met, His, Ile, Leu, Val Ala, or Gly
  SITE (259)..(259): Xaa at position 259 is Ile, Ala, Val, Leu, or Gly
  SITE (260)..(260): Xaa at position 260 is Tyr, Phe, Met, His, Ile, Leu, Val Ala, or Gly
  SITE (261)..(261): Xaa at position 261 is Phe, Tyr, Met, His, Ile, Leu, Val Ala, or Gly
  SITE (262)..(262): Xaa at position 262 is Leu, Ala, Val, Gly, or Ile
  SITE (278)..(278): Xaa at position 278 is Ile, Ala, Val, Leu, or Gly
  SITE (279)..(279): Xaa at position 279 is Ile, Ala, Val, Leu, or Gly
  SITE (281)..(281): Xaa at position 281 is Phe, Tyr, Met, His, Ile, Leu, Val Ala, or Gly
  SITE (288)..(288): Xaa at position 288 is Leu, Ala, Val, Gly, or Ile
  SITE (291)..(291): Xaa at position 291 is Tyr, Phe, Met, His, Ile, Leu, Val Ala, or Gly
  SITE (294)..(294): Xaa at position 294 is Met, Ile, Leu, Val, Ala, or Gly
  SITE (296)..(296): Xaa at position 296 is Leu, Ala, Val, Gly, or Ile
  SITE (298)..(298): Xaa at position 298 is Cys, Ala, Val, Gly, Ser, or Thr
  SITE (299)..(299): Xaa at position 299 is Ile, Ala, Val, Leu, or Gly
  SITE (300)..(300): Xaa at position 300 is Leu, Ala, Val, Gly, or Ile
  SITE (314)..(314): Xaa at position 314 is Phe, Tyr, Met, His, Ile, Leu, Val Ala, or Gly
  SITE (316)..(316): Xaa at position 316 is Ile, Ala, Val, Leu, or Gly
  SITE (317)..(317): Xaa at position 317 is Leu, Ala, Val, Gly, or Ile
  SITE (319)..(319): Xaa at position 319 is Ala, Gly, or Pro
  SITE (329)..(329): Xaa at position 329 is Leu, Ala, Val, Gly, or Ile
  SITE (330)..(330): Xaa at position 330 is Ala, Gly, or Pro
  SITE (341)..(341): Xaa at position 341 is Ile, Ala, Val, Leu, or Gly
  SITE (343)..(343): Xaa at position 343 is Phe, Tyr, Met, His, Ile, Leu, Val Ala, or Gly
  SITE (344)..(344): Xaa at position 344 is Gly, Ala, or Pro
  SITE (345)..(345): Xaa at position 345 is Val, Ala, Gly, Leu, or Ile
  SITE (346)..(346): Xaa at position 346 is Phe, Tyr, Met, His, Ile, Leu, Val Ala, or Gly
  SITE (347)..(347): Xaa at position 347 is Ala, Gly, or Pro
  SITE (354)..(354): Xaa at position 354 is Ala, Gly, or Pro
  SITE (361)..(361): Xaa at position 361 is Ala, Gly, or Pro
  SITE (362)..(362): Xaa at position 362 is Met, Ile, Leu, Val, Ala, or Gly
  SITE (363)..(363): Xaa at position 363 is Cys, Ala, Val, Gly, Ser, or Thr
  SITE (365)..(365): Xaa at position 365 is Phe, Tyr, Met, His, Ile, Leu, Val Ala, or Gly
  SITE (367)..(367): Xaa at position 367 is Ile, Ala, Val, Leu, or Gly
  SITE (370)..(370): Xaa at position 370 is Val, Ala, Gly, Leu, or Ile
  SITE (383)..(383): Xaa at position 383 is Val, Ala, Gly, Leu, or Ile
  SITE (386)..(386): Xaa at position 386 is Leu, Ala, Val, Gly, or Ile
  SITE (388)..(388): Xaa at position 388 is His, Phe, Tyr, Lys, Arg, Gly, Ser Thr, Ala, Val, Leu, Ile, Asn, Met, or Gln
  SITE (389)..(389): Xaa at position 389 is Phe, Tyr, Met, His, Ile, Leu, Val Ala, or Gly
  SITE (424)..(424): Xaa at position 424 is Leu, Ala, Val, Gly, or Ile
  SITE (429)..(429): Xaa at position 429 is Leu, Ala, Val, Gly, or Ile
  SITE (430)..(430): Xaa at position 430 is Phe, Tyr, Met, His, Ile, Leu, Val Ala, or Gly
  SITE (439)..(439): Xaa at position 439 is Leu, Ala, Val, Gly, or Ile
  SITE (442)..(442): Xaa at position 442 is Ile, Ala, Val, Leu, or Gly
  SITE (452)..(452): Xaa at position 452 is Ile, Ala, Val, Leu, or Gly
  SITE (453)..(453): Xaa at position 453 is Ala, Gly, or Pro
  SITE (455)..(455): Xaa at position 455 is Leu, Ala, Val, Gly, or Ile
  SITE (462)..(462): Xaa at position 462 is Phe, Tyr, Met, His, Ile, Leu, Val Ala, or Gly
  SITE (465)..(465): Xaa at position 465 is Val, Ala, Gly, Leu, or Ile
  SITE (467)..(467): Xaa at position 467 is Val, Ala, Gly, Leu, or Ile
  SITE (476)..(476): Xaa at position 476 is His, Phe, Tyr, Lys, Arg, Gly, Ser Thr, Ala, Val, Leu, Ile, Asn, Met, or Gln
  SITE (477)..(477): Xaa at position 477 is Val, Ala, Gly, Leu, or Ile
  SITE (486)..(486): Xaa at position 486 is Val, Ala, Gly, Leu, or Ile
  SITE (503)..(503): Xaa at position 503 is Leu, Ala, Val, Gly, or Ile
  SITE (504)..(504): Xaa at position 504 is Val, Ala, Gly, Leu, or Ile
  SITE (505)..(505): Xaa at position 505 is Ile, Ala, Val, Leu, or Gly
  SITE (510)..(510): Xaa at position 510 is Ile, Ala, Val, Leu, or Gly
  SITE (513)..(513): Xaa at position 513 is Ile, Ala, Val, Leu, or Gly
  SITE (515)..(515): Xaa at position 515 is Leu, Ala, Val, Gly, or Ile
  SITE (518)..(518): Xaa at position 518 is Leu, Ala, Val, Gly, or Ile
  SITE (520)..(520): Xaa at position 520 is Cys, Ala, Val, Gly, Ser, or Thr
  SITE (529)..(529): Xaa at position 529 is Cys, Ala, Val, Gly, Ser, or Thr
  SITE (541)..(541): Xaa at position 541 is Cys, Ala, Val, Gly, Ser, or Thr
  SITE (561)..(561): Xaa at position 561 is Cys, Ala, Val, Gly, Ser, or Thr
  SITE (573)..(573): Xaa at position 573 is Ala, Gly, or Pro
  SITE (581)..(581): Xaa at position 581 is Leu, Ala, Val, Gly, or Ile
  SITE (583)..(583): Xaa at position 583 is Ile, Ala, Val, Leu, or Gly
  SITE (588)..(588): Xaa at position 588 is Phe, Tyr, Met, His, Ile, Leu, Val Ala, or Gly
  SITE (603)..(603): Xaa at position 603 is Val, Ala, Gly, Leu, or Ile
  SITE (622)..(622): Xaa at position 622 is Leu, Ala, Val, Gly, or Ile
  SITE (624)..(624): Xaa at position 624 is Cys, Ala, Val, Gly, Ser, or Thr
  SITE (638)..(638): Xaa at position 638 is Ile, Ala, Val, Leu, or Gly
  SITE (640)..(640): Xaa at position 640 is Ile, Ala, Val, Leu, or Gly
  SITE (652)..(652): Xaa at position 652 is Phe, Tyr, Met, His, Ile, Leu, Val Ala, or Gly
  SITE (659)..(659): Xaa at position 659 is Ile, Ala, Val, Leu, or Gly
MKAPAVLAPGILVLLFTLVQRSNGECKEALAKSEMNVNMKYQLPNFTXETPIQNVILHEHHXXXGXTNYXXXXNEEDXQKVAEYKTGPVLEHPDCFPCQDCSSKANLSGGVWKDNINMALVVDTYYDDQXXSXGSVNRGTXQRXVFPHNHTADXQSEVHCXFSPQIEEPSQCPDXXXSALGAKVLSSVKDRFXNXXXGNTINSSYFPDHPLHSXSXRRXKETKDGFMFLTDQSYXDXLPEFRDSXPIKYVHAFESNNFXXXXTVQRETLDAQTFHTRXXRXCSINSGXHSXMEXPXEXXXTEKRKKRSTKKEVXNXXQXAYVSKPGAQXXRQIGASLNDDXLXXXXXQSKPDSXEPMDRSXXXAXPXKYXNDFFNKIVNKNNXRCXQXXYGPNHEHCFNRTLLRNSSGCEARRDEYRTEFTTAXQRVDXXMGQFSEVLXTSXSTFIKGDLTXXNXGTSEGRXMQXVXSRSGPSTPXXNFLLDSHPXSPEVIVEHTLNQNGYTXXXTGKKXTKXPXNGXGXRHFQSCSQXLSAPPFVQCGWXHDKCVRSEECLSGTWTQQIXLPAIYKVFPNSXPLEGGTRXTXCGWDXGFRRNNKFDLKKTRXLLGNESCTLTLSESTMNTXKXTVGPAMNKHFNMSXIXSNGHGTTQYSTXSYVDPVXTSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 253 - protein, 1231 aa, Homo sapiens
  SITE (21)..(21): Xaa at position 21 is Cys, Ala, Val, Gly, Ser, or Thr
  SITE (48)..(48): Xaa at position 48 is Ala, Gly, or Pro
  SITE (50)..(50): Xaa at position 50 is Tyr, Phe, Met, His, Ile, Leu, Val Ala, or Gly
  SITE (62)..(62): Xaa at position 62 is Val, Ala, Gly, Leu, or Ile
  SITE (66)..(66): Xaa at position 66 is Cys, Ala, Val, Gly, Ser, or Thr
  SITE (80)..(80): Xaa at position 80 is Cys, Ala, Val, Gly, Ser, or Thr
  SITE (108)..(108): Xaa at position 108 is Val, Ala, Gly, Leu, or Ile
  SITE (110)..(110): Xaa at position 110 is Ala, Gly, or Pro
  SITE (129)..(129): Xaa at position 129 is Cys, Ala, Val, Gly, Ser, or Thr
  SITE (141)..(141): Xaa at position 141 is Cys, Ala, Val, Gly, Ser, or Thr
  SITE (144)..(144): Xaa at position 144 is Val, Ala, Gly, Leu, or Ile
  SITE (146)..(146): Xaa at position 146 is Cys, Ala, Val, Gly, Ser, or Thr
  SITE (174)..(174): Xaa at position 174 is Val, Ala, Gly, Leu, or Ile
  SITE (176)..(176): Xaa at position 176 is Phe, Tyr, Met, His, Ile, Leu, Val Ala, or Gly
  SITE (190)..(190): Xaa at position 190 is Met, Ile, Leu, Val, Ala, or Gly
  SITE (192)..(192): Xaa at position 192 is Cys, Ala, Val, Gly, Ser, or Thr
  SITE (205)..(205): Xaa at position 205 is Cys, Ala, Val, Gly, Ser, or Thr
  SITE (227)..(227): Xaa at position 227 is Tyr, Phe, Met, His, Ile, Leu, Val Ala, or Gly
  SITE (233)..(233): Xaa at position 233 is Phe, Tyr, Met, His, Ile, Leu, Val Ala, or Gly
  SITE (235)..(235): Xaa at position 235 is Tyr, Phe, Met, His, Ile, Leu, Val Ala, or Gly
  SITE (249)..(249): Xaa at position 249 is Ala, Gly, or Pro
  SITE (251)..(251): Xaa at position 251 is Cys, Ala, Val, Gly, Ser, or Thr
  SITE (325)..(325): Xaa at position 325 is Cys, Ala, Val, Gly, Ser, or Thr
  SITE (347)..(347): Xaa at position 347 is Val, Ala, Gly, Leu, or Ile
  SITE (355)..(355): Xaa at position 355 is Tyr, Phe, Met, His, Ile, Leu, Val Ala, or Gly
  SITE (372)..(372): Xaa at position 372 is Ile, Ala, Val, Leu, or Gly
  SITE (389)..(389): Xaa at position 389 is Cys, Ala, Val, Gly, Ser, or Thr
  SITE (391)..(391): Xaa at position 391 is Phe, Tyr, Met, His, Ile, Leu, Val Ala, or Gly
  SITE (394)..(394): Xaa at position 394 is Leu, Ala, Val, Gly, or Ile
  SITE (414)..(414): Xaa at position 414 is Val, Ala, Gly, Leu, or Ile
  SITE (422)..(422): Xaa at position 422 is Leu, Ala, Val, Gly, or Ile
  SITE (429)..(429): Xaa at position 429 is Val, Ala, Gly, Leu, or Ile
  SITE (431)..(431): Xaa at position 431 is Cys, Ala, Val, Gly, Ser, or Thr
  SITE (467)..(467): Xaa at position 467 is Tyr, Phe, Met, His, Ile, Leu, Val Ala, or Gly
  SITE (473)..(473): Xaa at position 473 is Ala, Gly, or Pro
  SITE (494)..(494): Xaa at position 494 is Cys, Ala, Val, Gly, Ser, or Thr
  SITE (505)..(505): Xaa at position 505 is Cys, Ala, Val, Gly, Ser, or Thr
  SITE (532)..(532): Xaa at position 532 is Leu, Ala, Val, Gly, or Ile
  SITE (551)..(551): Xaa at position 551 is Ile, Ala, Val, Leu, or Gly
  SITE (553)..(553): Xaa at position 553 is Cys, Ala, Val, Gly, Ser, or Thr
  SITE (569)..(569): Xaa at position 569 is Cys, Ala, Val, Gly, Ser, or Thr
  SITE (587)..(587): Xaa at position 587 is Tyr, Phe, Met, His, Ile, Leu, Val Ala, or Gly
  SITE (593)..(593): Xaa at position 593 is Leu, Ala, Val, Gly, or Ile
  SITE (595)..(595): Xaa at position 595 is Phe, Tyr, Met, His, Ile, Leu, Val Ala, or Gly
  SITE (609)..(609): Xaa at position 609 is Val, Ala, Gly, Leu, or Ile
  SITE (611)..(611): Xaa at position 611 is Cys, Ala, Val, Gly, Ser, or Thr
  SITE (636)..(636): Xaa at position 636 is Leu, Ala, Val, Gly, or Ile
  SITE (655)..(655): Xaa at position 655 is Val, Ala, Gly, Leu, or Ile
  SITE (657)..(657): Xaa at position 657 is Tyr, Phe, Met, His, Ile, Leu, Val Ala, or Gly
  SITE (671)..(671): Xaa at position 671 is Ile, Ala, Val, Leu, or Gly
  SITE (673)..(673): Xaa at position 673 is Cys, Ala, Val, Gly, Ser, or Thr
  SITE (684)..(684): Xaa at position 684 is Cys, Ala, Val, Gly, Ser, or Thr
  SITE (709)..(709): Xaa at position 709 is Tyr, Phe, Met, His, Ile, Leu, Val Ala, or Gly
  SITE (715)..(715): Xaa at position 715 is Val, Ala, Gly, Leu, or Ile
  SITE (717)..(717): Xaa at position 717 is Phe, Tyr, Met, His, Ile, Leu, Val Ala, or Gly
  SITE (731)..(731): Xaa at position 731 is Ile, Ala, Val, Leu, or Gly
  SITE (733)..(733): Xaa at position 733 is Cys, Ala, Val, Gly, Ser, or Thr
  SITE (744)..(744): Xaa at position 744 is Cys, Ala, Val, Gly, Ser, or Thr
  SITE (753)..(753): Xaa at position 753 is Cys, Ala, Val, Gly, Ser, or Thr
  SITE (761)..(761): Xaa at position 761 is Leu, Ala, Val, Gly, or Ile
  SITE (771)..(771): Xaa at position 771 is Phe, Tyr, Met, His, Ile, Leu, Val Ala, or Gly
  SITE (777)..(777): Xaa at position 777 is Ile, Ala, Val, Leu, or Gly
  SITE (792)..(792): Xaa at position 792 is Cys, Ala, Val, Gly, Ser, or Thr
  SITE (870)..(870): Xaa at position 870 is Cys, Ala, Val, Gly, Ser, or Thr
  SITE (876)..(876): Xaa at position 876 is Ile, Ala, Val, Leu, or Gly
  SITE (915)..(915): Xaa at position 915 is Cys, Ala, Val, Gly, Ser, or Thr
  SITE (926)..(926): Xaa at position 926 is Cys, Ala, Val, Gly, Ser, or Thr
  SITE (942)..(942): Xaa at position 942 is Val, Ala, Gly, Leu, or Ile
  SITE (955)..(955): Xaa at position 955 is Val, Ala, Gly, Leu, or Ile
  SITE (971)..(971): Xaa at position 971 is Ala, Gly, or Pro
  SITE (973)..(973): Xaa at position 973 is Cys, Ala, Val, Gly, Ser, or Thr
  SITE (984)..(984): Xaa at position 984 is Cys, Ala, Val, Gly, Ser, or Thr
  SITE (1048)..(1048): Xaa at position 1048 is Cys, Ala, Val, Gly, Ser, or Thr
  SITE (1067)..(1067): Xaa at position 1067 is Tyr, Phe, Met, His, Ile, Leu Val, Ala, or Gly
  SITE (1073)..(1073): Xaa at position 1073 is Val, Ala, Gly, Leu, or Ile
  SITE (1089)..(1089): Xaa at position 1089 is Val, Ala, Gly, Leu, or Ile
  SITE (1109)..(1109): Xaa at position 1109 is Cys, Ala, Val, Gly, Ser, or Thr
  SITE (1120)..(1120): Xaa at position 1120 is Ile, Ala, Val, Leu, or Gly
  SITE (1134)..(1134): Xaa at position 1134 is Val, Ala, Gly, Leu, or Ile
  SITE (1136)..(1136): Xaa at position 1136 is Tyr, Phe, Met, His, Ile, Leu Val, Ala, or Gly
  SITE (1138)..(1138): Xaa at position 1138 is Cys, Ala, Val, Gly, Ser, or Thr
  SITE (1144)..(1144): Xaa at position 1144 is Leu, Ala, Val, Gly, or Ile
  SITE (1150)..(1150): Xaa at position 1150 is Ile, Ala, Val, Leu, or Gly
  SITE (1152)..(1152): Xaa at position 1152 is Cys, Ala, Val, Gly, Ser, or Thr
  SITE (1167)..(1167): Xaa at position 1167 is Cys, Ala, Val, Gly, Ser, or Thr
  SITE (1169)..(1169): Xaa at position 1169 is Ile, Ala, Val, Leu, or Gly
  SITE (1174)..(1174): Xaa at position 1174 is Met, Ile, Leu, Val, Ala, or Gly
  SITE (1179)..(1179): Xaa at position 1179 is Ile, Ala, Val, Leu, or Gly
  SITE (1181)..(1181): Xaa at position 1181 is Leu, Ala, Val, Gly, or Ile
  SITE (1189)..(1189): Xaa at position 1189 is Leu, Ala, Val, Gly, or Ile
  SITE (1197)..(1197): Xaa at position 1197 is Val, Ala, Gly, Leu, or Ile
  SITE (1199)..(1199): Xaa at position 1199 is Phe, Tyr, Met, His, Ile, Leu Val, Ala, or Gly
  SITE (1218)..(1218): Xaa at position 1218 is Cys, Ala, Val, Gly, Ser, or Thr
  SITE (1223)..(1223): Xaa at position 1223 is Leu, Ala, Val, Gly, or Ile
  SITE (1228)..(1228): Xaa at position 1228 is Cys, Ala, Val, Gly, Ser, or Thr
MRLLAKIICLMLWAICVAEDXNELPPRRNTEILTGSWSDQTYPEGTQXIXKCRPGYRSLGNXIMVXRKGEWVALNPLRKXQKRPCGHPGDTPFGTFTLTGGNVFEYGXKXVYTCNEGYQLLGEINYREXDTDGWTNDIPIXEVXKXLPVTAPENGKIVSSAMEPDREYHFGQAXRXVCNSGYKIEGDEEXHXSDDGFWSKEKPKXVEISCKSPDVINGSPISQKIIXKENERXQXKCNMGYEYSERGDXVXTESGWRPLPSCEEKSCDNPYIPNGDYSPLRIKHRTGDEITYQCRNGFYPATRGNTAKCTSTGWIPAPRCTLKPXDYPDIKHGGLYHENMRRPYFPXAVGKYYSXYCDEHFETPSGSYWDHXHCTQDGWSPAVPCLRKXYXPYXENGYNQNYGRKFVQGKSIDXACHPGYAXPKAQTTXTXMENGWSPTPRCIRVKTCSKSSIDIENGFISESQYTXALKEKXKYQCKLGYVTADGETSGSITXGKDGWSAQPTXIKSCDIPVFMNARTKNDFTWFKLNDTXDYECHDGYESNTGSTTGSXVXGYNGWSDLPICYEREXELPKIDVHLVPDRKKDQXKVGEVXKXSCKPGFTIVGPNSXQXYHFGLSPDLPICKEQVQSCGPPPEXLNGNVKEKTKEEYGHSEVXEXYCNPRFLMKGPNKXQXVDGEWTTLPVXIVEESTCGDIPELEHGWAQLSSPPXYYGDSXEXNCSESFTMIGHRSXTXIHGVWTQLPQXVAIDKLKKXKSSNLIIXEEHLKNKKEXDHNSNXRYRCRGKEGWIHTVXINGRWDPEVNCSMAQIQLCPPPPQIPNSHNMTTTLNYRDGEKVSVLCQENYLIQEGEEITCKDGRWQSIPLCVEKIPXSQPPQXEHGTINSSRSSQESYAHGTKLSYTCEGGFRISEENETTXYMGKWSSPPQXEGLPCKSPPEISHGVXAHMSDSYQYGEEXTYKCFEGFGIDGPAIXKXLGEKWSHPPSXIKTDCLSLPSFENAIPMGEKKDVYKAGEQVTYTCATYYKMDGASNVTCINSRWTGRPTCRDTSXVNPPTVQNAYIVSRQMSKXPSGERXRYQCRSPYEMFGDEEXMCLNGNWTEPPQCKDSTGKXGPPPPIDNGDXTSFPLSVYAPASSXEXQXQNLYQXEGNKRXTXRNGQWSEPPKCLHPXVXSREIXENYNXAXRWTAKQKXYSRTGESXEXVCKRGYRLSSRSHTLRTTXWDGKXEYPTXAKR

SEQ ID NO: 254 - protein, 2227 aa, Human hepatitis A virus
  genotype IB (isolate HM175) (HHAV) (Human hepatitis A virus (isolate Human/Australia/HM175/1976))
  SITE (91)..(91): Xaa at position 91 is Trp, Tyr, Phe, Met, His, Ile, Leu Val, Ala, or Gly
  SITE (106)..(106): Xaa at position 106 is Val, Ala, Gly, Leu, or Ile
  SITE (107)..(107): Xaa at position 107 is Val, Ala, Gly, Leu, or Ile
  SITE (110)..(110): Xaa at position 110 is Leu, Ala, Val, Gly, or Ile
  SITE (117)..(117): Xaa at position 117 is Val, Ala, Gly, Leu, or Ile
  SITE (121)..(121): Xaa at position 121 is Leu, Ala, Val, Gly, or Ile
  SITE (127)..(127): Xaa at position 127 is Ala, Gly, or Pro
  SITE (129)..(129): Xaa at position 129 is Phe, Tyr, Met, His, Ile, Leu, Val Ala, or Gly
  SITE (131)..(131): Xaa at position 131 is Ile, Ala, Val, Leu, or Gly
  SITE (135)..(135): Xaa at position 135 is Val, Ala, Gly, Leu, or Ile
  SITE (147)..(147): Xaa at position 147 is Leu, Ala, Val, Gly, or Ile
  SITE (148)..(148): Xaa at position 148 is Ile, Ala, Val, Leu, or Gly
  SITE (150)..(150): Xaa at position 150 is Ala, Gly, or Pro
  SITE (151)..(151): Xaa at position 151 is Met, Ile, Leu, Val, Ala, or Gly
  SITE (152)..(152): Xaa at position 152 is Val, Ala, Gly, Leu, or Ile
  SITE (202)..(202): Xaa at position 202 is Val, Ala, Gly, Leu, or Ile
  SITE (207)..(207): Xaa at position 207 is Ile, Ala, Val, Leu, or Gly
  SITE (209)..(209): Xaa at position 209 is Val, Ala, Gly, Leu, or Ile
  SITE (213)..(213): Xaa at position 213 is Leu, Ala, Val, Gly, or Ile
  SITE (227)..(227): Xaa at position 227 is Val, Ala, Gly, Leu, or Ile
  SITE (229)..(229): Xaa at position 229 is Ala, Gly, or Pro
  SITE (231)..(231): Xaa at position 231 is Phe, Tyr, Met, His, Ile, Leu, Val Ala, or Gly
  SITE (306)..(306): Xaa at position 306 is Ala, Gly, or Pro
  SITE (326)..(326): Xaa at position 326 is Val, Ala, Gly, Leu, or Ile
  SITE (329)..(329): Xaa at position 329 is Tyr, Phe, Met, His, Ile, Leu, Val Ala, or Gly
  SITE (331)..(331): Xaa at position 331 is Phe, Tyr, Met, His, Ile, Leu, Val Ala, or Gly
  SITE (346)..(346): Xaa at position 346 is Leu, Ala, Val, Gly, or Ile
  SITE (347)..(347): Xaa at position 347 is Ala, Gly, or Pro
  SITE (350)..(350): Xaa at position 350 is Cys, Ala, Val, Gly, Ser, or Thr
  SITE (356)..(356): Xaa at position 356 is Trp, Tyr, Phe, Met, His, Ile, Leu Val, Ala, or Gly
  SITE (360)..(360): Xaa at position 360 is Leu, Ala, Val, Gly, or Ile
  SITE (376)..(376): Xaa at position 376 is Leu, Ala, Val, Gly, or Ile
  SITE (379)..(379): Xaa at position 379 is Cys, Ala, Val, Gly, Ser, or Thr
  SITE (418)..(418): Xaa at position 418 is Val, Ala, Gly, Leu, or Ile
  SITE (443)..(443): Xaa at position 443 is Ala, Gly, or Pro
  SITE (444)..(444): Xaa at position 444 is Ile, Ala, Val, Leu, or Gly
  SITE (448)..(448): Xaa at position 448 is Ile, Ala, Val, Leu, or Gly
  SITE (450)..(450): Xaa at position 450 is Tyr, Phe, Met, His, Ile, Leu, Val Ala, or Gly
  SITE (451)..(451): Xaa at position 451 is Cys, Ala, Val, Gly, Ser, or Thr
  SITE (465)..(465): Xaa at position 465 is Val, Ala, Gly, Leu, or Ile
  SITE (471)..(471): Xaa at position 471 is Leu, Ala, Val, Gly, or Ile
  SITE (600)..(600): Xaa at position 600 is Phe, Tyr, Met, His, Ile, Leu, Val Ala, or Gly
  SITE (628)..(628): Xaa at position 628 is Tyr, Phe, Met, His, Ile, Leu, Val Ala, or Gly
  SITE (644)..(644): Xaa at position 644 is Val, Ala, Gly, Leu, or Ile
  SITE (702)..(702): Xaa at position 702 is Val, Ala, Gly, Leu, or Ile
  SITE (722)..(722): Xaa at position 722 is Ile, Ala, Val, Leu, or Gly
  SITE (727)..(727): Xaa at position 727 is Tyr, Phe, Met, His, Ile, Leu, Val Ala, or Gly
  SITE (734)..(734): Xaa at position 734 is Leu, Ala, Val, Gly, or Ile
  SITE (738)..(738): Xaa at position 738 is Cys, Ala, Val, Gly, Ser, or Thr
  SITE (841)..(841): Xaa at position 841 is Leu, Ala, Val, Gly, or Ile
  SITE (869)..(869): Xaa at position 869 is Phe, Tyr, Met, His, Ile, Leu, Val Ala, or Gly
  SITE (880)..(880): Xaa at position 880 is Leu, Ala, Val, Gly, or Ile
  SITE (907)..(907): Xaa at position 907 is Ile, Ala, Val, Leu, or Gly
  SITE (911)..(911): Xaa at position 911 is Ile, Ala, Val, Leu, or Gly
  SITE (914)..(914): Xaa at position 914 is Phe, Tyr, Met, His, Ile, Leu, Val Ala, or Gly
  SITE (953)..(953): Xaa at position 953 is Leu, Ala, Val, Gly, or Ile
  SITE (954)..(954): Xaa at position 954 is Leu, Ala, Val, Gly, or Ile
  SITE (962)..(962): Xaa at position 962 is Ile, Ala, Val, Leu, or Gly
  SITE (1528)..(1528): Xaa at position 1528 is Val, Ala, Gly, Leu, or Ile
  SITE (1533)..(1533): Xaa at position 1533 is Val, Ala, Gly, Leu, or Ile
  SITE (1535)..(1535): Xaa at position 1535 is Phe, Tyr, Met, His, Ile, Leu Val, Ala, or Gly
  SITE (1537)..(1537): Xaa at position 1537 is Val, Ala, Gly, Leu, or Ile
  SITE (1548)..(1548): Xaa at position 1548 is Met, Ile, Leu, Val, Ala, or Gly
  SITE (1550)..(1550): Xaa at position 1550 is Ala, Gly, or Pro
  SITE (1551)..(1551): Xaa at position 1551 is Leu, Ala, Val, Gly, or Ile
  SITE (1553)..(1553): Xaa at position 1553 is Val, Ala, Gly, Leu, or Ile
  SITE (1558)..(1558): Xaa at position 1558 is Leu, Ala, Val, Gly, or Ile
  SITE (1559)..(1559): Xaa at position 1559 is Leu, Ala, Val, Gly, or Ile
  SITE (1560)..(1560): Xaa at position 1560 is Val, Ala, Gly, Leu, or Ile
  SITE (1576)..(1576): Xaa at position 1576 is Phe, Tyr, Met, His, Ile, Leu Val, Ala, or Gly
  SITE (1578)..(1578): Xaa at position 1578 is Phe, Tyr, Met, His, Ile, Leu Val, Ala, or Gly
  SITE (1604)..(1604): Xaa at position 1604 is Val, Ala, Gly, Leu, or Ile
  SITE (1605)..(1605): Xaa at position 1605 is Val, Ala, Gly, Leu, or Ile
  SITE (1606)..(1606): Xaa at position 1606 is Leu, Ala, Val, Gly, or Ile
  SITE (1607)..(1607): Xaa at position 1607 is Met, Ile, Leu, Val, Ala, or Gly
  SITE (1609)..(1609): Xaa at position 1609 is Val, Ala, Gly, Leu, or Ile
  SITE (1618)..(1618): Xaa at position 1618 is Ile, Ala, Val, Leu, or Gly
  SITE (1623)..(1623): Xaa at position 1623 is Ile, Ala, Val, Leu, or Gly
  SITE (1631)..(1631): Xaa at position 1631 is Ala, Gly, or Pro
  SITE (1636)..(1636): Xaa at position 1636 is Ala, Gly, or Pro
  SITE (1638)..(1638): Xaa at position 1638 is Leu, Ala, Val, Gly, or Ile
  SITE (1639)..(1639): Xaa at position 1639 is Val, Ala, Gly, Leu, or Ile
  SITE (1654)..(1654): Xaa at position 1654 is Leu, Ala, Val, Gly, or Ile
  SITE (1676)..(1676): Xaa at position 1676 is Val, Ala, Gly, Leu, or Ile
  SITE (1679)..(1679): Xaa at position 1679 is Ala, Gly, or Pro
  SITE (1680)..(1680): Xaa at position 1680 is Trp, Tyr, Phe, Met, His, Ile Leu, Val, Ala, or Gly
  SITE (1690)..(1690): Xaa at position 1690 is Met, Ile, Leu, Val, Ala, or Gly
  SITE (1694)..(1694): Xaa at position 1694 is Ala, Gly, or Pro
  SITE (1695)..(1695): Xaa at position 1695 is Leu, Ala, Val, Gly, or Ile
  SITE (1696)..(1696): Xaa at position 1696 is Val, Ala, Gly, Leu, or Ile
  SITE (1706)..(1706): Xaa at position 1706 is Ile, Ala, Val, Leu, or Gly
  SITE (1707)..(1707): Xaa at position 1707 is Leu, Ala, Val, Gly, or Ile
  SITE (1709)..(1709): Xaa at position 1709 is Ile, Ala, Val, Leu, or Gly
  SITE (1712)..(1712): Xaa at position 1712 is Ala, Gly, or Pro
  SITE (1718)..(1718): Xaa at position 1718 is Leu, Ala, Val, Gly, or Ile
  SITE (1719)..(1719): Xaa at position 1719 is Val, Ala, Gly, Leu, or Ile
  SITE (1720)..(1720): Xaa at position 1720 is Ala, Gly, or Pro
  SITE (1722)..(1722): Xaa at position 1722 is Leu, Ala, Val, Gly, or Ile
  SITE (1723)..(1723): Xaa at position 1723 is Val, Ala, Gly, Leu, or Ile
MNMSRQGIFQTVGSGLDHILSLADIEEEQMIQSVDRTAVTGASYFTSVDQSSVHTAEVGSHQVEPLRTSVDKPGSKKTQGEKFFLIHSADXLTTHALFHEVAKLDXXKLXYNEQFAXQGLXRYHTYXRXGXEIQXQINPTPFQQGGXXCXXXPGDQSYGSIASLTVYPHGLLNCNINNVVRIKVPFIYTRGAYHFKDPQYPXWELTXRXWSEXNIGTGTSAYTSLNXLXRXTDLELHGLTPLSTQMMRNEFRVSTTENVVNLSNYEDARAKMSFALDQEDWKSDPSQGGGIKITHFTTWTSIPTLXAQFPFNASDSVGQQIKVIPXDPXFXQMTNTNPDQKCITAXXSIXQMFCFXRGDXVFDFQVFPTKYHSGRXLFXFVPGNELIDVSGITLKQATTAPCAVMDITGVQSTLRFRXPWISDTPYRVNRYTKSAHQKGEYTXXGKLXVXXYNRLTSPSNVASHXRVNVYXSAINLECFAPLYHAMDVTTQVGDDSGGFSTTVSTEQNVPDPQVGITTMKDLKGKANRGKMDVSGVQAPVGAITTIEDPVLAKKVPETFPELKPGESRHTSDHMSIYKFMGRSHFLCTFTFNSNNKEYTXPITLSSTSNPPHGLPSTLRWFFNLFQLXRGPLDLTIIITGATDXDGMAWFTPVGLAVDTPWVEKESALSIDYKTALGAVRFNTRRTGNIQIRLPWYSYLYAXSGALDGLGDKTDSTFGLVSXQIANXNHSDEYXSFSXYLSVTEQSEFYFPRAPLNSNAMLSTESMMSRIAAGDLESSVDDPRSEEDKRFESHIECRKPYKELRLEVGKQRLKYAQEELSNEVLPPPRKMKGLFSQAKISXFYTEEHEIMKFSWRGVTADTRALRRFGXSLAAGRSVWTXEMDAGVLTGRLIRLNDEKWTEMKDDKXVSLXEKXTSNKYWSKVNFPHGMLDLEEIAANSKDFPNMSETDLCFXXHWLNPKKXNLADRMLGLSGVQEIKEQGVGLIAECRTFLDSIAGTLKSMMFGFHHSVTVEIINTVLCFVKSGILLYVIQQLNQDEHSHIIGLLRVMNYADIGCSVISCGKVFSKMLETVFNWQMDSRMMELRTQSFSNWLRDICSGITIFKNFKDAIYWLYTKLKDFYEVNYGKKKDILNILKDNQQKIEKAIEEADEFCILQIQDVEKFEQYQKGVDLIQKLRTVHSMAQVDPNLMVHLSPLRDCIARVHQKLKNLGSINQAMVTRCEPVVCYLYGKRGGGKSLTSIALATKICKHYGVEPEKNIYTKPVASDYWDGYSGQLVCIIDDIGQNTTDEDWSDFCQLVSGCPMRLNMASLEEKGRHFSSPFIIATSNWSNPSPKTVYVKEAIDRRLHFKVEVKPASFFKNPHNDMLNVNLAKTNDAIKDMSCVDLIMDGHNVSLMDLLSSLVMTVEIRKQNMTEFMELWSQGISDDDNDSAVAEFFQSFPSGEPSNSKLSGFFQSVTNHKWVAVGAAVGILGVLVGGWFVYKHFSRKEEEPIPAEGVYHGVTKPKQVIKLDADPVESQSTLEIAGLXRKNLXQXGXGEKNGCVRWVXNXXGXKDDWXXXPSHAYKFEKDYEMMEXYXNRGGTYYSISAGNVVIQSLDVGFQDXXXXKXPTIPKFRDXTQHFXKKGDVPRXLNRLXTXXTTVNGTPMLISEGPXKMEEKATYVHKKNDGTTVDLTXDQXXRGKGEGLPGXCGGXXXSSNQSIQNAXXGXHVXGGNSIXXXKXXTQEMFQNIDKKIESQRIMKVEFTQCSMNVVSKTLFRKSPIYHHIDKTMINFPAAMPFSKAEIDPMAVMLSKYSLPIVEEPEDYKEASIFYQNKIVGKTQLVDDFLDLDMAITGAPGIDAINMDSSPGFPYVQEKLTKRDLIWLDENGLLLGVHPRLAQRILFNTVMMENCSDLDVVFTTCPKDELRPLEKVLESKTRAIDACPLDYSILCRMYWGPAISYFHLNPGFHTGVAIGIDPDRQWDELFKTMIRFGDVGLDLDFSAFDASLSPFMIREAGRIMSELSGTPSHFGTALINTIIYSKHLLYNCCYHVCGSMPSGSPCTALLNSIINNVNLYYVFSKIFGKSPVFFCQALKILCYGDDVLIVFSRDVQIDNLDLIGQKIVDEFKKLGMTATSADKNVPQLKPVSELTFLKRSFNLVEDRIRPAISEKTIWSLIAWQRSNAEFEQNLENAQWFAFMHGYEFYQKFYYFVQSCLEKEMIEYRLKSYDWWRMRFYDQCFICDLS

SEQ ID NO: 255 - protein, 135 aa, Homo sapiens
  SITE (9)..(9): Xaa at position 9 is Val, Ala, Gly, Leu, or Ile
  SITE (13)..(13): Xaa at position 13 is Ala, Gly, or Pro
  SITE (17)..(17): Xaa at position 17 is Ile, Ala, Val, Leu, or Gly
  SITE (35)..(35): Xaa at position 35 is Cys, Ala, Val, Gly, Ser, or Thr
  SITE (50)..(50): Xaa at position 50 is Ile, Ala, Val, Leu, or Gly
  SITE (51)..(51): Xaa at position 51 is Ala, Gly, or Pro
  SITE (54)..(54): Xaa at position 54 is Val, Ala, Gly, Leu, or Ile
  SITE (61)..(61): Xaa at position 61 is Ile, Ala, Val, Leu, or Gly
MGRVRTKTXKKAXRVIXEKYYTRLGNDFHTNKRVXEEIAIIPSKKLRNKXXGYXTHLMKRXQRGPVRGISIKLQEEERERRDNYVPEVSALDQEIIEVDPDTKEMLKLLDFGSLSNLQVTQPTVGMNFKTPRGPV

SEQ ID NO: 256 - protein, 466 aa, Homo sapiens
  SITE (141)..(141): Xaa at position 141 is Cys, Ala, Val, Gly, Ser, or Thr
  SITE (213)..(213): Xaa at position 213 is Ile, Ala, Val, Leu, or Gly
  SITE (219)..(219): Xaa at position 219 is Cys, Ala, Val, Gly, Ser, or Thr
  SITE (228)..(228): Xaa at position 228 is Val, Ala, Gly, Leu, or Ile
  SITE (229)..(229): Xaa at position 229 is Leu, Ala, Val, Gly, or Ile
  SITE (230)..(230): Xaa at position 230 is Leu, Ala, Val, Gly, or Ile
  SITE (242)..(242): Xaa at position 242 is Leu, Ala, Val, Gly, or Ile
  SITE (248)..(248): Xaa at position 248 is Val, Ala, Gly, Leu, or Ile
  SITE (249)..(249): Xaa at position 249 is Val, Ala, Gly, Leu, or Ile
  SITE (251)..(251): Xaa at position 251 is Ala, Gly, or Pro
  SITE (252)..(252): Xaa at position 252 is Ala, Gly, or Pro
  SITE (264)..(264): Xaa at position 264 is Leu, Ala, Val, Gly, or Ile
  SITE (266)..(266): Xaa at position 266 is Ala, Gly, or Pro
  SITE (268)..(268): Xaa at position 268 is Leu, Ala, Val, Gly, or Ile
  SITE (285)..(285): Xaa at position 285 is Val, Ala, Gly, Leu, or Ile
  SITE (288)..(288): Xaa at position 288 is Val, Ala, Gly, Leu, or Ile
  SITE (289)..(289): Xaa at position 289 is Ile, Ala, Val, Leu, or Gly
  SITE (294)..(294): Xaa at position 294 is Tyr, Phe, Met, His, Ile, Leu, Val Ala, or Gly
  SITE (303)..(303): Xaa at position 303 is Ile, Ala, Val, Leu, or Gly
  SITE (304)..(304): Xaa at position 304 is Ala, Gly, or Pro
  SITE (305)..(305): Xaa at position 305 is Leu, Ala, Val, Gly, or Ile
  SITE (306)..(306): Xaa at position 306 is Leu, Ala, Val, Gly, or Ile
  SITE (318)..(318): Xaa at position 318 is Val, Ala, Gly, Leu, or Ile
  SITE (321)..(321): Xaa at position 321 is Leu, Ala, Val, Gly, or Ile
  SITE (333)..(333): Xaa at position 333 is Leu, Ala, Val, Gly, or Ile
  SITE (341)..(341): Xaa at position 341 is Val, Ala, Gly, Leu, or Ile
  SITE (344)..(344): Xaa at position 344 is Trp, Tyr, Phe, Met, His, Ile, Leu Val, Ala, or Gly
  SITE (354)..(354): Xaa at position 354 is Ala, Gly, or Pro
  SITE (362)..(362): Xaa at position 362 is Val, Ala, Gly, Leu, or Ile
  SITE (370)..(370): Xaa at position 370 is Cys, Ala, Val, Gly, Ser, or Thr
  SITE (387)..(387): Xaa at position 387 is Met, Ile, Leu, Val, Ala, or Gly
  SITE (388)..(388): Xaa at position 388 is Phe, Tyr, Met, His, Ile, Leu, Val Ala, or Gly
  SITE (389)..(389): Xaa at position 389 is Cys, Ala, Val, Gly, Ser, or Thr
  SITE (390)..(390): Xaa at position 390 is Ala, Gly, or Pro
  SITE (408)..(408): Xaa at position 408 is His, Phe, Tyr, Lys, Arg, Gly, Ser Thr, Ala, Val, Leu, Ile, Asn, Met, or Gln
  SITE (409)..(409): Xaa at position 409 is Ala, Gly, or Pro
  SITE (411)..(411): Xaa at position 411 is His, Phe, Tyr, Lys, Arg, Gly, Ser Thr, Ala, Val, Leu, Ile, Asn, Met, or Gln
  SITE (418)..(418): Xaa at position 418 is Leu, Ala, Val, Gly, or Ile
  SITE (421)..(421): Xaa at position 421 is Ile, Ala, Val, Leu, or Gly
  SITE (422)..(422): Xaa at position 422 is Val, Ala, Gly, Leu, or Ile
  SITE (436)..(436): Xaa at position 436 is Val, Ala, Gly, Leu, or Ile
  SITE (437)..(437): Xaa at position 437 is Tyr, Phe, Met, His, Ile, Leu, Val Ala, or Gly
  SITE (440)..(440): Xaa at position 440 is Val, Ala, Gly, Leu, or Ile
  SITE (443)..(443): Xaa at position 443 is Tyr, Phe, Met, His, Ile, Leu, Val Ala, or Gly
  SITE (444)..(444): Xaa at position 444 is Ile, Ala, Val, Leu, or Gly
  SITE (446)..(446): Xaa at position 446 is Trp, Tyr, Phe, Met, His, Ile, Leu Val, Ala, or Gly
  SITE (447)..(447): Xaa at position 447 is Leu, Ala, Val, Gly, or Ile
  SITE (450)..(450): Xaa at position 450 is Leu, Ala, Val, Gly, or Ile
  SITE (463)..(463): Xaa at position 463 is Ala, Gly, or Pro
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNXETHKDDQLICVNENGGCEQYCSDHTGTKRSCRCHEGYSLLADGVSCTPTVEYPCGKIPILEKRNASKPQGRXVGGKVXPKGECPWQXXXLVNGAQLCGGTXINTIWXXSXXHCFDKIKNWRNXIXVXGEHDLSEHDGDEQSRRXAQXXIPSTXVPGTTNHDXXXXRLHQPVVLTDHXVPXCLPERTFSERTXAFVRFSLXSGXGQLLDRGATXLELMVLNXPRLMTQDXLQQSRKVGDSPNITEYXXXXGYSDGSKDSCKGDSGGPXXTXYRGTWYXTGXXSWGQGCATVGHFGXXTRXSQXXEXXQKXMRSEPRPGVLLRXPFP

SEQ ID NO: 257 - protein, 468 aa, Homo sapiens
  SITE (45)..(45): Xaa at position 45 is Leu, Ala, Val, Gly, or Ile
  SITE (47)..(47): Xaa at position 47 is Cys, Ala, Val, Gly, Ser, or Thr
  SITE (50)..(50): Xaa at position 50 is Val, Ala, Gly, Leu, or Ile
  SITE (58)..(58): Xaa at position 58 is Val, Ala, Gly, Leu, or Ile
  SITE (60)..(60): Xaa at position 60 is Trp, Tyr, Phe, Met, His, Ile, Leu Val, Ala, or Gly
  SITE (86)..(86): Xaa at position 86 is Val, Ala, Gly, Leu, or Ile
  SITE (94)..(94): Xaa at position 94 is Tyr, Phe, Met, His, Ile, Leu, Val Ala, or Gly
  SITE (96)..(96): Xaa at position 96 is Cys, Ala, Val, Gly, Ser, or Thr
  SITE (130)..(130): Xaa at position 130 is Val, Ala, Gly, Leu, or Ile
  SITE (132)..(132): Xaa at position 132 is Cys, Ala, Val, Gly, Ser, or Thr
  SITE (148)..(148): Xaa at position 148 is Leu, Ala, Val, Gly, or Ile
  SITE (149)..(149): Xaa at position 149 is Leu, Ala, Val, Gly, or Ile
  SITE (150)..(150): Xaa at position 150 is Val, Ala, Gly, Leu, or Ile
  SITE (176)..(176): Xaa at position 176 is Cys, Ala, Val, Gly, Ser, or Thr
  SITE (178)..(178): Xaa at position 178 is Leu, Ala, Val, Gly, or Ile
  SITE (188)..(188): Xaa at position 188 is Tyr, Phe, Met, His, Ile, Leu, Val Ala, or Gly
  SITE (190)..(190): Xaa at position 190 is Val, Ala, Gly, Leu, or Ile
  SITE (192)..(192): Xaa at position 192 is Met, Ile, Leu, Val, Ala, or Gly
  SITE (194)..(194): Xaa at position 194 is Val, Ala, Gly, Leu, or Ile
  SITE (234)..(234): Xaa at position 234 is Leu, Ala, Val, Gly, or Ile
  SITE (236)..(236): Xaa at position 236 is Val, Ala, Gly, Leu, or Ile
  SITE (251)..(251): Xaa at position 251 is Leu, Ala, Val, Gly, or Ile
  SITE (253)..(253): Xaa at position 253 is Phe, Tyr, Met, His, Ile, Leu, Val Ala, or Gly
  SITE (255)..(255): Xaa at position 255 is Leu, Ala, Val, Gly, or Ile
  SITE (257)..(257): Xaa at position 257 is Tyr, Phe, Met, His, Ile, Leu, Val Ala, or Gly
  SITE (259)..(259): Xaa at position 259 is Ala, Gly, or Pro
  SITE (270)..(270): Xaa at position 270 is Val, Ala, Gly, Leu, or Ile
  SITE (273)..(273): Xaa at position 273 is Leu, Ala, Val, Gly, or Ile
  SITE (279)..(279): Xaa at position 279 is Ile, Ala, Val, Leu, or Gly
  SITE (282)..(282): Xaa at position 282 is Ala, Gly, or Pro
  SITE (288)..(288): Xaa at position 288 is His, Phe, Tyr, Lys, Arg, Gly, Ser Thr, Ala, Val, Leu, Ile, Asn, Met, or Gln
  SITE (290)..(290): Xaa at position 290 is Val, Ala, Gly, Leu, or Ile
  SITE (292)..(292): Xaa at position 292 is Leu, Ala, Val, Gly, or Ile
  SITE (294)..(294): Xaa at position 294 is Ala, Gly, or Pro
MLAVGCALLAALLAAPGAALAPRRCPAQEVARGVLTSLPGDSVTXTXPGXEPEDNATXHXVLRKPAAGSHPSRWAGMGRRLLLRSXQLHDSGNXSXYRAGRPAGTVHLLVDVPPEEPQLSCFRKSPLSNXVXEWGPRSTPSLTTKAVXXXRKFQNSPAEDFQEPCQYSQESQKFSXQXAVPEGDSSFXIXSXCXASSVGSKFSKTQTFQGCGILQPDPPANITVTAVARNPRWXSXTWQDPHSWNSSFYRXRXEXRXRXERSKTFTTWMXKDXQHHCVXHDXWSGLRXVXQXRXQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 258 - protein, 244 aa, Homo sapiens
  SITE (13)..(13): Xaa at position 13 is Val, Ala, Gly, Leu, or Ile
  SITE (14)..(14): Xaa at position 14 is Leu, Ala, Val, Gly, or Ile
  SITE (15)..(15): Xaa at position 15 is Val, Ala, Gly, Leu, or Ile
  SITE (26)..(26): Xaa at position 26 is Cys, Ala, Val, Gly, Ser, or Thr
  SITE (27)..(27): Xaa at position 27 is Val, Ala, Gly, Leu, or Ile
  SITE (30)..(30): Xaa at position 30 is Phe, Tyr, Met, His, Ile, Leu, Val Ala, or Gly
  SITE (37)..(37): Xaa at position 37 is Val, Ala, Gly, Leu, or Ile
  SITE (38)..(38): Xaa at position 38 is Ala, Gly, or Pro
  SITE (40)..(40): Xaa at position 40 is Val, Ala, Gly, Leu, or Ile
  SITE (67)..(67): Xaa at position 67 is Val, Ala, Gly, Leu, or Ile
  SITE (71)..(71): Xaa at position 71 is Val, Ala, Gly, Leu, or Ile
  SITE (80)..(80): Xaa at position 80 is Val, Ala, Gly, Leu, or Ile
  SITE (82)..(82): Xaa at position 82 is Ala, Gly, or Pro
  SITE (83)..(83): Xaa at position 83 is Ile, Ala, Val, Leu, or Gly
  SITE (84)..(84): Xaa at position 84 is Leu, Ala, Val, Gly, or Ile
  SITE (85)..(85): Xaa at position 85 is Cys, Ala, Val, Gly, Ser, or Thr
  SITE (107)..(107): Xaa at position 107 is Met, Ile, Leu, Val, Ala, or Gly
  SITE (121)..(121): Xaa at position 121 is Leu, Ala, Val, Gly, or Ile
  SITE (122)..(122): Xaa at position 122 is Ala, Gly, or Pro
  SITE (131)..(131): Xaa at position 131 is Leu, Ala, Val, Gly, or Ile
  SITE (132)..(132): Xaa at position 132 is Leu, Ala, Val, Gly, or Ile
  SITE (134)..(134): Xaa at position 134 is Leu, Ala, Val, Gly, or Ile
  SITE (153)..(153): Xaa at position 153 is Ala, Gly, or Pro
  SITE (157)..(157): Xaa at position 157 is Val, Ala, Gly, Leu, or Ile
  SITE (158)..(158): Xaa at position 158 is His, Phe, Tyr, Lys, Arg, Gly, Ser Thr, Ala, Val, Leu, Ile, Asn, Met, or Gln
  SITE (161)..(161): Xaa at position 161 is Cys, Ala, Val, Gly, Ser, or Thr
  SITE (176)..(176): Xaa at position 176 is Ala, Gly, or Pro
  SITE (177)..(177): Xaa at position 177 is Ala, Gly, or Pro
  SITE (178)..(178): Xaa at position 178 is Ile, Ala, Val, Leu, or Gly
  SITE (179)..(179): Xaa at position 179 is Ala, Gly, or Pro
  SITE (180)..(180): Xaa at position 180 is Val, Ala, Gly, Leu, or Ile
  SITE (181)..(181): Xaa at position 181 is Leu, Ala, Val, Gly, or Ile
  SITE (208)..(208): Xaa at position 208 is Leu, Ala, Val, Gly, or Ile
  SITE (212)..(212): Xaa at position 212 is Phe, Tyr, Met, His, Ile, Leu, Val Ala, or Gly
  SITE (227)..(227): Xaa at position 227 is Leu, Ala, Val, Gly, or Ile
  SITE (228)..(228): Xaa at position 228 is Ile, Ala, Val, Leu, or Gly
  SITE (230)..(230): Xaa at position 230 is Val, Ala, Gly, Leu, or Ile
MAAAAAAGEARRXXXYGGRGALGSRXXQAXRARNWWXXSXDVVENEEASASIIVKMTDSFTEQADQXTAEXGKLLGEEKXDXXXXVAGGWAGGNAKSKSLFKNCDLXWKQSIWTSTISSHXXTKHLKEGGXXTXAGAKAALDGTPGMIGYGMXKGAXXQLXQSLAGKNSGMPPGAXXXXXXPVTLDTPMNRKSMPEADFSSWTPLEFXVETXHDWITGKNRPSSGSXXQXVTTEGRTELTPAYF

SEQ ID NO: 259 - protein, 338 aa, Homo sapiens
  SITE (14)..(14): Xaa at position 14 is Leu, Ala, Val, Gly, or Ile
  SITE (17)..(17): Xaa at position 17 is Phe, Tyr, Met, His, Ile, Leu, Val Ala, or Gly
  SITE (18)..(18): Xaa at position 18 is Val, Ala, Gly, Leu, or Ile
  SITE (34)..(34): Xaa at position 34 is Leu, Ala, Val, Gly, or Ile
  SITE (38)..(38): Xaa at position 38 is Leu, Ala, Val, Gly, or Ile
  SITE (41)..(41): Xaa at position 41 is Ala, Gly, or Pro
  SITE (42)..(42): Xaa at position 42 is Val, Ala, Gly, Leu, or Ile
  SITE (45)..(45): Xaa at position 45 is Ile, Ala, Val, Leu, or Gly
  SITE (52)..(52): Xaa at position 52 is Ala, Gly, or Pro
  SITE (74)..(74): Xaa at position 74 is Leu, Ala, Val, Gly, or Ile
  SITE (82)..(82): Xaa at position 82 is Val, Ala, Gly, Leu, or Ile
  SITE (86)..(86): Xaa at position 86 is Leu, Ala, Val, Gly, or Ile
  SITE (91)..(91): Xaa at position 91 is Ala, Gly, or Pro
  SITE (93)..(93): Xaa at position 93 is Cys, Ala, Val, Gly, Ser, or Thr
  SITE (94)..(94): Xaa at position 94 is Val, Ala, Gly, Leu, or Ile
  SITE (95)..(95): Xaa at position 95 is Leu, Ala, Val, Gly, or Ile
  SITE (96)..(96): Xaa at position 96 is Val, Ala, Gly, Leu, or Ile
  SITE (106)..(106): Xaa at position 106 is Val, Ala, Gly, Leu, or Ile
  SITE (115)..(115): Xaa at position 115 is Val, Ala, Gly, Leu, or Ile
  SITE (116)..(116): Xaa at position 116 is Val, Ala, Gly, Leu, or Ile
  SITE (117)..(117): Xaa at position 117 is Cys, Ala, Val, Gly, Ser, or Thr
  SITE (118)..(118): Xaa at position 118 is Phe, Tyr, Met, His, Ile, Leu, Val Ala, or Gly
  SITE (121)..(121): Xaa at position 121 is Leu, Ala, Val, Gly, or Ile
  SITE (133)..(133): Xaa at position 133 is Val, Ala, Gly, Leu, or Ile
  SITE (136)..(136): Xaa at position 136 is Ile, Ala, Val, Leu, or Gly
  SITE (137)..(137): Xaa at position 137 is Phe, Tyr, Met, His, Ile, Leu, Val Ala, or Gly
  SITE (139)..(139): Xaa at position 139 is Ile, Ala, Val, Leu, or Gly
  SITE (140)..(140): Xaa at position 140 is Tyr, Phe, Met, His, Ile, Leu, Val Ala, or Gly
  SITE (153)..(153): Xaa at position 153 is Ala, Gly, or Pro
  SITE (162)..(162): Xaa at position 162 is Ala, Gly, or Pro
  SITE (163)..(163): Xaa at position 163 is Ala, Gly, or Pro
  SITE (165)..(165): Xaa at position 165 is Tyr, Phe, Met, His, Ile, Leu, Val Ala, or Gly
  SITE (166)..(166): Xaa at position 166 is Ala, Gly, or Pro
  SITE (174)..(174): Xaa at position 174 is Leu, Ala, Val, Gly, or Ile
  SITE (175)..(175): Xaa at position 175 is Val, Ala, Gly, Leu, or Ile
  SITE (176)..(176): Xaa at position 176 is Leu, Ala, Val, Gly, or Ile
  SITE (177)..(177): Xaa at position 177 is Ala, Gly, or Pro
  SITE (182)..(182): Xaa at position 182 is Val, Ala, Gly, Leu, or Ile
  SITE (184)..(184): Xaa at position 184 is Cys, Ala, Val, Gly, Ser, or Thr
  SITE (185)..(185): Xaa at position 185 is Phe, Tyr, Met, His, Ile, Leu, Val Ala, or Gly
  SITE (194)..(194): Xaa at position 194 is Phe, Tyr, Met, His, Ile, Leu, Val Ala, or Gly
  SITE (223)..(223): Xaa at position 223 is Ala, Gly, or Pro
  SITE (224)..(224): Xaa at position 224 is Val, Ala, Gly, Leu, or Ile
  SITE (227)..(227): Xaa at position 227 is Tyr, Phe, Met, His, Ile, Leu, Val Ala, or Gly
  SITE (250)..(250): Xaa at position 250 is Val, Ala, Gly, Leu, or Ile
  SITE (253)..(253): Xaa at position 253 is Val, Ala, Gly, Leu, or Ile
  SITE (257)..(257): Xaa at position 257 is Leu, Ala, Val, Gly, or Ile
  SITE (262)..(262): Xaa at position 262 is Ile, Ala, Val, Leu, or Gly
  SITE (263)..(263): Xaa at position 263 is Phe, Tyr, Met, His, Ile, Leu, Val Ala, or Gly
  SITE (264)..(264): Xaa at position 264 is Leu, Ala, Val, Gly, or Ile
  SITE (278)..(278): Xaa at position 278 is Leu, Ala, Val, Gly, or Ile
  SITE (279)..(279): Xaa at position 279 is Leu, Ala, Val, Gly, or Ile
  SITE (280)..(280): Xaa at position 280 is Tyr, Phe, Met, His, Ile, Leu, Val Ala, or Gly
  SITE (282)..(282): Xaa at position 282 is Cys, Ala, Val, Gly, Ser, or Thr
  SITE (285)..(285): Xaa at position 285 is Met, Ile, Leu, Val, Ala, or Gly
  SITE (286)..(286): Xaa at position 286 is Ala, Gly, or Pro
  SITE (287)..(287): Xaa at position 287 is Tyr, Phe, Met, His, Ile, Leu, Val Ala, or Gly
  SITE (288)..(288): Xaa at position 288 is Val, Ala, Gly, Leu, or Ile
  SITE (289)..(289): Xaa at position 289 is Met, Ile, Leu, Val, Ala, or Gly
  SITE (292)..(292): Xaa at position 292 is Ala, Gly, or Pro
  SITE (296)..(296): Xaa at position 296 is Ala, Gly, or Pro
  SITE (303)..(303): Xaa at position 303 is Val, Ala, Gly, Leu, or Ile
  SITE (304)..(304): Xaa at position 304 is Leu, Ala, Val, Gly, or Ile
  SITE (311)..(311): Xaa at position 311 is Ile, Ala, Val, Leu, or Gly
  SITE (315)..(315): Xaa at position 315 is Ala, Gly, or Pro
  SITE (317)..(317): Xaa at position 317 is Val, Ala, Gly, Leu, or Ile
  SITE (318)..(318): Xaa at position 318 is Ile, Ala, Val, Leu, or Gly
  SITE (319)..(319): Xaa at position 319 is Leu, Ala, Val, Gly, or Ile
  SITE (325)..(325): Xaa at position 325 is Val, Ala, Gly, Leu, or Ile
  SITE (328)..(328): Xaa at position 328 is Phe, Tyr, Met, His, Ile, Leu, Val Ala, or Gly
  SITE (331)..(331): Xaa at position 331 is Val, Ala, Gly, Leu, or Ile
MADQAPFDTDVNTXTRXXMEEGRKARGTGELTQXLNSXCTXXKAXSSAVRKXGIAHLYGIAGSTNVTGDQVKKXDVLSNDLXMNMXKSSFXTXXXXSEEDKHAIIXEPEKRGKYXXXXDPXDGSSNIDCLVSXGTXXGXXRKKSTDEPSEKDXLQPGRNLVXXGXXLYGSATMXXXXMDCGXNXXMLDPAIGEXILVDKDVKIKKKGKIYSLNEGYARDFDPXXTEXIQRKKFPPDNSAPYGARYVGSMXADXHRTXVYGGXXXYPANKKSPNGKLRXXXEXNPXXXXXEKXGGMXTTGKEAXXDVIPTDXHQRXPXXXGSPDDXLEXLKXYEKHSAQ

SEQ ID NO: 260 - protein, 554 aa, Homo sapiens
  SITE (39)..(39): Xaa at position 39 is Cys, Ala, Val, Gly, Ser, or Thr
  SITE (43)..(43): Xaa at position 43 is Ile, Ala, Val, Leu, or Gly
  SITE (51)..(51): Xaa at position 51 is Leu, Ala, Val, Gly, or Ile
  SITE (54)..(54): Xaa at position 54 is Leu, Ala, Val, Gly, or Ile
  SITE (69)..(69): Xaa at position 69 is Phe, Tyr, Met, His, Ile, Leu, Val Ala, or Gly
  SITE (70)..(70): Xaa at position 70 is Val, Ala, Gly, Leu, or Ile
  SITE (75)..(75): Xaa at position 75 is Leu, Ala, Val, Gly, or Ile
  SITE (80)..(80): Xaa at position 80 is Cys, Ala, Val, Gly, Ser, or Thr
  SITE (85)..(85): Xaa at position 85 is Ala, Gly, or Pro
  SITE (89)..(89): Xaa at position 89 is Val, Ala, Gly, Leu, or Ile
  SITE (93)..(93): Xaa at position 93 is Met, Ile, Leu, Val, Ala, or Gly
  SITE (112)..(112): Xaa at position 112 is Leu, Ala, Val, Gly, or Ile
  SITE (115)..(115): Xaa at position 115 is Leu, Ala, Val, Gly, or Ile
  SITE (119)..(119): Xaa at position 119 is Leu, Ala, Val, Gly, or Ile
  SITE (122)..(122): Xaa at position 122 is Cys, Ala, Val, Gly, Ser, or Thr
  SITE (134)..(134): Xaa at position 134 is Cys, Ala, Val, Gly, Ser, or Thr
  SITE (145)..(145): Xaa at position 145 is Leu, Ala, Val, Gly, or Ile
  SITE (149)..(149): Xaa at position 149 is Val, Ala, Gly, Leu, or Ile
  SITE (152)..(152): Xaa at position 152 is Val, Ala, Gly, Leu, or Ile
  SITE (153)..(153): Xaa at position 153 is Phe, Tyr, Met, His, Ile, Leu, Val Ala, or Gly
  SITE (160)..(160): Xaa at position 160 is Leu, Ala, Val, Gly, or Ile
  SITE (167)..(167): Xaa at position 167 is Phe, Tyr, Met, His, Ile, Leu, Val Ala, or Gly
  SITE (171)..(171): Xaa at position 171 is Cys, Ala, Val, Gly, Ser, or Thr
MTAPGAAGRCPPTTWLGSLLLLVCLLASRSITEEVSEYXSHMXGSGHLQSXQRXIDSQMETSCQITFEXXDQEQXKDPVXYLKKXFLLXQDIXEDTMRFRDNTPNAIAIVQXQEXSLRXKSXFTKDYEEHDKAXVRTFYETPLQXLEKXKNXXNETKNLXDKDWNIXSKNXNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 261 - protein, 1106 aa, Homo sapiens
  SITE (52)..(52): Xaa at position 52 is Leu, Ala, Val, Gly, or Ile
  SITE (54)..(54): Xaa at position 54 is Cys, Ala, Val, Gly, Ser, or Thr
  SITE (60)..(60): Xaa at position 60 is Val, Ala, Gly, Leu, or Ile
  SITE (62)..(62): Xaa at position 62 is Trp, Tyr, Phe, Met, His, Ile, Leu Val, Ala, or Gly
  SITE (85)..(85): Xaa at position 85 is Leu, Ala, Val, Gly, or Ile
  SITE (90)..(90): Xaa at position 90 is Leu, Ala, Val, Gly, or Ile
  SITE (100)..(100): Xaa at position 100 is Cys, Ala, Val, Gly, Ser, or Thr
  SITE (117)..(117): Xaa at position 117 is Tyr, Phe, Met, His, Ile, Leu, Val Ala, or Gly
  SITE (118)..(118): Xaa at position 118 is Ile, Ala, Val, Leu, or Gly
  SITE (119)..(119): Xaa at position 119 is Phe, Tyr, Met, His, Ile, Leu, Val Ala, or Gly
  SITE (120)..(120): Xaa at position 120 is Val, Ala, Gly, Leu, or Ile
  SITE (147)..(147): Xaa at position 147 is Ile, Ala, Val, Leu, or Gly
  SITE (149)..(149): Xaa at position 149 is Cys, Ala, Val, Gly, Ser, or Thr
  SITE (151)..(151): Xaa at position 151 is Val, Ala, Gly, Leu, or Ile
  SITE (160)..(160): Xaa at position 160 is Leu, Ala, Val, Gly, or Ile
  SITE (190)..(190): Xaa at position 190 is Cys, Ala, Val, Gly, Ser, or Thr
  SITE (225)..(225): Xaa at position 225 is Val, Ala, Gly, Leu, or Ile
  SITE (231)..(231): Xaa at position 231 is Ile, Ala, Val, Leu, or Gly
  SITE (233)..(233): Xaa at position 233 is Leu, Ala, Val, Gly, or Ile
  SITE (235)..(235): Xaa at position 235 is Cys, Ala, Val, Gly, Ser, or Thr
  SITE (237)..(237): Xaa at position 237 is Val, Ala, Gly, Leu, or Ile
  SITE (265)..(265): Xaa at position 265 is Leu, Ala, Val, Gly, or Ile
  SITE (276)..(276): Xaa at position 276 is Leu, Ala, Val, Gly, or Ile
  SITE (278)..(278): Xaa at position 278 is Ile, Ala, Val, Leu, or Gly
  SITE (289)..(289): Xaa at position 289 is Tyr, Phe, Met, His, Ile, Leu, Val Ala, or Gly
  SITE (291)..(291): Xaa at position 291 is Cys, Ala, Val, Gly, Ser, or Thr
  SITE (293)..(293): Xaa at position 293 is Val, Ala, Gly, Leu, or Ile
  SITE (308)..(308): Xaa at position 308 is Ile, Ala, Val, Leu, or Gly
MRLPGAMPALALKGELLLLSLLLLLEPQISQGLVVTPPGPELVLNVSSTFVXTXSGSAPXVXERMSQEPPQEMAKAQDGTFSSVXTLTNXTGLDTGEYFXTHNDSRGLETDERKRLXXXXPDPTVGFLPNDAEELFIFLTEITEITXPXRXTDPQLVVTXHEKKGDVALPVPYDHQRGFSGIFEDRSYIXKTTIGDREVDSDAYYVYRLQVSSINVSVNAVQTVXRQGENXTXMXIXIGNEVVNFEWTYPRKESGRLVEPVTDFXLDMPYHIRSIXHXPSAELEDSGTXTXNXTESVNDHQDEKAINXTVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 262 - protein, 335 aa, Homo sapiens
  SITE (240)..(240): Xaa at position 240 is Val, Ala, Gly, Leu, or Ile
  SITE (279)..(279): Xaa at position 279 is Val, Ala, Gly, Leu, or Ile
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMXEAVALYNPVSFAFEVTQDFMMYRTGIYSSTSCHKTPDKXNHAVLAVGYGEKNGIPYWIVKNSWGPQWGMNGYFLIERGKNMCGLAACASYPIPLV

SEQ ID NO: 263 - protein, 223 aa, Homo sapiens
  SITE (12)..(12): Xaa at position 12 is Met, Ile, Leu, Val, Ala, or Gly
  SITE (13)..(13): Xaa at position 13 is Leu, Ala, Val, Gly, or Ile
  SITE (16)..(16): Xaa at position 16 is Val, Ala, Gly, Leu, or Ile
  SITE (17)..(17): Xaa at position 17 is Leu, Ala, Val, Gly, or Ile
  SITE (20)..(20): Xaa at position 20 is Leu, Ala, Val, Gly, or Ile
  SITE (22)..(22): Xaa at position 22 is Val, Ala, Gly, Leu, or Ile
  SITE (23)..(23): Xaa at position 23 is Ala, Gly, or Pro
  SITE (42)..(42): Xaa at position 42 is Val, Ala, Gly, Leu, or Ile
  SITE (47)..(47): Xaa at position 47 is Cys, Ala, Val, Gly, Ser, or Thr
  SITE (48)..(48): Xaa at position 48 is Ala, Gly, or Pro
  SITE (49)..(49): Xaa at position 49 is Leu, Ala, Val, Gly, or Ile
  SITE (50)..(50): Xaa at position 50 is Leu, Ala, Val, Gly, or Ile
  SITE (51)..(51): Xaa at position 51 is Leu, Ala, Val, Gly, or Ile
  SITE (52)..(52): Xaa at position 52 is Leu, Ala, Val, Gly, or Ile
  SITE (53)..(53): Xaa at position 53 is Phe, Tyr, Met, His, Ile, Leu, Val Ala, or Gly
  SITE (67)..(67): Xaa at position 67 is Ile, Ala, Val, Leu, or Gly
  SITE (82)..(82): Xaa at position 82 is Met, Ile, Leu, Val, Ala, or Gly
  SITE (86)..(86): Xaa at position 86 is Ile, Ala, Val, Leu, or Gly
  SITE (95)..(95): Xaa at position 95 is Leu, Ala, Val, Gly, or Ile
  SITE (96)..(96): Xaa at position 96 is Ile, Ala, Val, Leu, or Gly
  SITE (97)..(97): Xaa at position 97 is His, Phe, Tyr, Lys, Arg, Gly, Ser Thr, Ala, Val, Leu, Ile, Asn, Met, or Gln
  SITE (98)..(98): Xaa at position 98 is Ala, Gly, or Pro
  SITE (99)..(99): Xaa at position 99 is Val, Ala, Gly, Leu, or Ile
  SITE (114)..(114): Xaa at position 114 is Leu, Ala, Val, Gly, or Ile
  SITE (117)..(117): Xaa at position 117 is Phe, Tyr, Met, His, Ile, Leu, Val Ala, or Gly
  SITE (118)..(118): Xaa at position 118 is Leu, Ala, Val, Gly, or Ile
  SITE (130)..(130): Xaa at position 130 is Ala, Gly, or Pro
  SITE (133)..(133): Xaa at position 133 is Phe, Tyr, Met, His, Ile, Leu, Val Ala, or Gly
  SITE (139)..(139): Xaa at position 139 is Ile, Ala, Val, Leu, or Gly
  SITE (142)..(142): Xaa at position 142 is Ala, Gly, or Pro
  SITE (143)..(143): Xaa at position 143 is His, Phe, Tyr, Lys, Arg, Gly, Ser Thr, Ala, Val, Leu, Ile, Asn, Met, or Gln
  SITE (146)..(146): Xaa at position 146 is Val, Ala, Gly, Leu, or Ile
  SITE (147)..(147): Xaa at position 147 is Ala, Gly, or Pro
  SITE (160)..(160): Xaa at position 160 is Phe, Tyr, Met, His, Ile, Leu, Val Ala, or Gly
  SITE (161)..(161): Xaa at position 161 is His, Phe, Tyr, Lys, Arg, Gly, Ser Thr, Ala, Val, Leu, Ile, Asn, Met, or Gln
  SITE (162)..(162): Xaa at position 162 is Phe, Tyr, Met, His, Ile, Leu, Val Ala, or Gly
  SITE (163)..(163): Xaa at position 163 is Ile, Ala, Val, Leu, or Gly
  SITE (164)..(164): Xaa at position 164 is Leu, Ala, Val, Gly, or Ile
  SITE (165)..(165): Xaa at position 165 is Phe, Tyr, Met, His, Ile, Leu, Val Ala, or Gly
  SITE (172)..(172): Xaa at position 172 is Leu, Ala, Val, Gly, or Ile
  SITE (173)..(173): Xaa at position 173 is Tyr, Phe, Met, His, Ile, Leu, Val Ala, or Gly
  SITE (175)..(175): Xaa at position 175 is Leu, Ala, Val, Gly, or Ile
  SITE (179)..(179): Xaa at position 179 is Met, Ile, Leu, Val, Ala, or Gly
  SITE (193)..(193): Xaa at position 193 is Leu, Ala, Val, Gly, or Ile
  SITE (194)..(194): Xaa at position 194 is Leu, Ala, Val, Gly, or Ile
  SITE (197)..(197): Xaa at position 197 is Ala, Gly, or Pro
  SITE (198)..(198): Xaa at position 198 is Ala, Gly, or Pro
  SITE (201)..(201): Xaa at position 201 is Cys, Ala, Val, Gly, Ser, or Thr
  SITE (212)..(212): Xaa at position 212 is Val, Ala, Gly, Leu, or Ile
  SITE (217)..(217): Xaa at position 217 is Val, Ala, Gly, Leu, or Ile
  SITE (218)..(218): Xaa at position 218 is Ala, Gly, or Pro
  SITE (219)..(219): Xaa at position 219 is Leu, Ala, Val, Gly, or Ile
  SITE (220)..(220): Xaa at position 220 is Cys, Ala, Val, Gly, Ser, or Thr
MQLKPMEINPEXXNKXXSRXGXXGQWRFVDVLGLEEESLGSXPAPAXXXXXXXPLTAQHENFRKKQXEELKGQEVSPKVYFXKQTXGNSCGTIGXXXXXANNQDKLGFEDGSVXKQXXSETEKMSPEDRXKCXEKNEAXQAXXDAXXQEGQCRVDDKVNXXXXXXNNVDGHXXEXDGRXPFPVNHGASSEDTXXKDXXKVXREFTEREQGEXRFSAXXXXKAA

SEQ ID NO: 264 - protein, 611 aa, Homo sapiens
  SITE (8)..(8): Xaa at position 8 is Cys, Ala, Val, Gly, Ser, or Thr
  SITE (16)..(16): Xaa at position 16 is Val, Ala, Gly, Leu, or Ile
  SITE (17)..(17): Xaa at position 17 is Cys, Ala, Val, Gly, Ser, or Thr
  SITE (22)..(22): Xaa at position 22 is Leu, Ala, Val, Gly, or Ile
  SITE (28)..(28): Xaa at position 28 is Val, Ala, Gly, Leu, or Ile
  SITE (35)..(35): Xaa at position 35 is Leu, Ala, Val, Gly, or Ile
  SITE (39)..(39): Xaa at position 39 is Ala, Gly, or Pro
  SITE (41)..(41): Xaa at position 41 is Leu, Ala, Val, Gly, or Ile
  SITE (43)..(43): Xaa at position 43 is Val, Ala, Gly, Leu, or Ile
  SITE (53)..(53): Xaa at position 53 is Leu, Ala, Val, Gly, or Ile
  SITE (55)..(55): Xaa at position 55 is Leu, Ala, Val, Gly, or Ile
  SITE (65)..(65): Xaa at position 65 is Val, Ala, Gly, Leu, or Ile
  SITE (67)..(67): Xaa at position 67 is Ile, Ala, Val, Leu, or Gly
  SITE (87)..(87): Xaa at position 87 is Met, Ile, Leu, Val, Ala, or Gly
  SITE (89)..(89): Xaa at position 89 is Ile, Ala, Val, Leu, or Gly
  SITE (94)..(94): Xaa at position 94 is Ala, Gly, or Pro
  SITE (95)..(95): Xaa at position 95 is Leu, Ala, Val, Gly, or Ile
  SITE (103)..(103): Xaa at position 103 is Ile, Ala, Val, Leu, or Gly
  SITE (105)..(105): Xaa at position 105 is Ile, Ala, Val, Leu, or Gly
  SITE (107)..(107): Xaa at position 107 is Phe, Tyr, Met, His, Ile, Leu, Val Ala, or Gly
  SITE (115)..(115): Xaa at position 115 is Ala, Gly, or Pro
  SITE (116)..(116): Xaa at position 116 is Leu, Ala, Val, Gly, or Ile
  SITE (119)..(119): Xaa at position 119 is Leu, Ala, Val, Gly, or Ile
  SITE (131)..(131): Xaa at position 131 is Tyr, Phe, Met, His, Ile, Leu, Val Ala, or Gly
  SITE (132)..(132): Xaa at position 132 is Leu, Ala, Val, Gly, or Ile
  SITE (133)..(133): Xaa at position 133 is Phe, Tyr, Met, His, Ile, Leu, Val Ala, or Gly
  SITE (136)..(136): Xaa at position 136 is Cys, Ala, Val, Gly, Ser, or Thr
  SITE (138)..(138): Xaa at position 138 is Ala, Gly, or Pro
  SITE (141)..(141): Xaa at position 141 is Cys, Ala, Val, Gly, Ser, or Thr
  SITE (143)..(143): Xaa at position 143 is Ala, Gly, or Pro
  SITE (145)..(145): Xaa at position 145 is Leu, Ala, Val, Gly, or Ile
  SITE (147)..(147): Xaa at position 147 is Cys, Ala, Val, Gly, Ser, or Thr
  SITE (153)..(153): Xaa at position 153 is Val, Ala, Gly, Leu, or Ile
  SITE (157)..(157): Xaa at position 157 is Tyr, Phe, Met, His, Ile, Leu, Val Ala, or Gly
  SITE (159)..(159): Xaa at position 159 is Ala, Gly, or Pro
  SITE (161)..(161): Xaa at position 161 is Val, Ala, Gly, Leu, or Ile
  SITE (163)..(163): Xaa at position 163 is Val, Ala, Gly, Leu, or Ile
  SITE (167)..(167): Xaa at position 167 is Leu, Ala, Val, Gly, or Ile
  SITE (169)..(169): Xaa at position 169 is Ala, Gly, or Pro
  SITE (170)..(170): Xaa at position 170 is Leu, Ala, Val, Gly, or Ile
  SITE (173)..(173): Xaa at position 173 is Ala, Gly, or Pro
  SITE (192)..(192): Xaa at position 192 is Phe, Tyr, Met, His, Ile, Leu, Val Ala, or Gly
  SITE (198)..(198): Xaa at position 198 is Ile, Ala, Val, Leu, or Gly
  SITE (200)..(200): Xaa at position 200 is Cys, Ala, Val, Gly, Ser, or Thr
  SITE (201)..(201): Xaa at position 201 is Tyr, Phe, Met, His, Ile, Leu, Val Ala, or Gly
  SITE (202)..(202): Xaa at position 202 is Leu, Ala, Val, Gly, or Ile
  SITE (204)..(204): Xaa at position 204 is Ala, Gly, or Pro
  SITE (206)..(206): Xaa at position 206 is Val, Ala, Gly, Leu, or Ile
  SITE (207)..(207): Xaa at position 207 is Val, Ala, Gly, Leu, or Ile
  SITE (221)..(221): Xaa at position 221 is Val, Ala, Gly, Leu, or Ile
  SITE (228)..(228): Xaa at position 228 is Val, Ala, Gly, Leu, or Ile
  SITE (235)..(235): Xaa at position 235 is Phe, Tyr, Met, His, Ile, Leu, Val Ala, or Gly
  SITE (241)..(241): Xaa at position 241 is Met, Ile, Leu, Val, Ala, or Gly
  SITE (242)..(242): Xaa at position 242 is Leu, Ala, Val, Gly, or Ile
  SITE (245)..(245): Xaa at position 245 is Ala, Gly, or Pro
  SITE (248)..(248): Xaa at position 248 is Leu, Ala, Val, Gly, or Ile
  SITE (259)..(259): Xaa at position 259 is Leu, Ala, Val, Gly, or Ile
  SITE (260)..(260): Xaa at position 260 is Leu, Ala, Val, Gly, or Ile
  SITE (261)..(261): Xaa at position 261 is Val, Ala, Gly, Leu, or Ile
  SITE (262)..(262): Xaa at position 262 is Leu, Ala, Val, Gly, or Ile
  SITE (266)..(266): Xaa at position 266 is Phe, Tyr, Met, His, Ile, Leu, Val Ala, or Gly
  SITE (275)..(275): Xaa at position 275 is Cys, Ala, Val, Gly, Ser, or Thr
  SITE (276)..(276): Xaa at position 276 is Leu, Ala, Val, Gly, or Ile
  SITE (278)..(278): Xaa at position 278 is Phe, Tyr, Met, His, Ile, Leu, Val Ala, or Gly
  SITE (279)..(279): Xaa at position 279 is Val, Ala, Gly, Leu, or Ile
  SITE (283)..(283): Xaa at position 283 is Leu, Ala, Val, Gly, or Ile
  SITE (294)..(294): Xaa at position 294 is Ile, Ala, Val, Leu, or Gly
  SITE (295)..(295): Xaa at position 295 is Ala, Gly, or Pro
  SITE (298)..(298): Xaa at position 298 is Ile, Ala, Val, Leu, or Gly
  SITE (300)..(300): Xaa at position 300 is His, Phe, Tyr, Lys, Arg, Gly, Ser Thr, Ala, Val, Leu, Ile, Asn, Met, or Gln
  SITE (302)..(302): Xaa at position 302 is Trp, Tyr, Phe, Met, His, Ile, Leu Val, Ala, or Gly
  SITE (307)..(307): Xaa at position 307 is Val, Ala, Gly, Leu, or Ile
  SITE (312)..(312): Xaa at position 312 is Trp, Tyr, Phe, Met, His, Ile, Leu Val, Ala, or Gly
  SITE (316)..(316): Xaa at position 316 is Trp, Tyr, Phe, Met, His, Ile, Leu Val, Ala, or Gly
  SITE (317)..(317): Xaa at position 317 is Leu, Ala, Val, Gly, or Ile
  SITE (321)..(321): Xaa at position 321 is His, Phe, Tyr, Lys, Arg, Gly, Ser Thr, Ala, Val, Leu, Ile, Asn, Met, or Gln
  SITE (324)..(324): Xaa at position 324 is Tyr, Phe, Met, His, Ile, Leu, Val Ala, or Gly
  SITE (325)..(325): Xaa at position 325 is Leu, Ala, Val, Gly, or Ile
  SITE (328)..(328): Xaa at position 328 is His, Phe, Tyr, Lys, Arg, Gly, Ser Thr, Ala, Val, Leu, Ile, Asn, Met, or Gln
  SITE (329)..(329): Xaa at position 329 is Ile, Ala, Val, Leu, or Gly
  SITE (343)..(343): Xaa at position 343 is Ala, Gly, or Pro
  SITE (344)..(344): Xaa at position 344 is Leu, Ala, Val, Gly, or Ile
  SITE (350)..(350): Xaa at position 350 is Leu, Ala, Val, Gly, or Ile
  SITE (366)..(366): Xaa at position 366 is Leu, Ala, Val, Gly, or Ile
  SITE (370)..(370): Xaa at position 370 is Leu, Ala, Val, Gly, or Ile
  SITE (382)..(382): Xaa at position 382 is Val, Ala, Gly, Leu, or Ile
  SITE (388)..(388): Xaa at position 388 is Phe, Tyr, Met, His, Ile, Leu, Val Ala, or Gly
  SITE (389)..(389): Xaa at position 389 is Ala, Gly, or Pro
  SITE (390)..(390): Xaa at position 390 is Leu, Ala, Val, Gly, or Ile
  SITE (391)..(391): Xaa at position 391 is Leu, Ala, Val, Gly, or Ile
  SITE (392)..(392): Xaa at position 392 is Phe, Tyr, Met, His, Ile, Leu, Val Ala, or Gly
  SITE (394)..(394): Xaa at position 394 is Leu, Ala, Val, Gly, or Ile
  SITE (397)..(397): Xaa at position 397 is Leu, Ala, Val, Gly, or Ile
  SITE (398)..(398): Xaa at position 398 is Leu, Ala, Val, Gly, or Ile
  SITE (404)..(404): Xaa at position 404 is Phe, Tyr, Met, His, Ile, Leu, Val Ala, or Gly
  SITE (407)..(407): Xaa at position 407 is Phe, Tyr, Met, His, Ile, Leu, Val Ala, or Gly
  SITE (408)..(408): Xaa at position 408 is Leu, Ala, Val, Gly, or Ile
  SITE (411)..(411): Xaa at position 411 is Tyr, Phe, Met, His, Ile, Leu, Val Ala, or Gly
  SITE (412)..(412): Xaa at position 412 is Val, Ala, Gly, Leu, or Ile
  SITE (420)..(420): Xaa at position 420 is Ile, Ala, Val, Leu, or Gly
  SITE (425)..(425): Xaa at position 425 is Trp, Tyr, Phe, Met, His, Ile, Leu Val, Ala, or Gly
  SITE (429)..(429): Xaa at position 429 is Leu, Ala, Val, Gly, or Ile
  SITE (440)..(440): Xaa at position 440 is Leu, Ala, Val, Gly, or Ile
  SITE (448)..(448): Xaa at position 448 is Trp, Tyr, Phe, Met, His, Ile, Leu Val, Ala, or Gly
  SITE (469)..(469): Xaa at position 469 is Cys, Ala, Val, Gly, Ser, or Thr
  SITE (476)..(476): Xaa at position 476 is Trp, Tyr, Phe, Met, His, Ile, Leu Val, Ala, or Gly
  SITE (487)..(487): Xaa at position 487 is Phe, Tyr, Met, His, Ile, Leu, Val Ala, or Gly
  SITE (503)..(503): Xaa at position 503 is Phe, Tyr, Met, His, Ile, Leu, Val Ala, or Gly
  SITE (504)..(504): Xaa at position 504 is Leu, Ala, Val, Gly, or Ile
  SITE (518)..(518): Xaa at position 518 is Ile, Ala, Val, Leu, or Gly
  SITE (521)..(521): Xaa at position 521 is Met, Ile, Leu, Val, Ala, or Gly
  SITE (527)..(527): Xaa at position 527 is Phe, Tyr, Met, His, Ile, Leu, Val Ala, or Gly
  SITE (535)..(535): Xaa at position 535 is Ile, Ala, Val, Leu, or Gly
  SITE (539)..(539): Xaa at position 539 is Trp, Tyr, Phe, Met, His, Ile, Leu Val, Ala, or Gly
  SITE (540)..(540): Xaa at position 540 is Leu, Ala, Val, Gly, or Ile
  SITE (542)..(542): Xaa at position 542 is Leu, Ala, Val, Gly, or Ile
  SITE (543)..(543): Xaa at position 543 is Cys, Ala, Val, Gly, Ser, or Thr
  SITE (544)..(544): Xaa at position 544 is Ile, Ala, Val, Leu, or Gly
  SITE (551)..(551): Xaa at position 551 is Ala, Gly, or Pro
  SITE (554)..(554): Xaa at position 554 is Leu, Ala, Val, Gly, or Ile
  SITE (555)..(555): Xaa at position 555 is Ala, Gly, or Pro
  SITE (559)..(559): Xaa at position 559 is Ala, Gly, or Pro
  SITE (567)..(567): Xaa at position 567 is Phe, Tyr, Met, His, Ile, Leu, Val Ala, or Gly
  SITE (571)..(571): Xaa at position 571 is Leu, Ala, Val, Gly, or Ile
  SITE (572)..(572): Xaa at position 572 is Phe, Tyr, Met, His, Ile, Leu, Val Ala, or Gly
  SITE (575)..(575): Xaa at position 575 is Leu, Ala, Val, Gly, or Ile
  SITE (585)..(585): Xaa at position 585 is Ala, Gly, or Pro
  SITE (589)..(589): Xaa at position 589 is Tyr, Phe, Met, His, Ile, Leu, Val Ala, or Gly
  SITE (597)..(597): Xaa at position 597 is His, Phe, Tyr, Lys, Arg, Gly, Ser Thr, Ala, Val, Leu, Ile, Asn, Met, or Gln
  SITE (603)..(603): Xaa at position 603 is Leu, Ala, Val, Gly, or Ile
  SITE (604)..(604): Xaa at position 604 is Val, Ala, Gly, Leu, or Ile
MPEIVDTXSLASPASXXRTKHXHLRCSXDFTRRTXTGTXAXTXQSQEDNLRSXVXDTKDLTIEKXVXNGQEVKYALGERQSYKGSPXEXSLPIXXSKNQEIVXEXSXETSPKSSXXQWXTPEQTSGKEHPXXXSQXQXIHXRXIXPXQDTPSXKLTXTXEXSXPKEXVXXMSXIRDGETPDPEDPSRKIYKXIQKVPXPXXXIXLXXGALESRQIGPRTLXWSEKEQXEKSAYEXSETESXXKIXEDXGGPYVWGQYDXXXXPPSXPYGGMENPXXTXXTPTXLAGDKSLSNVXXHEXSXSXTGNLXTNKTXDHFXXNEGXTVXXERXXCGRLFGEKFRHFNXXGGWGEXQNSVKTFGETHPFTKXVVDXTDIDPDVAYSSXPYEKGXXXXXYXEQXXGGPEIXLGXXKAXXEKFSYKSXTTDDXKDFXYSYFKDKVDVXNQVDWNAXLYSPGLPPIKPNYDMTLTNAXIALSQRXITAKEDDLNSXNATDLKDLSSHQLNEXXAQTLQRAPLPLGHXKRXQEVYNXNAINNSEXRFRXXRXXXQSKWEDXIPXXLKMXTEQGRMKXTRPXXKDXAAFDKSHDQXVRTXQEHKASMXPVTAMXXGKDLKVD

SEQ ID NO: 265 - protein, 1744 aa, Homo sapiens
  SITE (24)..(24): Xaa at position 24 is Leu, Ala, Val, Gly, or Ile
  SITE (25)..(25): Xaa at position 25 is Leu, Ala, Val, Gly, or Ile
  SITE (26)..(26): Xaa at position 26 is Phe, Tyr, Met, His, Ile, Leu, Val Ala, or Gly
  SITE (31)..(31): Xaa at position 31 is Val, Ala, Gly, Leu, or Ile
  SITE (37)..(37): Xaa at position 37 is Leu, Ala, Val, Gly, or Ile
  SITE (39)..(39): Xaa at position 39 is Val, Ala, Gly, Leu, or Ile
  SITE (41)..(41): Xaa at position 41 is Val, Ala, Gly, Leu, or Ile
  SITE (43)..(43): Xaa at position 43 is Leu, Ala, Val, Gly, or Ile
  SITE (52)..(52): Xaa at position 52 is Val, Ala, Gly, Leu, or Ile
  SITE (56)..(56): Xaa at position 56 is Val, Ala, Gly, Leu, or Ile
  SITE (76)..(76): Xaa at position 76 is Leu, Ala, Val, Gly, or Ile
  SITE (87)..(87): Xaa at position 87 is Leu, Ala, Val, Gly, or Ile
  SITE (94)..(94): Xaa at position 94 is Ala, Gly, or Pro
  SITE (110)..(110): Xaa at position 110 is Leu, Ala, Val, Gly, or Ile
  SITE (111)..(111): Xaa at position 111 is Val, Ala, Gly, Leu, or Ile
  SITE (112)..(112): Xaa at position 112 is Ala, Gly, or Pro
  SITE (130)..(130): Xaa at position 130 is Ile, Ala, Val, Leu, or Gly
  SITE (132)..(132): Xaa at position 132 is Leu, Ala, Val, Gly, or Ile
  SITE (149)..(149): Xaa at position 149 is Ile, Ala, Val, Leu, or Gly
  SITE (150)..(150): Xaa at position 150 is Tyr, Phe, Met, His, Ile, Leu, Val Ala, or Gly
  SITE (156)..(156): Xaa at position 156 is Val, Ala, Gly, Leu, or Ile
  SITE (158)..(158): Xaa at position 158 is Tyr, Phe, Met, His, Ile, Leu, Val Ala, or Gly
  SITE (160)..(160): Xaa at position 160 is Val, Ala, Gly, Leu, or Ile
  SITE (162)..(162): Xaa at position 162 is Ala, Gly, or Pro
  SITE (174)..(174): Xaa at position 174 is Ile, Ala, Val, Leu, or Gly
  SITE (176)..(176): Xaa at position 176 is Val, Ala, Gly, Leu, or Ile
  SITE (178)..(178): Xaa at position 178 is Val, Ala, Gly, Leu, or Ile
  SITE (215)..(215): Xaa at position 215 is Ile, Ala, Val, Leu, or Gly
  SITE (217)..(217): Xaa at position 217 is Ala, Gly, or Pro
  SITE (219)..(219): Xaa at position 219 is Phe, Tyr, Met, His, Ile, Leu, Val Ala, or Gly
  SITE (231)..(231): Xaa at position 231 is Phe, Tyr, Met, His, Ile, Leu, Val Ala, or Gly
  SITE (233)..(233): Xaa at position 233 is Val, Ala, Gly, Leu, or Ile
  SITE (241)..(241): Xaa at position 241 is Phe, Tyr, Met, His, Ile, Leu, Val Ala, or Gly
  SITE (252)..(252): Xaa at position 252 is Ile, Ala, Val, Leu, or Gly
  SITE (266)..(266): Xaa at position 266 is Ile, Ala, Val, Leu, or Gly
  SITE (268)..(268): Xaa at position 268 is Ala, Gly, or Pro
  SITE (271)..(271): Xaa at position 271 is Ile, Ala, Val, Leu, or Gly
  SITE (276)..(276): Xaa at position 276 is Val, Ala, Gly, Leu, or Ile
  SITE (280)..(280): Xaa at position 280 is Ala, Gly, or Pro
  SITE (282)..(282): Xaa at position 282 is Val, Ala, Gly, Leu, or Ile
  SITE (286)..(286): Xaa at position 286 is Leu, Ala, Val, Gly, or Ile
  SITE (305)..(305): Xaa at position 305 is Leu, Ala, Val, Gly, or Ile
  SITE (319)..(319): Xaa at position 319 is Phe, Tyr, Met, His, Ile, Leu, Val Ala, or Gly
  SITE (340)..(340): Xaa at position 340 is Val, Ala, Gly, Leu, or Ile
  SITE (341)..(341): Xaa at position 341 is Ala, Gly, or Pro
  SITE (343)..(343): Xaa at position 343 is Ala, Gly, or Pro
  SITE (345)..(345): Xaa at position 345 is Ile, Ala, Val, Leu, or Gly
  SITE (378)..(378): Xaa at position 378 is Leu, Ala, Val, Gly, or Ile
  SITE (382)..(382): Xaa at position 382 is Ala, Gly, or Pro
  SITE (386)..(386): Xaa at position 386 is Leu, Ala, Val, Gly, or Ile
  SITE (390)..(390): Xaa at position 390 is Val, Ala, Gly, Leu, or Ile
  SITE (403)..(403): Xaa at position 403 is Val, Ala, Gly, Leu, or Ile
  SITE (405)..(405): Xaa at position 405 is Val, Ala, Gly, Leu, or Ile
  SITE (407)..(407): Xaa at position 407 is Ala, Gly, or Pro
  SITE (409)..(409): Xaa at position 409 is Val, Ala, Gly, Leu, or Ile
  SITE (431)..(431): Xaa at position 431 is Val, Ala, Gly, Leu, or Ile
  SITE (433)..(433): Xaa at position 433 is Ile, Ala, Val, Leu, or Gly
  SITE (435)..(435): Xaa at position 435 is Ile, Ala, Val, Leu, or Gly
  SITE (444)..(444): Xaa at position 444 is Leu, Ala, Val, Gly, or Ile
  SITE (450)..(450): Xaa at position 450 is Ala, Gly, or Pro
  SITE (462)..(462): Xaa at position 462 is Val, Ala, Gly, Leu, or Ile
  SITE (473)..(473): Xaa at position 473 is Leu, Ala, Val, Gly, or Ile
  SITE (491)..(491): Xaa at position 491 is Leu, Ala, Val, Gly, or Ile
  SITE (508)..(508): Xaa at position 508 is Met, Ile, Leu, Val, Ala, or Gly
  SITE (510)..(510): Xaa at position 510 is Leu, Ala, Val, Gly, or Ile
  SITE (529)..(529): Xaa at position 529 is Val, Ala, Gly, Leu, or Ile
  SITE (533)..(533): Xaa at position 533 is Val, Ala, Gly, Leu, or Ile
  SITE (541)..(541): Xaa at position 541 is Phe, Tyr, Met, His, Ile, Leu, Val Ala, or Gly
  SITE (543)..(543): Xaa at position 543 is Phe, Tyr, Met, His, Ile, Leu, Val Ala, or Gly
  SITE (544)..(544): Xaa at position 544 is Val, Ala, Gly, Leu, or Ile
  SITE (545)..(545): Xaa at position 545 is Ala, Gly, or Pro
  SITE (546)..(546): Xaa at position 546 is Phe, Tyr, Met, His, Ile, Leu, Val Ala, or Gly
  SITE (547)..(547): Xaa at position 547 is Tyr, Phe, Met, His, Ile, Leu, Val Ala, or Gly
  SITE (560)..(560): Xaa at position 560 is Val, Ala, Gly, Leu, or Ile
  SITE (564)..(564): Xaa at position 564 is Ala, Gly, or Pro
  SITE (633)..(633): Xaa at position 633 is Leu, Ala, Val, Gly, or Ile
  SITE (646)..(646): Xaa at position 646 is Val, Ala, Gly, Leu, or Ile
  SITE (647)..(647): Xaa at position 647 is Phe, Tyr, Met, His, Ile, Leu, Val Ala, or Gly
  SITE (652)..(652): Xaa at position 652 is Leu, Ala, Val, Gly, or Ile
  SITE (654)..(654): Xaa at position 654 is Phe, Tyr, Met, His, Ile, Leu, Val Ala, or Gly
  SITE (687)..(687): Xaa at position 687 is Ile, Ala, Val, Leu, or Gly
  SITE (703)..(703): Xaa at position 703 is Cys, Ala, Val, Gly, Ser, or Thr
  SITE (720)..(720): Xaa at position 720 is Ala, Gly, or Pro
  SITE (735)..(735): Xaa at position 735 is Cys, Ala, Val, Gly, Ser, or Thr
  SITE (739)..(739): Xaa at position 739 is Ala, Gly, or Pro
  SITE (833)..(833): Xaa at position 833 is Phe, Tyr, Met, His, Ile, Leu, Val Ala, or Gly
  SITE (835)..(835): Xaa at position 835 is Leu, Ala, Val, Gly, or Ile
  SITE (837)..(837): Xaa at position 837 is Leu, Ala, Val, Gly, or Ile
  SITE (855)..(855): Xaa at position 855 is Leu, Ala, Val, Gly, or Ile
  SITE (863)..(863): Xaa at position 863 is Leu, Ala, Val, Gly, or Ile
  SITE (865)..(865): Xaa at position 865 is Val, Ala, Gly, Leu, or Ile
  SITE (867)..(867): Xaa at position 867 is Val, Ala, Gly, Leu, or Ile
  SITE (889)..(889): Xaa at position 889 is Val, Ala, Gly, Leu, or Ile
  SITE (897)..(897): Xaa at position 897 is Val, Ala, Gly, Leu, or Ile
  SITE (901)..(901): Xaa at position 901 is Val, Ala, Gly, Leu, or Ile
  SITE (913)..(913): Xaa at position 913 is Val, Ala, Gly, Leu, or Ile
  SITE (914)..(914): Xaa at position 914 is Val, Ala, Gly, Leu, or Ile
  SITE (915)..(915): Xaa at position 915 is Ala, Gly, or Pro
  SITE (927)..(927): Xaa at position 927 is Val, Ala, Gly, Leu, or Ile
  SITE (931)..(931): Xaa at position 931 is Leu, Ala, Val, Gly, or Ile
  SITE (945)..(945): Xaa at position 945 is Val, Ala, Gly, Leu, or Ile
  SITE (948)..(948): Xaa at position 948 is Leu, Ala, Val, Gly, or Ile
  SITE (978)..(978): Xaa at position 978 is Val, Ala, Gly, Leu, or Ile
  SITE (980)..(980): Xaa at position 980 is Val, Ala, Gly, Leu, or Ile
  SITE (994)..(994): Xaa at position 994 is Ala, Gly, or Pro
  SITE (995)..(995): Xaa at position 995 is Leu, Ala, Val, Gly, or Ile
  SITE (1000)..(1000): Xaa at position 1000 is Val, Ala, Gly, Leu, or Ile
  SITE (1001)..(1001): Xaa at position 1001 is Ala, Gly, or Pro
  SITE (1015)..(1015): Xaa at position 1015 is Met, Ile, Leu, Val, Ala, or Gly
  SITE (1016)..(1016): Xaa at position 1016 is Ile, Ala, Val, Leu, or Gly
  SITE (1018)..(1018): Xaa at position 1018 is Leu, Ala, Val, Gly, or Ile
  SITE (1019)..(1019): Xaa at position 1019 is Ala, Gly, or Pro
  SITE (1023)..(1023): Xaa at position 1023 is Ala, Gly, or Pro
  SITE (1024)..(1024): Xaa at position 1024 is Ala, Gly, or Pro
  SITE (1027)..(1027): Xaa at position 1027 is Tyr, Phe, Met, His, Ile, Leu Val, Ala, or Gly
  SITE (1028)..(1028): Xaa at position 1028 is Leu, Ala, Val, Gly, or Ile
  SITE (1045)..(1045): Xaa at position 1045 is Ala, Gly, or Pro
  SITE (1049)..(1049): Xaa at position 1049 is Ile, Ala, Val, Leu, or Gly
  SITE (1056)..(1056): Xaa at position 1056 is Ile, Ala, Val, Leu, or Gly
  SITE (1066)..(1066): Xaa at position 1066 is Tyr, Phe, Met, His, Ile, Leu Val, Ala, or Gly
  SITE (1067)..(1067): Xaa at position 1067 is Ala, Gly, or Pro
  SITE (1068)..(1068): Xaa at position 1068 is Ala, Gly, or Pro
  SITE (1077)..(1077): Xaa at position 1077 is Trp, Tyr, Phe, Met, His, Ile Leu, Val, Ala, or Gly
  SITE (1078)..(1078): Xaa at position 1078 is Leu, Ala, Val, Gly, or Ile
  SITE (1080)..(1080): Xaa at position 1080 is Ala, Gly, or Pro
  SITE (1082)..(1082): Xaa at position 1082 is Val, Ala, Gly, Leu, or Ile
  SITE (1083)..(1083): Xaa at position 1083 is Leu, Ala, Val, Gly, or Ile
  SITE (1085)..(1085): Xaa at position 1085 is Val, Ala, Gly, Leu, or Ile
  SITE (1086)..(1086): Xaa at position 1086 is Leu, Ala, Val, Gly, or Ile
  SITE (1089)..(1089): Xaa at position 1089 is Ala, Gly, or Pro
  SITE (1107)..(1107): Xaa at position 1107 is Leu, Ala, Val, Gly, or Ile
  SITE (1117)..(1117): Xaa at position 1117 is Phe, Tyr, Met, His, Ile, Leu Val, Ala, or Gly
  SITE (1132)..(1132): Xaa at position 1132 is Leu, Ala, Val, Gly, or Ile
  SITE (1139)..(1139): Xaa at position 1139 is Val, Ala, Gly, Leu, or Ile
  SITE (1140)..(1140): Xaa at position 1140 is Ala, Gly, or Pro
  SITE (1141)..(1141): Xaa at position 1141 is Leu, Ala, Val, Gly, or Ile
  SITE (1143)..(1143): Xaa at position 1143 is Ala, Gly, or Pro
  SITE (1144)..(1144): Xaa at position 1144 is Phe, Tyr, Met, His, Ile, Leu Val, Ala, or Gly
  SITE (1145)..(1145): Xaa at position 1145 is Val, Ala, Gly, Leu, or Ile
  SITE (1147)..(1147): Xaa at position 1147 is Ile, Ala, Val, Leu, or Gly
  SITE (1148)..(1148): Xaa at position 1148 is Ala, Gly, or Pro
  SITE (1149)..(1149): Xaa at position 1149 is Leu, Ala, Val, Gly, or Ile
  SITE (1168)..(1168): Xaa at position 1168 is Val, Ala, Gly, Leu, or Ile
  SITE (1175)..(1175): Xaa at position 1175 is Ala, Gly, or Pro
  SITE (1179)..(1179): Xaa at position 1179 is Leu, Ala, Val, Gly, or Ile
  SITE (1192)..(1192): Xaa at position 1192 is Ala, Gly, or Pro
  SITE (1193)..(1193): Xaa at position 1193 is Ala, Gly, or Pro
  SITE (1194)..(1194): Xaa at position 1194 is Ala, Gly, or Pro
  SITE (1195)..(1195): Xaa at position 1195 is Ile, Ala, Val, Leu, or Gly
  SITE (1197)..(1197): Xaa at position 1197 is Ala, Gly, or Pro
  SITE (1199)..(1199): Xaa at position 1199 is Ala, Gly, or Pro
  SITE (1200)..(1200): Xaa at position 1200 is Leu, Ala, Val, Gly, or Ile
  SITE (1205)..(1205): Xaa at position 1205 is Ala, Gly, or Pro
  SITE (1210)..(1210): Xaa at position 1210 is Leu, Ala, Val, Gly, or Ile
  SITE (1213)..(1213): Xaa at position 1213 is Ala, Gly, or Pro
  SITE (1217)..(1217): Xaa at position 1217 is Leu, Ala, Val, Gly, or Ile
  SITE (1230)..(1230): Xaa at position 1230 is Trp, Tyr, Phe, Met, His, Ile Leu, Val, Ala, or Gly
  SITE (1262)..(1262): Xaa at position 1262 is Ile, Ala, Val, Leu, or Gly
  SITE (1266)..(1266): Xaa at position 1266 is Ala, Gly, or Pro
  SITE (1267)..(1267): Xaa at position 1267 is Tyr, Phe, Met, His, Ile, Leu Val, Ala, or Gly
  SITE (1268)..(1268): Xaa at position 1268 is Ala, Gly, or Pro
  SITE (1269)..(1269): Xaa at position 1269 is Leu, Ala, Val, Gly, or Ile
  SITE (1271)..(1271): Xaa at position 1271 is His, Phe, Tyr, Lys, Arg, Gly Ser, Thr, Ala, Val, Leu, Ile, Asn, Met, or Gln
  SITE (1282)..(1282): Xaa at position 1282 is Ala, Gly, or Pro
  SITE (1285)..(1285): Xaa at position 1285 is Ala, Gly, or Pro
  SITE (1289)..(1289): Xaa at position 1289 is Leu, Ala, Val, Gly, or Ile
  SITE (1306)..(1306): Xaa at position 1306 is Val, Ala, Gly, Leu, or Ile
  SITE (1307)..(1307): Xaa at position 1307 is Ile, Ala, Val, Leu, or Gly
  SITE (1308)..(1308): Xaa at position 1308 is Ala, Gly, or Pro
  SITE (1311)..(1311): Xaa at position 1311 is Ala, Gly, or Pro
  SITE (1327)..(1327): Xaa at position 1327 is Leu, Ala, Val, Gly, or Ile
  SITE (1329)..(1329): Xaa at position 1329 is Val, Ala, Gly, Leu, or Ile
  SITE (1331)..(1331): Xaa at position 1331 is Leu, Ala, Val, Gly, or Ile
  SITE (1358)..(1358): Xaa at position 1358 is Leu, Ala, Val, Gly, or Ile
  SITE (1366)..(1366): Xaa at position 1366 is Ile, Ala, Val, Leu, or Gly
  SITE (1368)..(1368): Xaa at position 1368 is Val, Ala, Gly, Leu, or Ile
  SITE (1378)..(1378): Xaa at position 1378 is Leu, Ala, Val, Gly, or Ile
  SITE (1384)..(1384): Xaa at position 1384 is Tyr, Phe, Met, His, Ile, Leu Val, Ala, or Gly
  SITE (1501)..(1501): Xaa at position 1501 is Leu, Ala, Val, Gly, or Ile
  SITE (1512)..(1512): Xaa at position 1512 is Val, Ala, Gly, Leu, or Ile
  SITE (1522)..(1522): Xaa at position 1522 is Val, Ala, Gly, Leu, or Ile
  SITE (1524)..(1524): Xaa at position 1524 is Leu, Ala, Val, Gly, or Ile
  SITE (1538)..(1538): Xaa at position 1538 is Phe, Tyr, Met, His, Ile, Leu Val, Ala, or Gly
  SITE (1540)..(1540): Xaa at position 1540 is Ala, Gly, or Pro
  SITE (1578)..(1578): Xaa at position 1578 is Leu, Ala, Val, Gly, or Ile
  SITE (1617)..(1617): Xaa at position 1617 is Ala, Gly, or Pro
  SITE (1625)..(1625): Xaa at position 1625 is Tyr, Phe, Met, His, Ile, Leu Val, Ala, or Gly
  SITE (1627)..(1627): Xaa at position 1627 is Phe, Tyr, Met, His, Ile, Leu Val, Ala, or Gly
  SITE (1629)..(1629): Xaa at position 1629 is Val, Ala, Gly, Leu, or Ile
  SITE (1643)..(1643): Xaa at position 1643 is Phe, Tyr, Met, His, Ile, Leu Val, Ala, or Gly
  SITE (1647)..(1647): Xaa at position 1647 is Ile, Ala, Val, Leu, or Gly
  SITE (1667)..(1667): Xaa at position 1667 is Phe, Tyr, Met, His, Ile, Leu Val, Ala, or Gly
  SITE (1669)..(1669): Xaa at position 1669 is Val, Ala, Gly, Leu, or Ile
  SITE (1683)..(1683): Xaa at position 1683 is Tyr, Phe, Met, His, Ile, Leu Val, Ala, or Gly
  SITE (1684)..(1684): Xaa at position 1684 is Leu, Ala, Val, Gly, or Ile
  SITE (1685)..(1685): Xaa at position 1685 is Ile, Ala, Val, Leu, or Gly
  SITE (1686)..(1686): Xaa at position 1686 is Met, Ile, Leu, Val, Ala, or Gly
  SITE (1701)..(1701): Xaa at position 1701 is Tyr, Phe, Met, His, Ile, Leu Val, Ala, or Gly
MRLLWGLIWASSFFTLSLQKPRLXXXSPSVXHLGVPXSXGXQXQDVPRGQVXKGSXFLRNPSRNNVPCSPKVDFTXSSERDFALLSXQVPLKDXKSCGLHQLLRGPEVQXXXHSPWLKDSLSRTTNIQGXNXLFSSRRGHLFLQTDQPXXNPGQRXRXRXFXLDQKMRPSTDTXTXMXENSHGLRVRKKEVYMPSSIFQDDFVIPDISEPGTWKXSXRXSDGLESNSSTQXEXKKYVLPNXEVKITPGKPYXLTVPGHLDEMQLDXQXRYXYGKPXQGVXYXRFGXLDEDGKKTFFRGLESQTKXVNGQSHISLSKAEXQDALEKLNMGITDLQGLRLYXXAXIXESPGGEMEEAELTSWYFVSSPFSLDLSKTKRHXVPGXPFLXQALXREMSGSPASGIPXKXSXTXSSPGSVPEVQDIQQNTDGSGQXSXPXIIPQTISEXQLSVSXGSPHPAIARLTXAAPPSGGPGFXSIERPDSRPPRVGDTLNXNLRAVGSGATFSHYYYXIXSRGQIVFMNREPKRTLTSXSVFXDHHLAPSXYXXXXXYHGDHPVANSLRXDVQXGACEGKLELSVDGAKQYRNGESVKLHLETDSLALVALGALDTALYAAGSKSHKPLNMGKVFEAMNSYDXGCGPGGGDSALQXXQAAGXAXSDGDQWTLSRKRLSCPKEKTTRKKRNVNFQKAXNEKLGQYASPTAKRCXQDGVTRLPMMRSCEQRXARVQQPDCREPFLSXCQFXESLRKKSRDKGQAGLQRALEILQEEDLIDEDDIPVRSFFPENWLWRVETVDRFQILTLWLPDSLTTWEIHGLSLSKTKGLCVATPVQLRVFREXHXHXRLPMSVRRFEQLELRPVXYNYLDKNXTXSXHVSPVEGLCLAGGGGLAQQVLXPAGSARPXAFSXVPTAAAAVSLKXXXRGSFEFPVGDAXSKVXQIEKEGAIHREELXYEXNPLDHRGRTLEIPGNSDPNMIPDGDFNSYXRXTASDPLDTLGSEGXXSPGGXXSLLRLPRGCGEQTXXYXXPTLXXSRXXDKTEQWSTLPPETKDHXVDLXQKGYMRXQQFRKADGSXXXWLSRDSSTXXTXFXXKXXSLXQEQVGGSPEKLQETSNWXLSQQQADGSXQDPCPVLDRSMQGGXVGNDETXXXTXXXTXXXHHGLAVFQDEGAEPLKQRXEASISKXNSFXGEKASAGLLGAHXXXXTXYXXTLTKXPVDLXGVXHNNXMAMAQETGDNLYXGSVTGSQSNAVSPTPAPRNPSDPMPQAPALWXETTXXXXLXLLLHEGKAEMXDQXSAWXTRQGSFQGGFRSTQDTXXXLDXLSAYWIASHTTEERGXNXTXSSTGRNGFKSHALQLNNRQIRGLEEEXQFSLGSKXNXKVGGNSKGTXKVLRTXNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADXEKLTSLSDRYXSHFETEGPHXLXYFDSVPTSRECVGXEXVQEVPVGLVQPASATLYDYYNPERRCSVFYGAPSKSRXLATLCSAEVCQCAEGKCPRQRRALERGLQDEDGYRMKFXCYYPRVEXGXQXKVLREDSRAAFRLXETKXTQVLHFTKDVKAAANQMRNXLXRASCRLRLEPGKEXXXXGLDGATYDLEGHPQXLLDSNSWIEEMPSERLCRSTRQRAACAQLNDFLQEYGTQGCQV

SEQ ID NO: 266 - protein, 1744 aa, Homo sapiens
  SITE (43)..(43): Xaa at position 43 is Leu, Ala, Val, Gly, or Ile
  SITE (149)..(149): Xaa at position 149 is Ile, Ala, Val, Leu, or Gly
  SITE (271)..(271): Xaa at position 271 is Ile, Ala, Val, Leu, or Gly
  SITE (305)..(305): Xaa at position 305 is Leu, Ala, Val, Gly, or Ile
  SITE (409)..(409): Xaa at position 409 is Val, Ala, Gly, Leu, or Ile
  SITE (510)..(510): Xaa at position 510 is Leu, Ala, Val, Gly, or Ile
  SITE (564)..(564): Xaa at position 564 is Ala, Gly, or Pro
  SITE (652)..(652): Xaa at position 652 is Leu, Ala, Val, Gly, or Ile
  SITE (1366)..(1366): Xaa at position 1366 is Ile, Ala, Val, Leu, or Gly
MRLLWGLIWASSFFTLSLQKPRLLLFSPSVVHLGVPLSVGVQXQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPXYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYXYGKPVQGVAYVRFGLLDEDGKKTFFRGLESQTKXVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATXSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMIXSRGQIVFMNREPKRTLTSVSVFVDHHLAPSFYFVAFYYHGDHPVANSLRVDVQXGACEGKLELSVDGAKQYRNGESVKLHLETDSLALVALGALDTALYAAGSKSHKPLNMGKVFEAMNSYDLGCGPGGGDSALQVFQAAGXAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKXNVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 267 - protein, 122 aa, Homo sapiens
  SITE (35)..(35): Xaa at position 35 is Met, Ile, Leu, Val, Ala, or Gly
  SITE (38)..(38): Xaa at position 38 is Ala, Gly, or Pro
  SITE (54)..(54): Xaa at position 54 is Phe, Tyr, Met, His, Ile, Leu, Val Ala, or Gly
  SITE (56)..(56): Xaa at position 56 is Ala, Gly, or Pro
  SITE (62)..(62): Xaa at position 62 is Ala, Gly, or Pro
  SITE (72)..(72): Xaa at position 72 is Ala, Gly, or Pro
  SITE (73)..(73): Xaa at position 73 is Ala, Gly, or Pro
  SITE (99)..(99): Xaa at position 99 is Ala, Gly, or Pro
  SITE (100)..(100): Xaa at position 100 is Ala, Gly, or Pro
MKLLTGLVFCSLVLGVSSRSFFSFLGEAFDGARDXWRXYSDMREANYIGSDKYXHXRGNYDXAKRGPGGVWXXEAISDARENIQRFFGHGAEDSLADQXXNEWGRSGKDPNHFRPAGLPEKY

SEQ ID NO: 268 - protein, 122 aa, Homo sapiens
  SITE (72)..(72): Xaa at position 72 is Ala, Gly, or Pro
  SITE (99)..(99): Xaa at position 99 is Ala, Gly, or Pro
MKLLTGLVFCSLVLSVSSRSFFSFLGEAFDGARDMWRAYSDMREANYIGSDKYFHARGNYDAAKRGPGGAWXAEVISNARENIQRLTGRGAEDSLADQXANKWGRSGRDPNHFRPAGLPEKY

SEQ ID NO: 269 - protein, 1580 aa, Homo sapiens
  SITE (548)..(548): Xaa at position 548 is Cys, Ala, Val, Gly, Ser, or Thr
  SITE (563)..(563): Xaa at position 563 is Leu, Ala, Val, Gly, or Ile
  SITE (578)..(578): Xaa at position 578 is Cys, Ala, Val, Gly, Ser, or Thr
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPTAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKXTFEGCTKAYSRLENXKTHLRSHTGEKPYVXEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDAPGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 270 - protein, 366 aa, Homo sapiens
  SITE (29)..(29): Xaa at position 29 is Met, Ile, Leu, Val, Ala, or Gly
  SITE (31)..(31): Xaa at position 31 is Tyr, Phe, Met, His, Ile, Leu, Val Ala, or Gly
  SITE (35)..(35): Xaa at position 35 is Ala, Gly, or Pro
  SITE (46)..(46): Xaa at position 46 is Phe, Tyr, Met, His, Ile, Leu, Val Ala, or Gly
  SITE (52)..(52): Xaa at position 52 is Val, Ala, Gly, Leu, or Ile
  SITE (57)..(57): Xaa at position 57 is Phe, Tyr, Met, His, Ile, Leu, Val Ala, or Gly
  SITE (58)..(58): Xaa at position 58 is Val, Ala, Gly, Leu, or Ile
  SITE (60)..(60): Xaa at position 60 is Phe, Tyr, Met, His, Ile, Leu, Val Ala, or Gly
  SITE (73)..(73): Xaa at position 73 is Ala, Gly, or Pro
  SITE (75)..(75): Xaa at position 75 is Trp, Tyr, Phe, Met, His, Ile, Leu Val, Ala, or Gly
  SITE (76)..(76): Xaa at position 76 is Val, Ala, Gly, Leu, or Ile
  SITE (83)..(83): Xaa at position 83 is Tyr, Phe, Met, His, Ile, Leu, Val Ala, or Gly
  SITE (91)..(91): Xaa at position 91 is Tyr, Phe, Met, His, Ile, Leu, Val Ala, or Gly
  SITE (95)..(95): Xaa at position 95 is Ala, Gly, or Pro
  SITE (102)..(102): Xaa at position 102 is Leu, Ala, Val, Gly, or Ile
  SITE (105)..(105): Xaa at position 105 is Leu, Ala, Val, Gly, or Ile
  SITE (119)..(119): Xaa at position 119 is Leu, Ala, Val, Gly, or Ile
  SITE (122)..(122): Xaa at position 122 is Met, Ile, Leu, Val, Ala, or Gly
  SITE (125)..(125): Xaa at position 125 is Cys, Ala, Val, Gly, Ser, or Thr
  SITE (127)..(127): Xaa at position 127 is Leu, Ala, Val, Gly, or Ile
  SITE (142)..(142): Xaa at position 142 is Tyr, Phe, Met, His, Ile, Leu, Val Ala, or Gly
  SITE (147)..(147): Xaa at position 147 is Tyr, Phe, Met, His, Ile, Leu, Val Ala, or Gly
  SITE (148)..(148): Xaa at position 148 is Ile, Ala, Val, Leu, or Gly
  SITE (150)..(150): Xaa at position 150 is Leu, Ala, Val, Gly, or Ile
  SITE (154)..(154): Xaa at position 154 is Leu, Ala, Val, Gly, or Ile
  SITE (157)..(157): Xaa at position 157 is Trp, Tyr, Phe, Met, His, Ile, Leu Val, Ala, or Gly
  SITE (163)..(163): Xaa at position 163 is Ala, Gly, or Pro
  SITE (164)..(164): Xaa at position 164 is Ala, Gly, or Pro
  SITE (176)..(176): Xaa at position 176 is Ala, Gly, or Pro
  SITE (177)..(177): Xaa at position 177 is Ala, Gly, or Pro
  SITE (184)..(184): Xaa at position 184 is Leu, Ala, Val, Gly, or Ile
  SITE (188)..(188): Xaa at position 188 is Cys, Ala, Val, Gly, Ser, or Thr
  SITE (189)..(189): Xaa at position 189 is Val, Ala, Gly, Leu, or Ile
  SITE (192)..(192): Xaa at position 192 is Leu, Ala, Val, Gly, or Ile
  SITE (195)..(195): Xaa at position 195 is Tyr, Phe, Met, His, Ile, Leu, Val Ala, or Gly
  SITE (196)..(196): Xaa at position 196 is Leu, Ala, Val, Gly, or Ile
  SITE (203)..(203): Xaa at position 203 is Leu, Ala, Val, Gly, or Ile
  SITE (213)..(213): Xaa at position 213 is Val, Ala, Gly, Leu, or Ile
  SITE (223)..(223): Xaa at position 223 is Ala, Gly, or Pro
  SITE (225)..(225): Xaa at position 225 is Leu, Ala, Val, Gly, or Ile
  SITE (227)..(227): Xaa at position 227 is Cys, Ala, Val, Gly, Ser, or Thr
  SITE (229)..(229): Xaa at position 229 is Ala, Gly, or Pro
  SITE (232)..(232): Xaa at position 232 is Phe, Tyr, Met, His, Ile, Leu, Val Ala, or Gly
  SITE (233)..(233): Xaa at position 233 is Tyr, Phe, Met, His, Ile, Leu, Val Ala, or Gly
  SITE (239)..(239): Xaa at position 239 is Leu, Ala, Val, Gly, or Ile
  SITE (241)..(241): Xaa at position 241 is Trp, Tyr, Phe, Met, His, Ile, Leu Val, Ala, or Gly
  SITE (269)..(269): Xaa at position 269 is Ala, Gly, or Pro
  SITE (270)..(270): Xaa at position 270 is Ala, Gly, or Pro
  SITE (271)..(271): Xaa at position 271 is Val, Ala, Gly, Leu, or Ile
  SITE (272)..(272): Xaa at position 272 is Val, Ala, Gly, Leu, or Ile
  SITE (273)..(273): Xaa at position 273 is Val, Ala, Gly, Leu, or Ile
  SITE (281)..(281): Xaa at position 281 is Tyr, Phe, Met, His, Ile, Leu, Val Ala, or Gly
  SITE (283)..(283): Xaa at position 283 is Cys, Ala, Val, Gly, Ser, or Thr
  SITE (285)..(285): Xaa at position 285 is Met, Ile, Leu, Val, Ala, or Gly
  SITE (287)..(287): Xaa at position 287 is His, Phe, Tyr, Lys, Arg, Gly, Ser Thr, Ala, Val, Leu, Ile, Asn, Met, or Gln
MRVMAPRALLLLLSGGLALTETWACSHSXRXFDTXVSRPGRGEPRXISVGYXDDTQXXRXDSDAASPRGEPRXPXXEQEGPEXWDRETQKXKRQXQADRVSXRNXRGYYNQSEDGSHTXQRXSGXDXGPDGRLLRGYDQSAXDGKDXXAXNEDXRSXTAADTXXQITQRKLEAARXXEQLRAYXEGTXXEWXRRXXENGKETXQRAEPPKTHXTHHPLSDHEXTXRXWXLGXXPAEITXTXQRDGEDQTQDTELVETRPAGDGTFQKWXXXXXPSGQEQRXTXHXQXEGLQEPLTLSWEPSSQPTIPIMGIVAGLAVLVVLAVLGAVVTAMMCRRKSSGGKGGSCSQAACSNSAQGSDESLITCKA

SEQ ID NO: 271 - protein, 575 aa, Influenza B virus
  strain B/Bonn/1943
  SITE (50)..(50): Xaa at position 50 is Ala, Gly, or Pro
  SITE (61)..(61): Xaa at position 61 is Leu, Ala, Val, Gly, or Ile
  SITE (62)..(62): Xaa at position 62 is Cys, Ala, Val, Gly, Ser, or Thr
  SITE (65)..(65): Xaa at position 65 is Cys, Ala, Val, Gly, Ser, or Thr
  SITE (71)..(71): Xaa at position 71 is Leu, Ala, Val, Gly, or Ile
  SITE (74)..(74): Xaa at position 74 is Ala, Gly, or Pro
  SITE (75)..(75): Xaa at position 75 is Leu, Ala, Val, Gly, or Ile
  SITE (80)..(80): Xaa at position 80 is Cys, Ala, Val, Gly, Ser, or Thr
  SITE (87)..(87): Xaa at position 87 is Ala, Gly, or Pro
  SITE (89)..(89): Xaa at position 89 is Val, Ala, Gly, Leu, or Ile
  SITE (91)..(91): Xaa at position 91 is Val, Ala, Gly, Leu, or Ile
  SITE (102)..(102): Xaa at position 102 is Cys, Ala, Val, Gly, Ser, or Thr
  SITE (112)..(112): Xaa at position 112 is Ile, Ala, Val, Leu, or Gly
  SITE (115)..(115): Xaa at position 115 is Leu, Ala, Val, Gly, or Ile
  SITE (119)..(119): Xaa at position 119 is Leu, Ala, Val, Gly, or Ile
  SITE (135)..(135): Xaa at position 135 is Ala, Gly, or Pro
  SITE (143)..(143): Xaa at position 143 is Tyr, Phe, Met, His, Ile, Leu, Val Ala, or Gly
  SITE (145)..(145): Xaa at position 145 is Ile, Ala, Val, Leu, or Gly
  SITE (151)..(151): Xaa at position 151 is Cys, Ala, Val, Gly, Ser, or Thr
  SITE (161)..(161): Xaa at position 161 is Phe, Tyr, Met, His, Ile, Leu, Val Ala, or Gly
  SITE (164)..(164): Xaa at position 164 is Met, Ile, Leu, Val, Ala, or Gly
  SITE (165)..(165): Xaa at position 165 is Ala, Gly, or Pro
  SITE (166)..(166): Xaa at position 166 is Trp, Tyr, Phe, Met, His, Ile, Leu Val, Ala, or Gly
  SITE (167)..(167): Xaa at position 167 is Ala, Gly, or Pro
  SITE (168)..(168): Xaa at position 168 is Val, Ala, Gly, Leu, or Ile
  SITE (180)..(180): Xaa at position 180 is Val, Ala, Gly, Leu, or Ile
  SITE (182)..(182): Xaa at position 182 is Val, Ala, Gly, Leu, or Ile
  SITE (193)..(193): Xaa at position 193 is Ile, Ala, Val, Leu, or Gly
  SITE (195)..(195): Xaa at position 195 is Val, Ala, Gly, Leu, or Ile
  SITE (196)..(196): Xaa at position 196 is Trp, Tyr, Phe, Met, His, Ile, Leu Val, Ala, or Gly
  SITE (199)..(199): Xaa at position 199 is His, Phe, Tyr, Lys, Arg, Gly, Ser Thr, Ala, Val, Leu, Ile, Asn, Met, or Gln
  SITE (206)..(206): Xaa at position 206 is Met, Ile, Leu, Val, Ala, or Gly
  SITE (210)..(210): Xaa at position 210 is Tyr, Phe, Met, His, Ile, Leu, Val Ala, or Gly
  SITE (218)..(218): Xaa at position 218 is Phe, Tyr, Met, His, Ile, Leu, Val Ala, or Gly
  SITE (251)..(251): Xaa at position 251 is Ile, Ala, Val, Leu, or Gly
  SITE (253)..(253): Xaa at position 253 is Val, Ala, Gly, Leu, or Ile
  SITE (266)..(266): Xaa at position 266 is Ile, Ala, Val, Leu, or Gly
  SITE (268)..(268): Xaa at position 268 is Tyr, Phe, Met, His, Ile, Leu, Val Ala, or Gly
  SITE (272)..(272): Xaa at position 272 is Ile, Ala, Val, Leu, or Gly
  SITE (273)..(273): Xaa at position 273 is Leu, Ala, Val, Gly, or Ile
  SITE (274)..(274): Xaa at position 274 is Leu, Ala, Val, Gly, or Ile
  SITE (278)..(278): Xaa at position 278 is Val, Ala, Gly, Leu, or Ile
  SITE (281)..(281): Xaa at position 281 is Ala, Gly, or Pro
  SITE (288)..(288): Xaa at position 288 is Ile, Ala, Val, Leu, or Gly
  SITE (300)..(300): Xaa at position 300 is Cys, Ala, Val, Gly, Ser, or Thr
  SITE (301)..(301): Xaa at position 301 is Leu, Ala, Val, Gly, or Ile
  SITE (302)..(302): Xaa at position 302 is His, Phe, Tyr, Lys, Arg, Gly, Ser Thr, Ala, Val, Leu, Ile, Asn, Met, or Gln
  SITE (385)..(385): Xaa at position 385 is Ala, Gly, or Pro
  SITE (511)..(511): Xaa at position 511 is Ala, Gly, or Pro
LMVVTSNADRICTGITSSNSPHVVKTATQGEVNVTGVIPLTTTPTRSHFXNLKGTQTRGKXXPNXFNCTDXDVXXGRPKXMGNIPSXKXSXLHEVKPVTSGXFPIMHDRTKXRQXPNLXRGYENIRLSTSNVISXETAPGGPXKXGTSGSXPNVTNGSGFXETXXXXXPKNKTAMNPVTXEXPYICAKGEDQXTXXGFXSDSETQXGRLXGDSNPQKXTSYANGVTTHYVSQIGGFPNQTEDEGLKQSGRXVXDYIVQKPEKPGTXVXQRGXXXPQKXWCXSGRSKVXKGSLPLIGEADXXXEKYGGLNKSKPYYTGEHAKAIGNCPIWVKTPLKLANGTKYRPPAKLLKERGFFGAIAGFLEGGWEGMIDGWHGYTSHGAHGVXVAADLKSTQEAINKITKNLNSLSELEVKNLQRLSGEMDGLHNEILELDEKVDDLRADTISSQIELAVLLSNEGIINSEDEHLLALERKLKKMLGPSAVDIGNGCFETKHKCNQTCLDRIAARTFSXGEFSLPTFDSLNITAASLNDDGLDNHTILLYYSTAASSLAVTLMIAIFIVYMVSRDNVSCSICL

SEQ ID NO: 272 - protein, 480 aa, Homo sapiens
  SITE (54)..(54): Xaa at position 54 is Leu, Ala, Val, Gly, or Ile
  SITE (61)..(61): Xaa at position 61 is His, Phe, Tyr, Lys, Arg, Gly, Ser Thr, Ala, Val, Leu, Ile, Asn, Met, or Gln
  SITE (62)..(62): Xaa at position 62 is Leu, Ala, Val, Gly, or Ile
  SITE (63)..(63): Xaa at position 63 is His, Phe, Tyr, Lys, Arg, Gly, Ser Thr, Ala, Val, Leu, Ile, Asn, Met, or Gln
  SITE (64)..(64): Xaa at position 64 is Tyr, Phe, Met, His, Ile, Leu, Val Ala, or Gly
  SITE (65)..(65): Xaa at position 65 is Trp, Tyr, Phe, Met, His, Ile, Leu Val, Ala, or Gly
  SITE (66)..(66): Xaa at position 66 is Phe, Tyr, Met, His, Ile, Leu, Val Ala, or Gly
  SITE (67)..(67): Xaa at position 67 is Val, Ala, Gly, Leu, or Ile
  SITE (78)..(78): Xaa at position 78 is Val, Ala, Gly, Leu, or Ile
  SITE (79)..(79): Xaa at position 79 is Val, Ala, Gly, Leu, or Ile
  SITE (80)..(80): Xaa at position 80 is Leu, Ala, Val, Gly, or Ile
  SITE (81)..(81): Xaa at position 81 is Trp, Tyr, Phe, Met, His, Ile, Leu Val, Ala, or Gly
  SITE (82)..(82): Xaa at position 82 is Leu, Ala, Val, Gly, or Ile
  SITE (91)..(91): Xaa at position 91 is Leu, Ala, Val, Gly, or Ile
  SITE (94)..(94): Xaa at position 94 is Leu, Ala, Val, Gly, or Ile
  SITE (95)..(95): Xaa at position 95 is Leu, Ala, Val, Gly, or Ile
  SITE (98)..(98): Xaa at position 98 is His, Phe, Tyr, Lys, Arg, Gly, Ser Thr, Ala, Val, Leu, Ile, Asn, Met, or Gln
  SITE (101)..(101): Xaa at position 101 is Phe, Tyr, Met, His, Ile, Leu, Val Ala, or Gly
  SITE (117)..(117): Xaa at position 117 is Trp, Tyr, Phe, Met, His, Ile, Leu Val, Ala, or Gly
  SITE (121)..(121): Xaa at position 121 is Ala, Gly, or Pro
  SITE (123)..(123): Xaa at position 123 is Val, Ala, Gly, Leu, or Ile
  SITE (124)..(124): Xaa at position 124 is Leu, Ala, Val, Gly, or Ile
  SITE (125)..(125): Xaa at position 125 is Tyr, Phe, Met, His, Ile, Leu, Val Ala, or Gly
  SITE (132)..(132): Xaa at position 132 is Val, Ala, Gly, Leu, or Ile
  SITE (134)..(134): Xaa at position 134 is Phe, Tyr, Met, His, Ile, Leu, Val Ala, or Gly
  SITE (149)..(149): Xaa at position 149 is Val, Ala, Gly, Leu, or Ile
  SITE (156)..(156): Xaa at position 156 is Ala, Gly, or Pro
  SITE (157)..(157): Xaa at position 157 is Leu, Ala, Val, Gly, or Ile
  SITE (160)..(160): Xaa at position 160 is Phe, Tyr, Met, His, Ile, Leu, Val Ala, or Gly
  SITE (164)..(164): Xaa at position 164 is Phe, Tyr, Met, His, Ile, Leu, Val Ala, or Gly
  SITE (167)..(167): Xaa at position 167 is Tyr, Phe, Met, His, Ile, Leu, Val Ala, or Gly
  SITE (172)..(172): Xaa at position 172 is Leu, Ala, Val, Gly, or Ile
  SITE (173)..(173): Xaa at position 173 is Phe, Tyr, Met, His, Ile, Leu, Val Ala, or Gly
  SITE (174)..(174): Xaa at position 174 is Leu, Ala, Val, Gly, or Ile
  SITE (179)..(179): Xaa at position 179 is Tyr, Phe, Met, His, Ile, Leu, Val Ala, or Gly
  SITE (180)..(180): Xaa at position 180 is Ala, Gly, or Pro
  SITE (182)..(182): Xaa at position 182 is Ile, Ala, Val, Leu, or Gly
  SITE (183)..(183): Xaa at position 183 is Tyr, Phe, Met, His, Ile, Leu, Val Ala, or Gly
  SITE (184)..(184): Xaa at position 184 is Ile, Ala, Val, Leu, or Gly
  SITE (187)..(187): Xaa at position 187 is Leu, Ala, Val, Gly, or Ile
  SITE (188)..(188): Xaa at position 188 is Ala, Gly, or Pro
  SITE (189)..(189): Xaa at position 189 is Val, Ala, Gly, Leu, or Ile
  SITE (191)..(191): Xaa at position 191 is Val, Ala, Gly, Leu, or Ile
  SITE (202)..(202): Xaa at position 202 is Leu, Ala, Val, Gly, or Ile
  SITE (204)..(204): Xaa at position 204 is Val, Ala, Gly, Leu, or Ile
  SITE (208)..(208): Xaa at position 208 is Leu, Ala, Val, Gly, or Ile
  SITE (218)..(218): Xaa at position 218 is Leu, Ala, Val, Gly, or Ile
  SITE (219)..(219): Xaa at position 219 is Val, Ala, Gly, Leu, or Ile
  SITE (222)..(222): Xaa at position 222 is Ala, Gly, or Pro
  SITE (236)..(236): Xaa at position 236 is Leu, Ala, Val, Gly, or Ile
  SITE (248)..(248): Xaa at position 248 is Phe, Tyr, Met, His, Ile, Leu, Val Ala, or Gly
  SITE (256)..(256): Xaa at position 256 is Cys, Ala, Val, Gly, Ser, or Thr
  SITE (260)..(260): Xaa at position 260 is Leu, Ala, Val, Gly, or Ile
  SITE (263)..(263): Xaa at position 263 is Val, Ala, Gly, Leu, or Ile
  SITE (267)..(267): Xaa at position 267 is Val, Ala, Gly, Leu, or Ile
  SITE (297)..(297): Xaa at position 297 is Val, Ala, Gly, Leu, or Ile
  SITE (298)..(298): Xaa at position 298 is Val, Ala, Gly, Leu, or Ile
  SITE (327)..(327): Xaa at position 327 is Met, Ile, Leu, Val, Ala, or Gly
  SITE (337)..(337): Xaa at position 337 is Ala, Gly, or Pro
  SITE (340)..(340): Xaa at position 340 is Tyr, Phe, Met, His, Ile, Leu, Val Ala, or Gly
  SITE (341)..(341): Xaa at position 341 is Leu, Ala, Val, Gly, or Ile
  SITE (346)..(346): Xaa at position 346 is Val, Ala, Gly, Leu, or Ile
  SITE (350)..(350): Xaa at position 350 is Leu, Ala, Val, Gly, or Ile
  SITE (359)..(359): Xaa at position 359 is Trp, Tyr, Phe, Met, His, Ile, Leu Val, Ala, or Gly
  SITE (362)..(362): Xaa at position 362 is Cys, Ala, Val, Gly, Ser, or Thr
  SITE (366)..(366): Xaa at position 366 is Val, Ala, Gly, Leu, or Ile
  SITE (370)..(370): Xaa at position 370 is Tyr, Phe, Met, His, Ile, Leu, Val Ala, or Gly
  SITE (377)..(377): Xaa at position 377 is Met, Ile, Leu, Val, Ala, or Gly
  SITE (381)..(381): Xaa at position 381 is Tyr, Phe, Met, His, Ile, Leu, Val Ala, or Gly
  SITE (382)..(382): Xaa at position 382 is Leu, Ala, Val, Gly, or Ile
  SITE (384)..(384): Xaa at position 384 is Leu, Ala, Val, Gly, or Ile
  SITE (385)..(385): Xaa at position 385 is Leu, Ala, Val, Gly, or Ile
  SITE (393)..(393): Xaa at position 393 is Leu, Ala, Val, Gly, or Ile
  SITE (394)..(394): Xaa at position 394 is Leu, Ala, Val, Gly, or Ile
  SITE (395)..(395): Xaa at position 395 is Tyr, Phe, Met, His, Ile, Leu, Val Ala, or Gly
  SITE (401)..(401): Xaa at position 401 is Met, Ile, Leu, Val, Ala, or Gly
  SITE (411)..(411): Xaa at position 411 is Phe, Tyr, Met, His, Ile, Leu, Val Ala, or Gly
  SITE (412)..(412): Xaa at position 412 is Val, Ala, Gly, Leu, or Ile
  SITE (426)..(426): Xaa at position 426 is Trp, Tyr, Phe, Met, His, Ile, Leu Val, Ala, or Gly
  SITE (428)..(428): Xaa at position 428 is Val, Ala, Gly, Leu, or Ile
  SITE (441)..(441): Xaa at position 441 is Val, Ala, Gly, Leu, or Ile
  SITE (447)..(447): Xaa at position 447 is Ile, Ala, Val, Leu, or Gly
  SITE (448)..(448): Xaa at position 448 is Ala, Gly, or Pro
  SITE (449)..(449): Xaa at position 449 is Phe, Tyr, Met, His, Ile, Leu, Val Ala, or Gly
  SITE (450)..(450): Xaa at position 450 is Leu, Ala, Val, Gly, or Ile
  SITE (452)..(452): Xaa at position 452 is Ile, Ala, Val, Leu, or Gly
  SITE (455)..(455): Xaa at position 455 is Ala, Gly, or Pro
  SITE (457)..(457): Xaa at position 457 is His, Phe, Tyr, Lys, Arg, Gly, Ser Thr, Ala, Val, Leu, Ile, Asn, Met, or Gln
  SITE (459)..(459): Xaa at position 459 is Val, Ala, Gly, Leu, or Ile
  SITE (466)..(466): Xaa at position 466 is Ala, Gly, or Pro
  SITE (467)..(467): Xaa at position 467 is Ala, Gly, or Pro
  SITE (470)..(470): Xaa at position 470 is Met, Ile, Leu, Val, Ala, or Gly
  SITE (471)..(471): Xaa at position 471 is Phe, Tyr, Met, His, Ile, Leu, Val Ala, or Gly
  SITE (474)..(474): Xaa at position 474 is Phe, Tyr, Met, His, Ile, Leu, Val Ala, or Gly
MIRAAPPPLFLLLLLLLLLVSWASRGEAAPDQDEIQRLPGLAKQPSFRQYSGYXKGSGSKXXXXXXXESQKDPENSPXXXXXNGGPGCSSXDGXXTEXGPXLVQPDGVTLEYNPYSXNLIXNXXXLESPAGXGXSYSDDKFYATNDTEXAQSNFEXXQDXFRLXPEXKNNKXXXTGESXXGXXXPTXXXLXMQDPSMNLQGXAXGNGXSSYEQNDNSXXYFXYYHGLLGNRLWSSXQTHCCSQNKCNXYDNKDLEXVTNXQEXARIXGNSGLNIYNLYAPCAGGVPSHFRYEKDTVXXQDLGNIFTRLPLKRMWHQALLRSGDKVRXDPPCTNTTAXSTXXNNPYXRKAXNIPEQLPQXDMXNFLXNLQXRRLYRSXNSQXXKXXSSQKYQIXXXNGDVDXACNFMGDEWXXDSLNQKMEVQRRPXLXKYGDSGEQIAGFXKEFSHXXXXTXKGXGXMXPTDKPLXXFTXXSRXLNKQPY

SEQ ID NO: 273 - protein, 976 aa, Homo sapiens
  SITE (54)..(54): Xaa at position 54 is Ile, Ala, Val, Leu, or Gly
  SITE (56)..(56): Xaa at position 56 is Leu, Ala, Val, Gly, or Ile
  SITE (58)..(58): Xaa at position 58 is Cys, Ala, Val, Gly, Ser, or Thr
  SITE (66)..(66): Xaa at position 66 is Trp, Tyr, Phe, Met, His, Ile, Leu Val, Ala, or Gly
  SITE (95)..(95): Xaa at position 95 is Tyr, Phe, Met, His, Ile, Leu, Val Ala, or Gly
  SITE (97)..(97): Xaa at position 97 is Cys, Ala, Val, Gly, Ser, or Thr
  SITE (107)..(107): Xaa at position 107 is Ile, Ala, Val, Leu, or Gly
  SITE (109)..(109): Xaa at position 109 is Val, Ala, Gly, Leu, or Ile
  SITE (111)..(111): Xaa at position 111 is Val, Ala, Gly, Leu, or Ile
  SITE (118)..(118): Xaa at position 118 is Phe, Tyr, Met, His, Ile, Leu, Val Ala, or Gly
  SITE (134)..(134): Xaa at position 134 is Val, Ala, Gly, Leu, or Ile
  SITE (136)..(136): Xaa at position 136 is Cys, Ala, Val, Gly, Ser, or Thr
  SITE (170)..(170): Xaa at position 170 is Ile, Ala, Val, Leu, or Gly
  SITE (172)..(172): Xaa at position 172 is Ile, Ala, Val, Leu, or Gly
  SITE (175)..(175): Xaa at position 175 is Val, Ala, Gly, Leu, or Ile
  SITE (184)..(184): Xaa at position 184 is Leu, Ala, Val, Gly, or Ile
  SITE (186)..(186): Xaa at position 186 is Cys, Ala, Val, Gly, Ser, or Thr
  SITE (188)..(188): Xaa at position 188 is Val, Ala, Gly, Leu, or Ile
  SITE (200)..(200): Xaa at position 200 is Phe, Tyr, Met, His, Ile, Leu, Val Ala, or Gly
  SITE (202)..(202): Xaa at position 202 is Leu, Ala, Val, Gly, or Ile
  SITE (213)..(213): Xaa at position 213 is Val, Ala, Gly, Leu, or Ile
  SITE (229)..(229): Xaa at position 229 is Phe, Tyr, Met, His, Ile, Leu, Val Ala, or Gly
  SITE (231)..(231): Xaa at position 231 is Val, Ala, Gly, Leu, or Ile
  SITE (233)..(233): Xaa at position 233 is Cys, Ala, Val, Gly, Ser, or Thr
  SITE (235)..(235): Xaa at position 235 is Ile, Ala, Val, Leu, or Gly
  SITE (246)..(246): Xaa at position 246 is Trp, Tyr, Phe, Met, His, Ile, Leu Val, Ala, or Gly
  SITE (273)..(273): Xaa at position 273 is Ala, Gly, or Pro
  SITE (275)..(275): Xaa at position 275 is Leu, Ala, Val, Gly, or Ile
  SITE (280)..(280): Xaa at position 280 is Ala, Gly, or Pro
  SITE (288)..(288): Xaa at position 288 is Phe, Tyr, Met, His, Ile, Leu, Val Ala, or Gly
  SITE (290)..(290): Xaa at position 290 is Cys, Ala, Val, Gly, Ser, or Thr
  SITE (292)..(292): Xaa at position 292 is Ala, Gly, or Pro
  SITE (325)..(325): Xaa at position 325 is Val, Ala, Gly, Leu, or Ile
  SITE (333)..(333): Xaa at position 333 is Leu, Ala, Val, Gly, or Ile
  SITE (335)..(335): Xaa at position 335 is Val, Ala, Gly, Leu, or Ile
  SITE (337)..(337): Xaa at position 337 is Tyr, Phe, Met, His, Ile, Leu, Val Ala, or Gly
  SITE (339)..(339): Xaa at position 339 is Ala, Gly, or Pro
  SITE (348)..(348): Xaa at position 348 is Trp, Tyr, Phe, Met, His, Ile, Leu Val, Ala, or Gly
  SITE (362)..(362): Xaa at position 362 is Tyr, Phe, Met, His, Ile, Leu, Val Ala, or Gly
  SITE (374)..(374): Xaa at position 374 is Val, Ala, Gly, Leu, or Ile
  SITE (377)..(377): Xaa at position 377 is Leu, Ala, Val, Gly, or Ile
  SITE (382)..(382): Xaa at position 382 is Leu, Ala, Val, Gly, or Ile
  SITE (390)..(390): Xaa at position 390 is Tyr, Phe, Met, His, Ile, Leu, Val Ala, or Gly
  SITE (392)..(392): Xaa at position 392 is Phe, Tyr, Met, His, Ile, Leu, Val Ala, or Gly
  SITE (394)..(394): Xaa at position 394 is Val, Ala, Gly, Leu, or Ile
  SITE (405)..(405): Xaa at position 405 is Phe, Tyr, Met, His, Ile, Leu, Val Ala, or Gly
  SITE (407)..(407): Xaa at position 407 is Val, Ala, Gly, Leu, or Ile
  SITE (409)..(409): Xaa at position 409 is Val, Ala, Gly, Leu, or Ile
  SITE (428)..(428): Xaa at position 428 is Cys, Ala, Val, Gly, Ser, or Thr
  SITE (430)..(430): Xaa at position 430 is Ala, Gly, or Pro
  SITE (431)..(431): Xaa at position 431 is Ala, Gly, or Pro
  SITE (440)..(440): Xaa at position 440 is Trp, Tyr, Phe, Met, His, Ile, Leu Val, Ala, or Gly
  SITE (473)..(473): Xaa at position 473 is Val, Ala, Gly, Leu, or Ile
  SITE (474)..(474): Xaa at position 474 is Val, Ala, Gly, Leu, or Ile
  SITE (489)..(489): Xaa at position 489 is Val, Ala, Gly, Leu, or Ile
  SITE (491)..(491): Xaa at position 491 is Cys, Ala, Val, Gly, Ser, or Thr
  SITE (493)..(493): Xaa at position 493 is Ala, Gly, or Pro
MRGARGAWDFLCVLLLLLRVQTGSSQPSVSPGEPSPPSIHPGKSDLIVRVGDEXRXLXTDPGFVKXTFEILDETNENKQNEWITEKAEATNTGKXTXTNKHGLSNSXYXFXRDPAKLXLVDRSLYGKEDNDTLXRXPLTDPEVTNYSLKGCQGKPLPKDLRFIPDPKAGXMXKSXKRAYHRLCXHXSXDQEGKSVLSEKXIXKVRPAFKAVPXVSVSKASYLLREGEEXTXTXTXKDVSSSVYSTXKRENSQTKLQEKYNSWHHGDFNYERQXTXTISSXRVNDSGVXMXYXNNTFGSANVTTTLEVVDKGFINIFPMINTTVFXNDGENVDXIXEXEXFPKPEHQQXIYMNRTFTDKWEDXPKSENESNIRYXSEXHLTRXKGTEGGTXTXLXSNSDVNAAIAXNXYXNTKPEILTYDRLVNGMLQXVXXGFPEPTIDXYFCPGTEQRCSASVLPVDVQTLNSSGPPFGKLXXQSSIDSSAFKHNGTXEXKXYNDVGKTSAYFNFAFKGNNKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 274 - protein, 573 aa, Homo sapiens
  SITE (36)..(36): Xaa at position 36 is Ala, Gly, or Pro
  SITE (40)..(40): Xaa at position 40 is Met, Ile, Leu, Val, Ala, or Gly
  SITE (44)..(44): Xaa at position 44 is Val, Ala, Gly, Leu, or Ile
  SITE (47)..(47): Xaa at position 47 is Leu, Ala, Val, Gly, or Ile
  SITE (48)..(48): Xaa at position 48 is Ala, Gly, or Pro
  SITE (51)..(51): Xaa at position 51 is Val, Ala, Gly, Leu, or Ile
  SITE (80)..(80): Xaa at position 80 is Val, Ala, Gly, Leu, or Ile
  SITE (81)..(81): Xaa at position 81 is Ala, Gly, or Pro
  SITE (95)..(95): Xaa at position 95 is Ala, Gly, or Pro
  SITE (98)..(98): Xaa at position 98 is Val, Ala, Gly, Leu, or Ile
  SITE (101)..(101): Xaa at position 101 is Val, Ala, Gly, Leu, or Ile
  SITE (102)..(102): Xaa at position 102 is Ala, Gly, or Pro
  SITE (116)..(116): Xaa at position 116 is Ala, Gly, or Pro
  SITE (118)..(118): Xaa at position 118 is Val, Ala, Gly, Leu, or Ile
  SITE (119)..(119): Xaa at position 119 is Leu, Ala, Val, Gly, or Ile
  SITE (120)..(120): Xaa at position 120 is Ala, Gly, or Pro
  SITE (123)..(123): Xaa at position 123 is Ile, Ala, Val, Leu, or Gly
  SITE (124)..(124): Xaa at position 124 is Ala, Gly, or Pro
  SITE (140)..(140): Xaa at position 140 is Ile, Ala, Val, Leu, or Gly
  SITE (144)..(144): Xaa at position 144 is Val, Ala, Gly, Leu, or Ile
  SITE (147)..(147): Xaa at position 147 is Ala, Gly, or Pro
  SITE (148)..(148): Xaa at position 148 is Val, Ala, Gly, Leu, or Ile
  SITE (150)..(150): Xaa at position 150 is Ala, Gly, or Pro
  SITE (151)..(151): Xaa at position 151 is Val, Ala, Gly, Leu, or Ile
  SITE (155)..(155): Xaa at position 155 is Leu, Ala, Val, Gly, or Ile
  SITE (162)..(162): Xaa at position 162 is Val, Ala, Gly, Leu, or Ile
  SITE (168)..(168): Xaa at position 168 is Ile, Ala, Val, Leu, or Gly
  SITE (171)..(171): Xaa at position 171 is Val, Ala, Gly, Leu, or Ile
  SITE (172)..(172): Xaa at position 172 is Ala, Gly, or Pro
  SITE (176)..(176): Xaa at position 176 is Ala, Gly, or Pro
  SITE (182)..(182): Xaa at position 182 is Ile, Ala, Val, Leu, or Gly
  SITE (186)..(186): Xaa at position 186 is Ile, Ala, Val, Leu, or Gly
  SITE (189)..(189): Xaa at position 189 is Ala, Gly, or Pro
  SITE (190)..(190): Xaa at position 190 is Met, Ile, Leu, Val, Ala, or Gly
  SITE (219)..(219): Xaa at position 219 is Phe, Tyr, Met, His, Ile, Leu, Val Ala, or Gly
  SITE (228)..(228): Xaa at position 228 is Phe, Tyr, Met, His, Ile, Leu, Val Ala, or Gly
  SITE (237)..(237): Xaa at position 237 is Cys, Ala, Val, Gly, Ser, or Thr
  SITE (242)..(242): Xaa at position 242 is Ala, Gly, or Pro
  SITE (244)..(244): Xaa at position 244 is Val, Ala, Gly, Leu, or Ile
  SITE (245)..(245): Xaa at position 245 is Leu, Ala, Val, Gly, or Ile
  SITE (246)..(246): Xaa at position 246 is Leu, Ala, Val, Gly, or Ile
  SITE (251)..(251): Xaa at position 251 is Ile, Ala, Val, Leu, or Gly
  SITE (257)..(257): Xaa at position 257 is Ile, Ala, Val, Leu, or Gly
  SITE (258)..(258): Xaa at position 258 is Val, Ala, Gly, Leu, or Ile
  SITE (260)..(260): Xaa at position 260 is Ala, Gly, or Pro
  SITE (271)..(271): Xaa at position 271 is Leu, Ala, Val, Gly, or Ile
  SITE (272)..(272): Xaa at position 272 is Val, Ala, Gly, Leu, or Ile
  SITE (273)..(273): Xaa at position 273 is Ile, Ala, Val, Leu, or Gly
  SITE (274)..(274): Xaa at position 274 is Ile, Ala, Val, Leu, or Gly
  SITE (275)..(275): Xaa at position 275 is Ala, Gly, or Pro
  SITE (278)..(278): Xaa at position 278 is Val, Ala, Gly, Leu, or Ile
  SITE (282)..(282): Xaa at position 282 is Ala, Gly, or Pro
  SITE (286)..(286): Xaa at position 286 is Leu, Ala, Val, Gly, or Ile
  SITE (297)..(297): Xaa at position 297 is Val, Ala, Gly, Leu, or Ile
  SITE (298)..(298): Xaa at position 298 is Val, Ala, Gly, Leu, or Ile
  SITE (299)..(299): Xaa at position 299 is Ala, Gly, or Pro
  SITE (300)..(300): Xaa at position 300 is Val, Ala, Gly, Leu, or Ile
  SITE (302)..(302): Xaa at position 302 is Ala, Gly, or Pro
  SITE (313)..(313): Xaa at position 313 is Leu, Ala, Val, Gly, or Ile
  SITE (316)..(316): Xaa at position 316 is Met, Ile, Leu, Val, Ala, or Gly
  SITE (317)..(317): Xaa at position 317 is Ala, Gly, or Pro
  SITE (319)..(319): Xaa at position 319 is Ala, Gly, or Pro
  SITE (324)..(324): Xaa at position 324 is Val, Ala, Gly, Leu, or Ile
  SITE (325)..(325): Xaa at position 325 is Phe, Tyr, Met, His, Ile, Leu, Val Ala, or Gly
  SITE (342)..(342): Xaa at position 342 is Leu, Ala, Val, Gly, or Ile
  SITE (345)..(345): Xaa at position 345 is Val, Ala, Gly, Leu, or Ile
  SITE (348)..(348): Xaa at position 348 is Val, Ala, Gly, Leu, or Ile
  SITE (349)..(349): Xaa at position 349 is Ile, Ala, Val, Leu, or Gly
  SITE (350)..(350): Xaa at position 350 is Val, Ala, Gly, Leu, or Ile
  SITE (357)..(357): Xaa at position 357 is Leu, Ala, Val, Gly, or Ile
  SITE (358)..(358): Xaa at position 358 is Leu, Ala, Val, Gly, or Ile
  SITE (371)..(371): Xaa at position 371 is Ile, Ala, Val, Leu, or Gly
  SITE (374)..(374): Xaa at position 374 is Ile, Ala, Val, Leu, or Gly
  SITE (395)..(395): Xaa at position 395 is Ala, Gly, or Pro
  SITE (397)..(397): Xaa at position 397 is Leu, Ala, Val, Gly, or Ile
  SITE (401)..(401): Xaa at position 401 is Val, Ala, Gly, Leu, or Ile
  SITE (402)..(402): Xaa at position 402 is Ala, Gly, or Pro
  SITE (403)..(403): Xaa at position 403 is Val, Ala, Gly, Leu, or Ile
  SITE (404)..(404): Xaa at position 404 is Leu, Ala, Val, Gly, or Ile
  SITE (406)..(406): Xaa at position 406 is Val, Ala, Gly, Leu, or Ile
  SITE (421)..(421): Xaa at position 421 is Val, Ala, Gly, Leu, or Ile
  SITE (424)..(424): Xaa at position 424 is Ala, Gly, or Pro
  SITE (427)..(427): Xaa at position 427 is Ala, Gly, or Pro
  SITE (430)..(430): Xaa at position 430 is Ala, Gly, or Pro
  SITE (431)..(431): Xaa at position 431 is Ala, Gly, or Pro
  SITE (437)..(437): Xaa at position 437 is Val, Ala, Gly, Leu, or Ile
  SITE (438)..(438): Xaa at position 438 is Leu, Ala, Val, Gly, or Ile
  SITE (442)..(442): Xaa at position 442 is Cys, Ala, Val, Gly, Ser, or Thr
  SITE (443)..(443): Xaa at position 443 is Ala, Gly, or Pro
  SITE (444)..(444): Xaa at position 444 is Leu, Ala, Val, Gly, or Ile
  SITE (445)..(445): Xaa at position 445 is Leu, Ala, Val, Gly, or Ile
  SITE (447)..(447): Xaa at position 447 is Cys, Ala, Val, Gly, Ser, or Thr
  SITE (465)..(465): Xaa at position 465 is Ile, Ala, Val, Leu, or Gly
  SITE (467)..(467): Xaa at position 467 is Ile, Ala, Val, Leu, or Gly
  SITE (468)..(468): Xaa at position 468 is Ile, Ala, Val, Leu, or Gly
  SITE (472)..(472): Xaa at position 472 is Leu, Ala, Val, Gly, or Ile
  SITE (476)..(476): Xaa at position 476 is Ala, Gly, or Pro
  SITE (480)..(480): Xaa at position 480 is Ala, Gly, or Pro
  SITE (490)..(490): Xaa at position 490 is Ile, Ala, Val, Leu, or Gly
  SITE (491)..(491): Xaa at position 491 is Val, Ala, Gly, Leu, or Ile
  SITE (494)..(494): Xaa at position 494 is Ile, Ala, Val, Leu, or Gly
  SITE (507)..(507): Xaa at position 507 is Ala, Gly, or Pro
  SITE (513)..(513): Xaa at position 513 is Met, Ile, Leu, Val, Ala, or Gly
  SITE (519)..(519): Xaa at position 519 is Ile, Ala, Val, Leu, or Gly
  SITE (528)..(528): Xaa at position 528 is Ala, Gly, or Pro
  SITE (529)..(529): Xaa at position 529 is Leu, Ala, Val, Gly, or Ile
  SITE (532)..(532): Xaa at position 532 is Ala, Gly, or Pro
  SITE (533)..(533): Xaa at position 533 is Ala, Gly, or Pro
  SITE (536)..(536): Xaa at position 536 is Ala, Gly, or Pro
  SITE (539)..(539): Xaa at position 539 is Leu, Ala, Val, Gly, or Ile
MLRLPTVFRQMRPVSRVLAPHLTRAYAKDVKFGADXRALXLQGXDLXXDAXAVTMGPKGRTVIIEQSWGSPKVTKDGVTXXKSIDLKDKYKNIGXKLXQDXXNNTNEEAGDGTTTXTXXXRSXXKEGFEKISKGANPVEXRRGXMLXXDXXIAEXKKQSKPXTTPEEXAQXXTISXNGDKEXGNIXSDXXKKVGRKGVITVKDGKTLNDELEIIEGMKXDRGYISPYXINTSKGQKXEFQDXYXXXSEKKXSSIQSXXPXLEIANAHRKPXXXXXEDXDGEXLSTXVLNRLKVGLQXXXXKXPGFGDNRKNQXKDXXIXTGGAXXGEEGLTLNLEDVQPHDXGKXGEXXXTKDDAMXXKGKGDKAQIEKRXQEXIEQLDVTTSEYEKEKLNERLXKXSDGXXXXKXGGTSDVEVNEKKDRXTDXLNXTRXXVEEGIXXGGGXXXXRXIPALDSLTPANEDQKIGXEXXKRTXKIPXMTIXKNAGVEGSLXXEKXMQSSSEVGYDAMXGDFVNXVEKGIXDPTKVVRTXXLDXXGVXSLXTTAEVVVTEIPKEEKDPGMGAMGGMGGGMGGGMF

SEQ ID NO: 275 - protein, 461 aa, Homo sapiens
  SITE (107)..(107): Xaa at position 107 is Cys, Ala, Val, Gly, Ser, or Thr
  SITE (109)..(109): Xaa at position 109 is Val, Ala, Gly, Leu, or Ile
  SITE (114)..(114): Xaa at position 114 is Ala, Gly, or Pro
  SITE (124)..(124): Xaa at position 124 is Cys, Ala, Val, Gly, Ser, or Thr
  SITE (127)..(127): Xaa at position 127 is Cys, Ala, Val, Gly, Ser, or Thr
  SITE (131)..(131): Xaa at position 131 is Phe, Tyr, Met, His, Ile, Leu, Val Ala, or Gly
  SITE (151)..(151): Xaa at position 151 is Cys, Ala, Val, Gly, Ser, or Thr
  SITE (153)..(153): Xaa at position 153 is Ile, Ala, Val, Leu, or Gly
  SITE (164)..(164): Xaa at position 164 is Cys, Ala, Val, Gly, Ser, or Thr
  SITE (166)..(166): Xaa at position 166 is Phe, Tyr, Met, His, Ile, Leu, Val Ala, or Gly
  SITE (169)..(169): Xaa at position 169 is Cys, Ala, Val, Gly, Ser, or Thr
  SITE (174)..(174): Xaa at position 174 is Met, Ile, Leu, Val, Ala, or Gly
  SITE (225)..(225): Xaa at position 225 is Val, Ala, Gly, Leu, or Ile
  SITE (228)..(228): Xaa at position 228 is Ala, Gly, or Pro
  SITE (229)..(229): Xaa at position 229 is His, Phe, Tyr, Lys, Arg, Gly, Ser Thr, Ala, Val, Leu, Ile, Asn, Met, or Gln
  SITE (246)..(246): Xaa at position 246 is Leu, Ala, Val, Gly, or Ile
  SITE (268)..(268): Xaa at position 268 is Ala, Gly, or Pro
  SITE (269)..(269): Xaa at position 269 is Phe, Tyr, Met, His, Ile, Leu, Val Ala, or Gly
  SITE (280)..(280): Xaa at position 280 is Ile, Ala, Val, Leu, or Gly
  SITE (283)..(283): Xaa at position 283 is Val, Ala, Gly, Leu, or Ile
  SITE (286)..(286): Xaa at position 286 is Phe, Tyr, Met, His, Ile, Leu, Val Ala, or Gly
  SITE (287)..(287): Xaa at position 287 is Ala, Gly, or Pro
  SITE (290)..(290): Xaa at position 290 is Leu, Ala, Val, Gly, or Ile
  SITE (293)..(293): Xaa at position 293 is Phe, Tyr, Met, His, Ile, Leu, Val Ala, or Gly
  SITE (304)..(304): Xaa at position 304 is Leu, Ala, Val, Gly, or Ile
  SITE (308)..(308): Xaa at position 308 is Cys, Ala, Val, Gly, Ser, or Thr
  SITE (309)..(309): Xaa at position 309 is Cys, Ala, Val, Gly, Ser, or Thr
  SITE (312)..(312): Xaa at position 312 is Ile, Ala, Val, Leu, or Gly
  SITE (315)..(315): Xaa at position 315 is Leu, Ala, Val, Gly, or Ile
  SITE (318)..(318): Xaa at position 318 is Ala, Gly, or Pro
  SITE (328)..(328): Xaa at position 328 is Leu, Ala, Val, Gly, or Ile
  SITE (335)..(335): Xaa at position 335 is Ala, Gly, or Pro
  SITE (336)..(336): Xaa at position 336 is Val, Ala, Gly, Leu, or Ile
  SITE (349)..(349): Xaa at position 349 is Val, Ala, Gly, Leu, or Ile
  SITE (354)..(354): Xaa at position 354 is Phe, Tyr, Met, His, Ile, Leu, Val Ala, or Gly
  SITE (371)..(371): Xaa at position 371 is Ala, Gly, or Pro
  SITE (372)..(372): Xaa at position 372 is Leu, Ala, Val, Gly, or Ile
  SITE (373)..(373): Xaa at position 373 is Leu, Ala, Val, Gly, or Ile
  SITE (375)..(375): Xaa at position 375 is Ala, Gly, or Pro
  SITE (377)..(377): Xaa at position 377 is Leu, Ala, Val, Gly, or Ile
  SITE (378)..(378): Xaa at position 378 is Leu, Ala, Val, Gly, or Ile
  SITE (379)..(379): Xaa at position 379 is Met, Ile, Leu, Val, Ala, or Gly
  SITE (392)..(392): Xaa at position 392 is Ile, Ala, Val, Leu, or Gly
  SITE (399)..(399): Xaa at position 399 is Phe, Tyr, Met, His, Ile, Leu, Val Ala, or Gly
  SITE (402)..(402): Xaa at position 402 is Ala, Gly, or Pro
  SITE (403)..(403): Xaa at position 403 is Phe, Tyr, Met, His, Ile, Leu, Val Ala, or Gly
  SITE (421)..(421): Xaa at position 421 is Leu, Ala, Val, Gly, or Ile
  SITE (425)..(425): Xaa at position 425 is Val, Ala, Gly, Leu, or Ile
  SITE (428)..(428): Xaa at position 428 is Leu, Ala, Val, Gly, or Ile
  SITE (431)..(431): Xaa at position 431 is Ile, Ala, Val, Leu, or Gly
  SITE (436)..(436): Xaa at position 436 is Ala, Gly, or Pro
  SITE (439)..(439): Xaa at position 439 is Phe, Tyr, Met, His, Ile, Leu, Val Ala, or Gly
  SITE (442)..(442): Xaa at position 442 is Met, Ile, Leu, Val, Ala, or Gly
  SITE (446)..(446): Xaa at position 446 is Cys, Ala, Val, Gly, Ser, or Thr
  SITE (456)..(456): Xaa at position 456 is Leu, Ala, Val, Gly, or Ile
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELXVXCGDKXTGYHYRCITXEGXKGFXRRTIQKNLHPSYSCKYEGKXVXDKVTRNQCQEXRXKKXIYVGXATDLVLDDSKRLAKRKLIEENREKRRREELQKSIGHKPEPTDEEWELIKTXTEXXVATNAQGSHWKQKRKFXPEDIGQAPIVNAPEGGKVDLEXXSHFTKIITPAXTRXVDXXKKXPMXCELPCEDQIIXLKGXXMEXMSXRAXVRYDPESETXTLNGEMXXTRGQLKNGGLGVXSDAIXDLGMSLSSFNLDDTEVXXXQXVXXXSSDRPGLACVERXEKYQDSXLLXXEHYINYRKHHVTHFWPKXLMKXTDXRMXGACHXSRXLHXKVEXPTELFPPLFXEVFED

SEQ ID NO: 276 - protein, 638 aa, Homo sapiens
  SITE (64)..(64): Xaa at position 64 is Phe, Tyr, Met, His, Ile, Leu, Val Ala, or Gly
  SITE (66)..(66): Xaa at position 66 is Cys, Ala, Val, Gly, Ser, or Thr
  SITE (84)..(84): Xaa at position 84 is Leu, Ala, Val, Gly, or Ile
  SITE (112)..(112): Xaa at position 112 is Cys, Ala, Val, Gly, Ser, or Thr
  SITE (114)..(114): Xaa at position 114 is Phe, Tyr, Met, His, Ile, Leu, Val Ala, or Gly
  SITE (125)..(125): Xaa at position 125 is Tyr, Phe, Met, His, Ile, Leu, Val Ala, or Gly
  SITE (127)..(127): Xaa at position 127 is Ile, Ala, Val, Leu, or Gly
  SITE (129)..(129): Xaa at position 129 is Leu, Ala, Val, Gly, or Ile
  SITE (140)..(140): Xaa at position 140 is Cys, Ala, Val, Gly, Ser, or Thr
  SITE (143)..(143): Xaa at position 143 is Val, Ala, Gly, Leu, or Ile
  SITE (147)..(147): Xaa at position 147 is Val, Ala, Gly, Leu, or Ile
  SITE (160)..(160): Xaa at position 160 is Leu, Ala, Val, Gly, or Ile
  SITE (169)..(169): Xaa at position 169 is Ala, Gly, or Pro
  SITE (171)..(171): Xaa at position 171 is Ile, Ala, Val, Leu, or Gly
  SITE (173)..(173): Xaa at position 173 is Val, Ala, Gly, Leu, or Ile
  SITE (188)..(188): Xaa at position 188 is Met, Ile, Leu, Val, Ala, or Gly
  SITE (194)..(194): Xaa at position 194 is Leu, Ala, Val, Gly, or Ile
  SITE (217)..(217): Xaa at position 217 is Val, Ala, Gly, Leu, or Ile
  SITE (220)..(220): Xaa at position 220 is Leu, Ala, Val, Gly, or Ile
  SITE (228)..(228): Xaa at position 228 is Val, Ala, Gly, Leu, or Ile
  SITE (230)..(230): Xaa at position 230 is Val, Ala, Gly, Leu, or Ile
  SITE (249)..(249): Xaa at position 249 is Val, Ala, Gly, Leu, or Ile
MDLWQLLLTLALAGSSDAFSGSEATAAILSRAPWSLQSVNPGLKTNSSKEPKFTKCRSPERETXSXHWTDEVHHGTKNLGPIQXFYTRRNTQEWTQEWKECPDYVSAGENSXYXNSSFTSIWIPXCXKXTSNGGTVDEKXFSXDEIXQPDPPIALNWTLXNVSLTGIHXDXQXRWEAPRNADIQKGWXVLEYEXQYKEVNETKWKMMDPILTTSVPXYSXKVDKEYEXRXRSKQRNSGNYGEFSEVLYXTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 277 - protein, 654 aa, Homo sapiens
  SITE (30)..(30): Xaa at position 30 is Val, Ala, Gly, Leu, or Ile
  SITE (31)..(31): Xaa at position 31 is Val, Ala, Gly, Leu, or Ile
  SITE (33)..(33): Xaa at position 33 is Ile, Ala, Val, Leu, or Gly
  SITE (35)..(35): Xaa at position 35 is Leu, Ala, Val, Gly, or Ile
  SITE (41)..(41): Xaa at position 41 is Cys, Ala, Val, Gly, Ser, or Thr
  SITE (42)..(42): Xaa at position 42 is Val, Ala, Gly, Leu, or Ile
  SITE (44)..(44): Xaa at position 44 is Val, Ala, Gly, Leu, or Ile
  SITE (53)..(53): Xaa at position 53 is Ile, Ala, Val, Leu, or Gly
  SITE (65)..(65): Xaa at position 65 is Tyr, Phe, Met, His, Ile, Leu, Val Ala, or Gly
  SITE (66)..(66): Xaa at position 66 is Val, Ala, Gly, Leu, or Ile
  SITE (67)..(67): Xaa at position 67 is Ala, Gly, or Pro
  SITE (68)..(68): Xaa at position 68 is Phe, Tyr, Met, His, Ile, Leu, Val Ala, or Gly
  SITE (80)..(80): Xaa at position 80 is Ala, Gly, or Pro
  SITE (92)..(92): Xaa at position 92 is Val, Ala, Gly, Leu, or Ile
  SITE (98)..(98): Xaa at position 98 is Leu, Ala, Val, Gly, or Ile
  SITE (99)..(99): Xaa at position 99 is Ile, Ala, Val, Leu, or Gly
  SITE (108)..(108): Xaa at position 108 is Val, Ala, Gly, Leu, or Ile
  SITE (119)..(119): Xaa at position 119 is Val, Ala, Gly, Leu, or Ile
  SITE (127)..(127): Xaa at position 127 is Tyr, Phe, Met, His, Ile, Leu, Val Ala, or Gly
  SITE (128)..(128): Xaa at position 128 is Ile, Ala, Val, Leu, or Gly
  SITE (130)..(130): Xaa at position 130 is Val, Ala, Gly, Leu, or Ile
  SITE (141)..(141): Xaa at position 141 is Ala, Gly, or Pro
  SITE (145)..(145): Xaa at position 145 is Ile, Ala, Val, Leu, or Gly
  SITE (147)..(147): Xaa at position 147 is Ala, Gly, or Pro
  SITE (150)..(150): Xaa at position 150 is Leu, Ala, Val, Gly, or Ile
  SITE (153)..(153): Xaa at position 153 is Met, Ile, Leu, Val, Ala, or Gly
  SITE (157)..(157): Xaa at position 157 is Ala, Gly, or Pro
  SITE (159)..(159): Xaa at position 159 is Ala, Gly, or Pro
  SITE (165)..(165): Xaa at position 165 is Val, Ala, Gly, Leu, or Ile
  SITE (168)..(168): Xaa at position 168 is Ala, Gly, or Pro
  SITE (169)..(169): Xaa at position 169 is Val, Ala, Gly, Leu, or Ile
  SITE (170)..(170): Xaa at position 170 is Val, Ala, Gly, Leu, or Ile
  SITE (172)..(172): Xaa at position 172 is Val, Ala, Gly, Leu, or Ile
  SITE (174)..(174): Xaa at position 174 is Ala, Gly, or Pro
  SITE (183)..(183): Xaa at position 183 is Ala, Gly, or Pro
  SITE (187)..(187): Xaa at position 187 is Ala, Gly, or Pro
  SITE (191)..(191): Xaa at position 191 is Ala, Gly, or Pro
  SITE (193)..(193): Xaa at position 193 is Leu, Ala, Val, Gly, or Ile
  SITE (195)..(195): Xaa at position 195 is Val, Ala, Gly, Leu, or Ile
  SITE (196)..(196): Xaa at position 196 is Met, Ile, Leu, Val, Ala, or Gly
  SITE (204)..(204): Xaa at position 204 is Ala, Gly, or Pro
  SITE (205)..(205): Xaa at position 205 is Ala, Gly, or Pro
  SITE (206)..(206): Xaa at position 206 is Ala, Gly, or Pro
  SITE (207)..(207): Xaa at position 207 is Ile, Ala, Val, Leu, or Gly
  SITE (208)..(208): Xaa at position 208 is Ala, Gly, or Pro
  SITE (211)..(211): Xaa at position 211 is Leu, Ala, Val, Gly, or Ile
  SITE (220)..(220): Xaa at position 220 is Ile, Ala, Val, Leu, or Gly
  SITE (221)..(221): Xaa at position 221 is Leu, Ala, Val, Gly, or Ile
  SITE (222)..(222): Xaa at position 222 is Val, Ala, Gly, Leu, or Ile
  SITE (223)..(223): Xaa at position 223 is Phe, Tyr, Met, His, Ile, Leu, Val Ala, or Gly
  SITE (225)..(225): Xaa at position 225 is Leu, Ala, Val, Gly, or Ile
  SITE (230)..(230): Xaa at position 230 is Phe, Tyr, Met, His, Ile, Leu, Val Ala, or Gly
  SITE (232)..(232): Xaa at position 232 is Val, Ala, Gly, Leu, or Ile
  SITE (234)..(234): Xaa at position 234 is Leu, Ala, Val, Gly, or Ile
  SITE (235)..(235): Xaa at position 235 is Leu, Ala, Val, Gly, or Ile
  SITE (237)..(237): Xaa at position 237 is Ile, Ala, Val, Leu, or Gly
  SITE (242)..(242): Xaa at position 242 is Phe, Tyr, Met, His, Ile, Leu, Val Ala, or Gly
  SITE (244)..(244): Xaa at position 244 is Val, Ala, Gly, Leu, or Ile
  SITE (245)..(245): Xaa at position 245 is Val, Ala, Gly, Leu, or Ile
  SITE (246)..(246): Xaa at position 246 is Ala, Gly, or Pro
  SITE (253)..(253): Xaa at position 253 is Leu, Ala, Val, Gly, or Ile
  SITE (258)..(258): Xaa at position 258 is Phe, Tyr, Met, His, Ile, Leu, Val Ala, or Gly
  SITE (262)..(262): Xaa at position 262 is Val, Ala, Gly, Leu, or Ile
  SITE (263)..(263): Xaa at position 263 is Met, Ile, Leu, Val, Ala, or Gly
  SITE (266)..(266): Xaa at position 266 is Phe, Tyr, Met, His, Ile, Leu, Val Ala, or Gly
  SITE (267)..(267): Xaa at position 267 is Ile, Ala, Val, Leu, or Gly
  SITE (270)..(270): Xaa at position 270 is Tyr, Phe, Met, His, Ile, Leu, Val Ala, or Gly
  SITE (278)..(278): Xaa at position 278 is Val, Ala, Gly, Leu, or Ile
  SITE (284)..(284): Xaa at position 284 is Ala, Gly, or Pro
  SITE (285)..(285): Xaa at position 285 is Val, Ala, Gly, Leu, or Ile
  SITE (288)..(288): Xaa at position 288 is Leu, Ala, Val, Gly, or Ile
  SITE (292)..(292): Xaa at position 292 is Val, Ala, Gly, Leu, or Ile
  SITE (295)..(295): Xaa at position 295 is Ala, Gly, or Pro
  SITE (299)..(299): Xaa at position 299 is Leu, Ala, Val, Gly, or Ile
  SITE (305)..(305): Xaa at position 305 is Ala, Gly, or Pro
  SITE (307)..(307): Xaa at position 307 is Ile, Ala, Val, Leu, or Gly
  SITE (309)..(309): Xaa at position 309 is Ile, Ala, Val, Leu, or Gly
  SITE (313)..(313): Xaa at position 313 is Tyr, Phe, Met, His, Ile, Leu, Val Ala, or Gly
  SITE (318)..(318): Xaa at position 318 is Phe, Tyr, Met, His, Ile, Leu, Val Ala, or Gly
  SITE (322)..(322): Xaa at position 322 is Leu, Ala, Val, Gly, or Ile
  SITE (327)..(327): Xaa at position 327 is Phe, Tyr, Met, His, Ile, Leu, Val Ala, or Gly
  SITE (334)..(334): Xaa at position 334 is Leu, Ala, Val, Gly, or Ile
  SITE (335)..(335): Xaa at position 335 is Phe, Tyr, Met, His, Ile, Leu, Val Ala, or Gly
  SITE (339)..(339): Xaa at position 339 is Met, Ile, Leu, Val, Ala, or Gly
  SITE (342)..(342): Xaa at position 342 is Val, Ala, Gly, Leu, or Ile
  SITE (345)..(345): Xaa at position 345 is Val, Ala, Gly, Leu, or Ile
  SITE (346)..(346): Xaa at position 346 is Leu, Ala, Val, Gly, or Ile
  SITE (356)..(356): Xaa at position 356 is Ile, Ala, Val, Leu, or Gly
  SITE (359)..(359): Xaa at position 359 is Ile, Ala, Val, Leu, or Gly
  SITE (360)..(360): Xaa at position 360 is Val, Ala, Gly, Leu, or Ile
  SITE (361)..(361): Xaa at position 361 is Leu, Ala, Val, Gly, or Ile
  SITE (362)..(362): Xaa at position 362 is Val, Ala, Gly, Leu, or Ile
  SITE (371)..(371): Xaa at position 371 is Ile, Ala, Val, Leu, or Gly
  SITE (375)..(375): Xaa at position 375 is Val, Ala, Gly, Leu, or Ile
  SITE (379)..(379): Xaa at position 379 is Phe, Tyr, Met, His, Ile, Leu, Val Ala, or Gly
  SITE (393)..(393): Xaa at position 393 is Ala, Gly, or Pro
  SITE (394)..(394): Xaa at position 394 is Val, Ala, Gly, Leu, or Ile
  SITE (395)..(395): Xaa at position 395 is Ala, Gly, or Pro
  SITE (398)..(398): Xaa at position 398 is Ala, Gly, or Pro
  SITE (399)..(399): Xaa at position 399 is Ala, Gly, or Pro
  SITE (400)..(400): Xaa at position 400 is Val, Ala, Gly, Leu, or Ile
  SITE (402)..(402): Xaa at position 402 is Ala, Gly, or Pro
  SITE (422)..(422): Xaa at position 422 is Leu, Ala, Val, Gly, or Ile
  SITE (426)..(426): Xaa at position 426 is Ile, Ala, Val, Leu, or Gly
  SITE (437)..(437): Xaa at position 437 is Ile, Ala, Val, Leu, or Gly
  SITE (451)..(451): Xaa at position 451 is Phe, Tyr, Met, His, Ile, Leu, Val Ala, or Gly
  SITE (461)..(461): Xaa at position 461 is Val, Ala, Gly, Leu, or Ile
  SITE (463)..(463): Xaa at position 463 is Ile, Ala, Val, Leu, or Gly
  SITE (465)..(465): Xaa at position 465 is Val, Ala, Gly, Leu, or Ile
  SITE (466)..(466): Xaa at position 466 is Tyr, Phe, Met, His, Ile, Leu, Val Ala, or Gly
  SITE (487)..(487): Xaa at position 487 is Ile, Ala, Val, Leu, or Gly
  SITE (497)..(497): Xaa at position 497 is Ile, Ala, Val, Leu, or Gly
  SITE (499)..(499): Xaa at position 499 is Val, Ala, Gly, Leu, or Ile
  SITE (501)..(501): Xaa at position 501 is Phe, Tyr, Met, His, Ile, Leu, Val Ala, or Gly
  SITE (509)..(509): Xaa at position 509 is Leu, Ala, Val, Gly, or Ile
  SITE (511)..(511): Xaa at position 511 is Val, Ala, Gly, Leu, or Ile
  SITE (513)..(513): Xaa at position 513 is Ala, Gly, or Pro
  SITE (542)..(542): Xaa at position 542 is Val, Ala, Gly, Leu, or Ile
  SITE (565)..(565): Xaa at position 565 is Leu, Ala, Val, Gly, or Ile
  SITE (568)..(568): Xaa at position 568 is Tyr, Phe, Met, His, Ile, Leu, Val Ala, or Gly
  SITE (569)..(569): Xaa at position 569 is Ala, Gly, or Pro
  SITE (572)..(572): Xaa at position 572 is Leu, Ala, Val, Gly, or Ile
  SITE (594)..(594): Xaa at position 594 is Met, Ile, Leu, Val, Ala, or Gly
  SITE (597)..(597): Xaa at position 597 is Ala, Gly, or Pro
  SITE (598)..(598): Xaa at position 598 is Val, Ala, Gly, Leu, or Ile
  SITE (605)..(605): Xaa at position 605 is Leu, Ala, Val, Gly, or Ile
  SITE (616)..(616): Xaa at position 616 is Phe, Tyr, Met, His, Ile, Leu, Val Ala, or Gly
  SITE (623)..(623): Xaa at position 623 is Leu, Ala, Val, Gly, or Ile
  SITE (627)..(627): Xaa at position 627 is Val, Ala, Gly, Leu, or Ile
MKLSLVAAMLLLLSAARAEEEDKKEDVGTXXGXDXGTTYSXXGXFKNGRVEIXANDQGNRITPSXXXXTPEGERLIGDAXKNQLTSNPENTXFDAKRXXGRTWNDPSXQQDIKFLPFKXVEKKTKPXXQXDIGGGQTKTFXPEEXSXMVXTKXKETXEXYLGKKXTHXXXTXPXYFNDAQRQXTKDXGTIXGXNXXRIINEPTXXXXXYGXDKREGEKNXXXXDXGGGTXDXSXXTXDNGVXEXXXTNGDTHXGGEDXDQRXXEHXXKLXKKKTGKDXRKDNRXXQKXRREXEKXKRAXSSQHQXRXEXESFXEGEDXSETXTRAKXEELNMDXXRSTXKPXQKXXEDSDLKKSDXDEXXXXGGSTRIPKXQQLXKEFXNGKEPSRGINPDEXXXYGXXXQXGVLSGDQDTGDLVLLDVCPXTLGXETVGGVMTKLXPRNTVVPTKKSQIXSTASDNQPTXTXKXXEGERPLTKDNHLLGTFDLTGXPPAPRGVPQXEXTXEIDVNGIXRXTXEDKGTGNKNKITITNDQNRLTPEEIERMXNDAEKFAEEDKKLKERIDTRNEXESXXYSXKNQIGDKEKLGGKLSSEDKETXEKXXEEKIEWXESHQDADIEDXKAKKKEXEEIXQPIISKLYGSAGPPPTGEEDTAEKDEL

SEQ ID NO: 278 - protein, 566 aa, Influenza A virus
  strain A/Duck/Ireland/113/1983 H5N8
  SITE (5)..(5): Xaa at position 5 is Val, Ala, Gly, Leu, or Ile
  SITE (19)..(19): Xaa at position 19 is Ile, Ala, Val, Leu, or Gly
  SITE (20)..(20): Xaa at position 20 is Cys, Ala, Val, Gly, Ser, or Thr
  SITE (21)..(21): Xaa at position 21 is Ile, Ala, Val, Leu, or Gly
  SITE (25)..(25): Xaa at position 25 is Ala, Gly, or Pro
  SITE (32)..(32): Xaa at position 32 is Val, Ala, Gly, Leu, or Ile
  SITE (35)..(35): Xaa at position 35 is Ile, Ala, Val, Leu, or Gly
  SITE (42)..(42): Xaa at position 42 is Val, Ala, Gly, Leu, or Ile
  SITE (48)..(48): Xaa at position 48 is Ile, Ala, Val, Leu, or Gly
  SITE (49)..(49): Xaa at position 49 is Leu, Ala, Val, Gly, or Ile
  SITE (57)..(57): Xaa at position 57 is Leu, Ala, Val, Gly, or Ile
  SITE (58)..(58): Xaa at position 58 is Cys, Ala, Val, Gly, Ser, or Thr
  SITE (60)..(60): Xaa at position 60 is Leu, Ala, Val, Gly, or Ile
  SITE (66)..(66): Xaa at position 66 is Leu, Ala, Val, Gly, or Ile
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (73)..(73): Xaa at position 73 is Val, Ala, Gly, Leu, or Ile
  SITE (74)..(74): Xaa at position 74 is Ala, Gly, or Pro
  SITE (76)..(76): Xaa at position 76 is Trp, Tyr, Phe, Met, His, Ile, Leu Val, Ala, or Gly
  SITE (77)..(77): Xaa at position 77 is Leu, Ala, Val, Gly, or Ile
  SITE (78)..(78): Xaa at position 78 is Leu, Ala, Val, Gly, or Ile
  SITE (83)..(83): Xaa at position 83 is Cys, Ala, Val, Gly, Ser, or Thr
  SITE (86)..(86): Xaa at position 86 is Phe, Tyr, Met, His, Ile, Leu, Val Ala, or Gly
  SITE (92)..(92): Xaa at position 92 is Trp, Tyr, Phe, Met, His, Ile, Leu Val, Ala, or Gly
  SITE (94)..(94): Xaa at position 94 is Tyr, Phe, Met, His, Ile, Leu, Val Ala, or Gly
  SITE (95)..(95): Xaa at position 95 is Ile, Ala, Val, Leu, or Gly
  SITE (96)..(96): Xaa at position 96 is Val, Ala, Gly, Leu, or Ile
  SITE (107)..(107): Xaa at position 107 is Tyr, Phe, Met, His, Ile, Leu, Val Ala, or Gly
  SITE (117)..(117): Xaa at position 117 is Leu, Ala, Val, Gly, or Ile
  SITE (120)..(120): Xaa at position 120 is Leu, Ala, Val, Gly, or Ile
  SITE (121)..(121): Xaa at position 121 is Leu, Ala, Val, Gly, or Ile
  SITE (127)..(127): Xaa at position 127 is Phe, Tyr, Met, His, Ile, Leu, Val Ala, or Gly
  SITE (133)..(133): Xaa at position 133 is Ile, Ala, Val, Leu, or Gly
  SITE (150)..(150): Xaa at position 150 is Ala, Gly, or Pro
  SITE (151)..(151): Xaa at position 151 is Cys, Ala, Val, Gly, Ser, or Thr
  SITE (153)..(153): Xaa at position 153 is Tyr, Phe, Met, His, Ile, Leu, Val Ala, or Gly
  SITE (163)..(163): Xaa at position 163 is Val, Ala, Gly, Leu, or Ile
  SITE (164)..(164): Xaa at position 164 is Val, Ala, Gly, Leu, or Ile
  SITE (165)..(165): Xaa at position 165 is Trp, Tyr, Phe, Met, His, Ile, Leu Val, Ala, or Gly
  SITE (166)..(166): Xaa at position 166 is Leu, Ala, Val, Gly, or Ile
  SITE (176)..(176): Xaa at position 176 is Ile, Ala, Val, Leu, or Gly
  SITE (188)..(188): Xaa at position 188 is Leu, Ala, Val, Gly, or Ile
  SITE (189)..(189): Xaa at position 189 is Leu, Ala, Val, Gly, or Ile
  SITE (190)..(190): Xaa at position 190 is Ile, Ala, Val, Leu, or Gly
  SITE (191)..(191): Xaa at position 191 is Leu, Ala, Val, Gly, or Ile
  SITE (192)..(192): Xaa at position 192 is Trp, Tyr, Phe, Met, His, Ile, Leu Val, Ala, or Gly
  SITE (194)..(194): Xaa at position 194 is Ile, Ala, Val, Leu, or Gly
  SITE (195)..(195): Xaa at position 195 is His, Phe, Tyr, Lys, Arg, Gly, Ser Thr, Ala, Val, Leu, Ile, Asn, Met, or Gln
  SITE (196)..(196): Xaa at position 196 is His, Phe, Tyr, Lys, Arg, Gly, Ser Thr, Ala, Val, Leu, Ile, Asn, Met, or Gln
  SITE (201)..(201): Xaa at position 201 is Ala, Gly, or Pro
  SITE (207)..(207): Xaa at position 207 is Tyr, Phe, Met, His, Ile, Leu, Val Ala, or Gly
  SITE (213)..(213): Xaa at position 213 is Tyr, Phe, Met, His, Ile, Leu, Val Ala, or Gly
  SITE (214)..(214): Xaa at position 214 is Val, Ala, Gly, Leu, or Ile
  SITE (216)..(216): Xaa at position 216 is Val, Ala, Gly, Leu, or Ile
  SITE (221)..(221): Xaa at position 221 is Leu, Ala, Val, Gly, or Ile
  SITE (242)..(242): Xaa at position 242 is Met, Ile, Leu, Val, Ala, or Gly
  SITE (244)..(244): Xaa at position 244 is Phe, Tyr, Met, His, Ile, Leu, Val Ala, or Gly
  SITE (245)..(245): Xaa at position 245 is Phe, Tyr, Met, His, Ile, Leu, Val Ala, or Gly
  SITE (248)..(248): Xaa at position 248 is Ile, Ala, Val, Leu, or Gly
  SITE (249)..(249): Xaa at position 249 is Leu, Ala, Val, Gly, or Ile
  SITE (255)..(255): Xaa at position 255 is Ile, Ala, Val, Leu, or Gly
  SITE (257)..(257): Xaa at position 257 is Phe, Tyr, Met, His, Ile, Leu, Val Ala, or Gly
  SITE (263)..(263): Xaa at position 263 is Phe, Tyr, Met, His, Ile, Leu, Val Ala, or Gly
  SITE (264)..(264): Xaa at position 264 is Ile, Ala, Val, Leu, or Gly
  SITE (265)..(265): Xaa at position 265 is Ala, Gly, or Pro
  SITE (268)..(268): Xaa at position 268 is Tyr, Phe, Met, His, Ile, Leu, Val Ala, or Gly
  SITE (269)..(269): Xaa at position 269 is Ala, Gly, or Pro
  SITE (270)..(270): Xaa at position 270 is Tyr, Phe, Met, His, Ile, Leu, Val Ala, or Gly
  SITE (272)..(272): Xaa at position 272 is Ile, Ala, Val, Leu, or Gly
  SITE (280)..(280): Xaa at position 280 is Ile, Ala, Val, Leu, or Gly
  SITE (281)..(281): Xaa at position 281 is Met, Ile, Leu, Val, Ala, or Gly
  SITE (290)..(290): Xaa at position 290 is Cys, Ala, Val, Gly, Ser, or Thr
  SITE (294)..(294): Xaa at position 294 is Cys, Ala, Val, Gly, Ser, or Thr
  SITE (300)..(300): Xaa at position 300 is Ala, Gly, or Pro
  SITE (301)..(301): Xaa at position 301 is Ile, Ala, Val, Leu, or Gly
  SITE (308)..(308): Xaa at position 308 is His, Phe, Tyr, Lys, Arg, Gly, Ser Thr, Ala, Val, Leu, Ile, Asn, Met, or Gln
  SITE (311)..(311): Xaa at position 311 is His, Phe, Tyr, Lys, Arg, Gly, Ser Thr, Ala, Val, Leu, Ile, Asn, Met, or Gln
  SITE (315)..(315): Xaa at position 315 is Ile, Ala, Val, Leu, or Gly
  SITE (322)..(322): Xaa at position 322 is Val, Ala, Gly, Leu, or Ile
  SITE (327)..(327): Xaa at position 327 is Leu, Ala, Val, Gly, or Ile
  SITE (329)..(329): Xaa at position 329 is Leu, Ala, Val, Gly, or Ile
  SITE (330)..(330): Xaa at position 330 is Ala, Gly, or Pro
  SITE (349)..(349): Xaa at position 349 is Ala, Gly, or Pro
  SITE (361)..(361): Xaa at position 361 is Met, Ile, Leu, Val, Ala, or Gly
  SITE (366)..(366): Xaa at position 366 is Tyr, Phe, Met, His, Ile, Leu, Val Ala, or Gly
  SITE (388)..(388): Xaa at position 388 is Ala, Gly, or Pro
  SITE (389)..(389): Xaa at position 389 is Ile, Ala, Val, Leu, or Gly
  SITE (440)..(440): Xaa at position 440 is Ala, Gly, or Pro
  SITE (452)..(452): Xaa at position 452 is Leu, Ala, Val, Gly, or Ile
  SITE (459)..(459): Xaa at position 459 is Val, Ala, Gly, Leu, or Ile
  SITE (462)..(462): Xaa at position 462 is Leu, Ala, Val, Gly, or Ile
  SITE (466)..(466): Xaa at position 466 is Val, Ala, Gly, Leu, or Ile
  SITE (470)..(470): Xaa at position 470 is Leu, Ala, Val, Gly, or Ile
  SITE (481)..(481): Xaa at position 481 is Cys, Ala, Val, Gly, Ser, or Thr
  SITE (486)..(486): Xaa at position 486 is His, Phe, Tyr, Lys, Arg, Gly, Ser Thr, Ala, Val, Leu, Ile, Asn, Met, or Gln
  SITE (488)..(488): Xaa at position 488 is Cys, Ala, Val, Gly, Ser, or Thr
  SITE (492)..(492): Xaa at position 492 is Cys, Ala, Val, Gly, Ser, or Thr
  SITE (493)..(493): Xaa at position 493 is Met, Ile, Leu, Val, Ala, or Gly
  SITE (510)..(510): Xaa at position 510 is Ala, Gly, or Pro
MEEIXLLFAIVSLARSDQXXXGYHXNNSTKQXDTXMEKNVTXTHAQDXXEKTHNGKXXSXNGVKPXIXRDXSXXGXXXGNPMXDEXLNVPEXSXXXEKDNPVNGLCXPGDFNDYEEXKHXXSCTKHXEKIRIXPRDSWPNHEASLGVSSXXPXNGRSSFFRNXXXXIKKDNAYPTXKRSYNNTNKEDXXXXXGXXXPNDAXEQTKLXQNPTTXXSXGTSTXNQRSIPKIATRPKLNGQSGRXEXXWTXXKPSDTXNXESNGNXXXPEXXXKXVKKGDSAXXKSGLEYGNXNTKXQTPIGXXNSSMPFXNIXPLTXGECPKYXKSDRXVXXTGLRNTPQRKRKKRGLFGXIAGFIEGGWQGXVDGWXGYHHSNEQGSGYAADKESTQKXXDGITNKVNSIIDKMNTQFEAVGKEFNNLERRIENLNKILEDGFLDVWTYNXELLVLMENERTXDFHEANXKSXYDKXRLQXKDNARELGNGXFEFYXKXDNEXXESIRNGTYNYPQYSEEXRLNREEISGIKLESMGIYQILSIYSTVASSLALAIMIAGLSFWMCSNGSLQCRICI

SEQ ID NO: 279 - protein, 492 aa, Homo sapiens
  SITE (40)..(40): Xaa at position 40 is Ile, Ala, Val, Leu, or Gly
  SITE (44)..(44): Xaa at position 44 is Tyr, Phe, Met, His, Ile, Leu, Val Ala, or Gly
  SITE (65)..(65): Xaa at position 65 is Trp, Tyr, Phe, Met, His, Ile, Leu Val, Ala, or Gly
  SITE (297)..(297): Xaa at position 297 is Ile, Ala, Val, Leu, or Gly
  SITE (298)..(298): Xaa at position 298 is Phe, Tyr, Met, His, Ile, Leu, Val Ala, or Gly
MEPSSKKLTGRLMLAVGGAVLGSLQFGYNTGVINAPQKVXEEFXNQTWVHRYGESILPTTLTTLXSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSXXEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 280 - protein, 524 aa, Homo sapiens
  SITE (10)..(10): Xaa at position 10 is Leu, Ala, Val, Gly, or Ile
  SITE (17)..(17): Xaa at position 17 is Ala, Gly, or Pro
  SITE (26)..(26): Xaa at position 26 is Tyr, Phe, Met, His, Ile, Leu, Val Ala, or Gly
  SITE (30)..(30): Xaa at position 30 is Val, Ala, Gly, Leu, or Ile
  SITE (31)..(31): Xaa at position 31 is Ile, Ala, Val, Leu, or Gly
  SITE (38)..(38): Xaa at position 38 is Ile, Ala, Val, Leu, or Gly
  SITE (42)..(42): Xaa at position 42 is Tyr, Phe, Met, His, Ile, Leu, Val Ala, or Gly
  SITE (97)..(97): Xaa at position 97 is Trp, Tyr, Phe, Met, His, Ile, Leu Val, Ala, or Gly
  SITE (101)..(101): Xaa at position 101 is Val, Ala, Gly, Leu, or Ile
  SITE (104)..(104): Xaa at position 104 is Phe, Tyr, Met, His, Ile, Leu, Val Ala, or Gly
  SITE (128)..(128): Xaa at position 128 is Met, Ile, Leu, Val, Ala, or Gly
  SITE (131)..(131): Xaa at position 131 is Ala, Gly, or Pro
  SITE (139)..(139): Xaa at position 139 is Ala, Gly, or Pro
  SITE (142)..(142): Xaa at position 142 is Met, Ile, Leu, Val, Ala, or Gly
  SITE (154)..(154): Xaa at position 154 is Ile, Ala, Val, Leu, or Gly
  SITE (164)..(164): Xaa at position 164 is Tyr, Phe, Met, His, Ile, Leu, Val Ala, or Gly
  SITE (165)..(165): Xaa at position 165 is Cys, Ala, Val, Gly, Ser, or Thr
  SITE (171)..(171): Xaa at position 171 is Leu, Ala, Val, Gly, or Ile
  SITE (172)..(172): Xaa at position 172 is Val, Ala, Gly, Leu, or Ile
  SITE (174)..(174): Xaa at position 174 is Met, Ile, Leu, Val, Ala, or Gly
  SITE (175)..(175): Xaa at position 175 is Tyr, Phe, Met, His, Ile, Leu, Val Ala, or Gly
  SITE (176)..(176): Xaa at position 176 is Ile, Ala, Val, Leu, or Gly
  SITE (179)..(179): Xaa at position 179 is Ile, Ala, Val, Leu, or Gly
  SITE (218)..(218): Xaa at position 218 is Trp, Tyr, Phe, Met, His, Ile, Leu Val, Ala, or Gly
  SITE (221)..(221): Xaa at position 221 is Leu, Ala, Val, Gly, or Ile
  SITE (222)..(222): Xaa at position 222 is Leu, Ala, Val, Gly, or Ile
  SITE (229)..(229): Xaa at position 229 is Ala, Gly, or Pro
  SITE (234)..(234): Xaa at position 234 is Leu, Ala, Val, Gly, or Ile
  SITE (236)..(236): Xaa at position 236 is Leu, Ala, Val, Gly, or Ile
  SITE (246)..(246): Xaa at position 246 is Leu, Ala, Val, Gly, or Ile
  SITE (256)..(256): Xaa at position 256 is Ala, Gly, or Pro
  SITE (260)..(260): Xaa at position 260 is Leu, Ala, Val, Gly, or Ile
  SITE (263)..(263): Xaa at position 263 is Leu, Ala, Val, Gly, or Ile
  SITE (276)..(276): Xaa at position 276 is Met, Ile, Leu, Val, Ala, or Gly
  SITE (294)..(294): Xaa at position 294 is Leu, Ala, Val, Gly, or Ile
  SITE (304)..(304): Xaa at position 304 is Ile, Ala, Val, Leu, or Gly
  SITE (306)..(306): Xaa at position 306 is Val, Ala, Gly, Leu, or Ile
  SITE (307)..(307): Xaa at position 307 is Ala, Gly, or Pro
  SITE (310)..(310): Xaa at position 310 is Leu, Ala, Val, Gly, or Ile
  SITE (322)..(322): Xaa at position 322 is Ile, Ala, Val, Leu, or Gly
  SITE (325)..(325): Xaa at position 325 is Tyr, Phe, Met, His, Ile, Leu, Val Ala, or Gly
  SITE (329)..(329): Xaa at position 329 is Ile, Ala, Val, Leu, or Gly
  SITE (330)..(330): Xaa at position 330 is Phe, Tyr, Met, His, Ile, Leu, Val Ala, or Gly
  SITE (360)..(360): Xaa at position 360 is Val, Ala, Gly, Leu, or Ile
  SITE (369)..(369): Xaa at position 369 is Phe, Tyr, Met, His, Ile, Leu, Val Ala, or Gly
  SITE (373)..(373): Xaa at position 373 is Met, Ile, Leu, Val, Ala, or Gly
  SITE (376)..(376): Xaa at position 376 is Met, Ile, Leu, Val, Ala, or Gly
  SITE (379)..(379): Xaa at position 379 is Cys, Ala, Val, Gly, Ser, or Thr
  SITE (380)..(380): Xaa at position 380 is Ala, Gly, or Pro
  SITE (383)..(383): Xaa at position 383 is Met, Ile, Leu, Val, Ala, or Gly
  SITE (403)..(403): Xaa at position 403 is Ala, Gly, or Pro
  SITE (404)..(404): Xaa at position 404 is Ile, Ala, Val, Leu, or Gly
  SITE (407)..(407): Xaa at position 407 is Phe, Tyr, Met, His, Ile, Leu, Val Ala, or Gly
  SITE (408)..(408): Xaa at position 408 is Val, Ala, Gly, Leu, or Ile
  SITE (418)..(418): Xaa at position 418 is Ile, Ala, Val, Leu, or Gly
  SITE (422)..(422): Xaa at position 422 is Met, Ile, Leu, Val, Ala, or Gly
  SITE (423)..(423): Xaa at position 423 is Val, Ala, Gly, Leu, or Ile
  SITE (424)..(424): Xaa at position 424 is Ala, Gly, or Pro
  SITE (427)..(427): Xaa at position 427 is Phe, Tyr, Met, His, Ile, Leu, Val Ala, or Gly
  SITE (435)..(435): Xaa at position 435 is Ala, Gly, or Pro
  SITE (439)..(439): Xaa at position 439 is Ala, Gly, or Pro
  SITE (465)..(465): Xaa at position 465 is Val, Ala, Gly, Leu, or Ile
  SITE (466)..(466): Xaa at position 466 is Phe, Tyr, Met, His, Ile, Leu, Val Ala, or Gly
  SITE (473)..(473): Xaa at position 473 is Leu, Ala, Val, Gly, or Ile
  SITE (495)..(495): Xaa at position 495 is Ile, Ala, Val, Leu, or Gly
MTEDKVTGTXVFTVITXVLGSFQFGXDIGXXNAPQQVXISHXRHVLGVPLDDRKAINNYVINSTDELPTISYSMNPKPTPWAEEETVAAAQLITMLXSLSXSSXAVGGMTASFFGGWLGDTLGRIKAXLVXNILSLVGXLLXGFSKLGPSHILXIAGRSISGLXXGLISGXXPXXXGEXAPTALRGALGTFHQLAIVTGILISQIIGLEFILGNYDLXHIXXGLSGVRXILQSXLXFFCPESPRYXYIKLDEEVKXKQSXKRXRGYDDVTKDINEXRKEREEASSEQKVSIIQXFTNSSYRQPXLXXLMXHVAQQFSGINGXFYXSTSXXQTAGISKPVYATIGVGAVNMVFTAVSVFLXEKAGRRSLXLIGXSGXFVXXIFXSVGLVLLNKFSWMSYVSMIXXFLXXSFFEIGPGPXPWFXXXEFXSQGPRPAXLAIXAFSNWTCNFIVALCFQYIADFCGPYXXFLFAGVXLAFTLFTFFKVPETKGKSFEEXAAEFQKKSGSAHRPKAAVEMKFLGATETV

SEQ ID NO: 281 - protein, 359 aa, Homo sapiens
  SITE (38)..(38): Xaa at position 38 is Ala, Gly, or Pro
  SITE (39)..(39): Xaa at position 39 is Ile, Ala, Val, Leu, or Gly
  SITE (43)..(43): Xaa at position 43 is Met, Ile, Leu, Val, Ala, or Gly
  SITE (47)..(47): Xaa at position 47 is Leu, Ala, Val, Gly, or Ile
  SITE (53)..(53): Xaa at position 53 is Val, Ala, Gly, Leu, or Ile
  SITE (55)..(55): Xaa at position 55 is Leu, Ala, Val, Gly, or Ile
  SITE (60)..(60): Xaa at position 60 is Val, Ala, Gly, Leu, or Ile
  SITE (61)..(61): Xaa at position 61 is Ala, Gly, or Pro
  SITE (82)..(82): Xaa at position 82 is Ile, Ala, Val, Leu, or Gly
  SITE (93)..(93): Xaa at position 93 is Ala, Gly, or Pro
  SITE (95)..(95): Xaa at position 95 is Ile, Ala, Val, Leu, or Gly
  SITE (96)..(96): Xaa at position 96 is Ala, Gly, or Pro
  SITE (100)..(100): Xaa at position 100 is Ala, Gly, or Pro
  SITE (107)..(107): Xaa at position 107 is Ile, Ala, Val, Leu, or Gly
  SITE (108)..(108): Xaa at position 108 is Cys, Ala, Val, Gly, Ser, or Thr
  SITE (110)..(110): Xaa at position 110 is Phe, Tyr, Met, His, Ile, Leu, Val Ala, or Gly
  SITE (113)..(113): Xaa at position 113 is Phe, Tyr, Met, His, Ile, Leu, Val Ala, or Gly
  SITE (119)..(119): Xaa at position 119 is Ala, Gly, or Pro
  SITE (123)..(123): Xaa at position 123 is Val, Ala, Gly, Leu, or Ile
  SITE (127)..(127): Xaa at position 127 is Ala, Gly, or Pro
  SITE (140)..(140): Xaa at position 140 is Val, Ala, Gly, Leu, or Ile
  SITE (142)..(142): Xaa at position 142 is Ile, Ala, Val, Leu, or Gly
  SITE (144)..(144): Xaa at position 144 is Phe, Tyr, Met, His, Ile, Leu, Val Ala, or Gly
  SITE (162)..(162): Xaa at position 162 is Phe, Tyr, Met, His, Ile, Leu, Val Ala, or Gly
  SITE (163)..(163): Xaa at position 163 is Ala, Gly, or Pro
  SITE (166)..(166): Xaa at position 166 is Tyr, Phe, Met, His, Ile, Leu, Val Ala, or Gly
  SITE (174)..(174): Xaa at position 174 is Val, Ala, Gly, Leu, or Ile
  SITE (175)..(175): Xaa at position 175 is Val, Ala, Gly, Leu, or Ile
  SITE (183)..(183): Xaa at position 183 is Ala, Gly, or Pro
  SITE (186)..(186): Xaa at position 186 is Leu, Ala, Val, Gly, or Ile
  SITE (187)..(187): Xaa at position 187 is Ile, Ala, Val, Leu, or Gly
  SITE (190)..(190): Xaa at position 190 is Ala, Gly, or Pro
  SITE (197)..(197): Xaa at position 197 is Val, Ala, Gly, Leu, or Ile
  SITE (198)..(198): Xaa at position 198 is Val, Ala, Gly, Leu, or Ile
  SITE (199)..(199): Xaa at position 199 is Val, Ala, Gly, Leu, or Ile
  SITE (200)..(200): Xaa at position 200 is Leu, Ala, Val, Gly, or Ile
  SITE (206)..(206): Xaa at position 206 is Tyr, Phe, Met, His, Ile, Leu, Val Ala, or Gly
  SITE (212)..(212): Xaa at position 212 is Phe, Tyr, Met, His, Ile, Leu, Val Ala, or Gly
  SITE (216)..(216): Xaa at position 216 is Ala, Gly, or Pro
  SITE (225)..(225): Xaa at position 225 is Ile, Ala, Val, Leu, or Gly
  SITE (237)..(237): Xaa at position 237 is Ile, Ala, Val, Leu, or Gly
  SITE (239)..(239): Xaa at position 239 is Val, Ala, Gly, Leu, or Ile
  SITE (240)..(240): Xaa at position 240 is Val, Ala, Gly, Leu, or Ile
  SITE (246)..(246): Xaa at position 246 is Val, Ala, Gly, Leu, or Ile
  SITE (252)..(252): Xaa at position 252 is Ala, Gly, or Pro
  SITE (253)..(253): Xaa at position 253 is Ala, Gly, or Pro
  SITE (256)..(256): Xaa at position 256 is Leu, Ala, Val, Gly, or Ile
  SITE (263)..(263): Xaa at position 263 is Cys, Ala, Val, Gly, Ser, or Thr
  SITE (265)..(265): Xaa at position 265 is Val, Ala, Gly, Leu, or Ile
  SITE (266)..(266): Xaa at position 266 is Ile, Ala, Val, Leu, or Gly
  SITE (268)..(268): Xaa at position 268 is Met, Ile, Leu, Val, Ala, or Gly
  SITE (279)..(279): Xaa at position 279 is Ile, Ala, Val, Leu, or Gly
  SITE (283)..(283): Xaa at position 283 is Val, Ala, Gly, Leu, or Ile
  SITE (289)..(289): Xaa at position 289 is Leu, Ala, Val, Gly, or Ile
  SITE (290)..(290): Xaa at position 290 is Val, Ala, Gly, Leu, or Ile
  SITE (305)..(305): Xaa at position 305 is Ile, Ala, Val, Leu, or Gly
  SITE (309)..(309): Xaa at position 309 is Ile, Ala, Val, Leu, or Gly
  SITE (314)..(314): Xaa at position 314 is Ala, Gly, or Pro
  SITE (337)..(337): Xaa at position 337 is Ile, Ala, Val, Leu, or Gly
  SITE (349)..(349): Xaa at position 349 is Ile, Ala, Val, Leu, or Gly
  SITE (353)..(353): Xaa at position 353 is Ile, Ala, Val, Leu, or Gly
MAAVSGLVRRPLREVSGLLKRRFHWTAPAALQVTVRDXXNQGXDEEXERDEKXFXLGEEXXQYDGAYKVSRGLWKKYGDKRXIDTPISEMGFXGXXVGAXMAGLRPXXEXMTXNFSMQXIDQXINSXAKTYYMSGGLQPXPXVXRGPNGASAGVAAQHSQCXXAWXGHCPGLKXXSPWNSEDXKGXXKSXIRDNNPXXXXENELMXGVPFEXPPEXQSKDFLIPXGKAKIERQGTHXTXXSHSRPXGHCLEXXAVXSKEGVEXEXXNXRTIRPMDMETXEASXMKTNHXXTVEGGWPQFGVGAEXCARXMEGPXFNFLDAPAVRVTGADVPMPYAKXLEDNSIPQVKDXIFAXKKTLNI

SEQ ID NO: 282 - protein, 1152 aa, Homo sapiens
  SITE (27)..(27): Xaa at position 27 is Phe, Tyr, Met, His, Ile, Leu, Val Ala, or Gly
  SITE (34)..(34): Xaa at position 34 is Phe, Tyr, Met, His, Ile, Leu, Val Ala, or Gly
  SITE (46)..(46): Xaa at position 46 is Val, Ala, Gly, Leu, or Ile
  SITE (47)..(47): Xaa at position 47 is Val, Ala, Gly, Leu, or Ile
  SITE (48)..(48): Xaa at position 48 is Val, Ala, Gly, Leu, or Ile
  SITE (50)..(50): Xaa at position 50 is Ala, Gly, or Pro
  SITE (63)..(63): Xaa at position 63 is Leu, Ala, Val, Gly, or Ile
  SITE (66)..(66): Xaa at position 66 is Cys, Ala, Val, Gly, Ser, or Thr
  SITE (84)..(84): Xaa at position 84 is Ala, Gly, or Pro
  SITE (87)..(87): Xaa at position 87 is Met, Ile, Leu, Val, Ala, or Gly
  SITE (89)..(89): Xaa at position 89 is Leu, Ala, Val, Gly, or Ile
  SITE (102)..(102): Xaa at position 102 is Leu, Ala, Val, Gly, or Ile
  SITE (103)..(103): Xaa at position 103 is Leu, Ala, Val, Gly, or Ile
  SITE (104)..(104): Xaa at position 104 is Ala, Gly, or Pro
  SITE (105)..(105): Xaa at position 105 is Cys, Ala, Val, Gly, Ser, or Thr
  SITE (123)..(123): Xaa at position 123 is Cys, Ala, Val, Gly, Ser, or Thr
  SITE (124)..(124): Xaa at position 124 is Phe, Tyr, Met, His, Ile, Leu, Val Ala, or Gly
  SITE (151)..(151): Xaa at position 151 is Ile, Ala, Val, Leu, or Gly
  SITE (152)..(152): Xaa at position 152 is Ala, Gly, or Pro
  SITE (153)..(153): Xaa at position 153 is Phe, Tyr, Met, His, Ile, Leu, Val Ala, or Gly
  SITE (154)..(154): Xaa at position 154 is Leu, Ala, Val, Gly, or Ile
  SITE (155)..(155): Xaa at position 155 is Ile, Ala, Val, Leu, or Gly
  SITE (161)..(161): Xaa at position 161 is Ile, Ala, Val, Leu, or Gly
  SITE (169)..(169): Xaa at position 169 is Met, Ile, Leu, Val, Ala, or Gly
  SITE (172)..(172): Xaa at position 172 is Phe, Tyr, Met, His, Ile, Leu, Val Ala, or Gly
  SITE (173)..(173): Xaa at position 173 is Val, Ala, Gly, Leu, or Ile
  SITE (176)..(176): Xaa at position 176 is Val, Ala, Gly, Leu, or Ile
  SITE (177)..(177): Xaa at position 177 is Met, Ile, Leu, Val, Ala, or Gly
  SITE (180)..(180): Xaa at position 180 is Leu, Ala, Val, Gly, or Ile
  SITE (187)..(187): Xaa at position 187 is Phe, Tyr, Met, His, Ile, Leu, Val Ala, or Gly
  SITE (189)..(189): Xaa at position 189 is Leu, Ala, Val, Gly, or Ile
  SITE (190)..(190): Xaa at position 190 is Met, Ile, Leu, Val, Ala, or Gly
  SITE (192)..(192): Xaa at position 192 is Tyr, Phe, Met, His, Ile, Leu, Val Ala, or Gly
  SITE (200)..(200): Xaa at position 200 is Phe, Tyr, Met, His, Ile, Leu, Val Ala, or Gly
  SITE (202)..(202): Xaa at position 202 is Phe, Tyr, Met, His, Ile, Leu, Val Ala, or Gly
  SITE (205)..(205): Xaa at position 205 is Phe, Tyr, Met, His, Ile, Leu, Val Ala, or Gly
  SITE (215)..(215): Xaa at position 215 is Val, Ala, Gly, Leu, or Ile
  SITE (228)..(228): Xaa at position 228 is Ala, Gly, or Pro
  SITE (231)..(231): Xaa at position 231 is Ile, Ala, Val, Leu, or Gly
  SITE (234)..(234): Xaa at position 234 is Val, Ala, Gly, Leu, or Ile
  SITE (238)..(238): Xaa at position 238 is Leu, Ala, Val, Gly, or Ile
  SITE (252)..(252): Xaa at position 252 is Ile, Ala, Val, Leu, or Gly
  SITE (253)..(253): Xaa at position 253 is Leu, Ala, Val, Gly, or Ile
  SITE (254)..(254): Xaa at position 254 is Val, Ala, Gly, Leu, or Ile
  SITE (255)..(255): Xaa at position 255 is Val, Ala, Gly, Leu, or Ile
  SITE (256)..(256): Xaa at position 256 is Ile, Ala, Val, Leu, or Gly
  SITE (271)..(271): Xaa at position 271 is Val, Ala, Gly, Leu, or Ile
  SITE (272)..(272): Xaa at position 272 is Ile, Ala, Val, Leu, or Gly
  SITE (275)..(275): Xaa at position 275 is Ala, Gly, or Pro
  SITE (280)..(280): Xaa at position 280 is Val, Ala, Gly, Leu, or Ile
  SITE (281)..(281): Xaa at position 281 is Ile, Ala, Val, Leu, or Gly
  SITE (284)..(284): Xaa at position 284 is Val, Ala, Gly, Leu, or Ile
  SITE (285)..(285): Xaa at position 285 is Ile, Ala, Val, Leu, or Gly
  SITE (287)..(287): Xaa at position 287 is Val, Ala, Gly, Leu, or Ile
  SITE (290)..(290): Xaa at position 290 is Ala, Gly, or Pro
  SITE (291)..(291): Xaa at position 291 is Phe, Tyr, Met, His, Ile, Leu, Val Ala, or Gly
  SITE (300)..(300): Xaa at position 300 is Leu, Ala, Val, Gly, or Ile
  SITE (303)..(303): Xaa at position 303 is Ile, Ala, Val, Leu, or Gly
  SITE (304)..(304): Xaa at position 304 is Ala, Gly, or Pro
  SITE (313)..(313): Xaa at position 313 is Phe, Tyr, Met, His, Ile, Leu, Val Ala, or Gly
  SITE (315)..(315): Xaa at position 315 is Val, Ala, Gly, Leu, or Ile
  SITE (318)..(318): Xaa at position 318 is Phe, Tyr, Met, His, Ile, Leu, Val Ala, or Gly
  SITE (320)..(320): Xaa at position 320 is Ala, Gly, or Pro
  SITE (321)..(321): Xaa at position 321 is Leu, Ala, Val, Gly, or Ile
  SITE (328)..(328): Xaa at position 328 is Leu, Ala, Val, Gly, or Ile
  SITE (332)..(332): Xaa at position 332 is Ile, Ala, Val, Leu, or Gly
  SITE (333)..(333): Xaa at position 333 is Phe, Tyr, Met, His, Ile, Leu, Val Ala, or Gly
  SITE (365)..(365): Xaa at position 365 is Leu, Ala, Val, Gly, or Ile
  SITE (366)..(366): Xaa at position 366 is Leu, Ala, Val, Gly, or Ile
  SITE (378)..(378): Xaa at position 378 is Val, Ala, Gly, Leu, or Ile
  SITE (390)..(390): Xaa at position 390 is Ile, Ala, Val, Leu, or Gly
  SITE (399)..(399): Xaa at position 399 is Met, Ile, Leu, Val, Ala, or Gly
  SITE (404)..(404): Xaa at position 404 is Leu, Ala, Val, Gly, or Ile
  SITE (411)..(411): Xaa at position 411 is Ile, Ala, Val, Leu, or Gly
  SITE (419)..(419): Xaa at position 419 is Leu, Ala, Val, Gly, or Ile
  SITE (420)..(420): Xaa at position 420 is Val, Ala, Gly, Leu, or Ile
  SITE (421)..(421): Xaa at position 421 is Leu, Ala, Val, Gly, or Ile
  SITE (423)..(423): Xaa at position 423 is Ala, Gly, or Pro
  SITE (432)..(432): Xaa at position 432 is Val, Ala, Gly, Leu, or Ile
  SITE (433)..(433): Xaa at position 433 is Ala, Gly, or Pro
  SITE (434)..(434): Xaa at position 434 is Met, Ile, Leu, Val, Ala, or Gly
  SITE (435)..(435): Xaa at position 435 is Phe, Tyr, Met, His, Ile, Leu, Val Ala, or Gly
  SITE (464)..(464): Xaa at position 464 is Val, Ala, Gly, Leu, or Ile
  SITE (466)..(466): Xaa at position 466 is Val, Ala, Gly, Leu, or Ile
  SITE (474)..(474): Xaa at position 474 is Leu, Ala, Val, Gly, or Ile
  SITE (475)..(475): Xaa at position 475 is Val, Ala, Gly, Leu, or Ile
  SITE (476)..(476): Xaa at position 476 is Leu, Ala, Val, Gly, or Ile
  SITE (477)..(477): Xaa at position 477 is Ile, Ala, Val, Leu, or Gly
  SITE (479)..(479): Xaa at position 479 is Ala, Gly, or Pro
  SITE (491)..(491): Xaa at position 491 is Val, Ala, Gly, Leu, or Ile
  SITE (493)..(493): Xaa at position 493 is Val, Ala, Gly, Leu, or Ile
  SITE (494)..(494): Xaa at position 494 is Cys, Ala, Val, Gly, Ser, or Thr
  SITE (509)..(509): Xaa at position 509 is Leu, Ala, Val, Gly, or Ile
  SITE (520)..(520): Xaa at position 520 is Phe, Tyr, Met, His, Ile, Leu, Val Ala, or Gly
  SITE (527)..(527): Xaa at position 527 is Leu, Ala, Val, Gly, or Ile
  SITE (530)..(530): Xaa at position 530 is Val, Ala, Gly, Leu, or Ile
  SITE (538)..(538): Xaa at position 538 is Val, Ala, Gly, Leu, or Ile
  SITE (539)..(539): Xaa at position 539 is Ala, Gly, or Pro
  SITE (540)..(540): Xaa at position 540 is Ile, Ala, Val, Leu, or Gly
  SITE (542)..(542): Xaa at position 542 is Ala, Gly, or Pro
  SITE (551)..(551): Xaa at position 551 is Ala, Gly, or Pro
  SITE (552)..(552): Xaa at position 552 is Val, Ala, Gly, Leu, or Ile
  SITE (553)..(553): Xaa at position 553 is Tyr, Phe, Met, His, Ile, Leu, Val Ala, or Gly
  SITE (554)..(554): Xaa at position 554 is Leu, Ala, Val, Gly, or Ile
  SITE (555)..(555): Xaa at position 555 is Phe, Tyr, Met, His, Ile, Leu, Val Ala, or Gly
  SITE (571)..(571): Xaa at position 571 is Ile, Ala, Val, Leu, or Gly
  SITE (572)..(572): Xaa at position 572 is Ala, Gly, or Pro
  SITE (580)..(580): Xaa at position 580 is Leu, Ala, Val, Gly, or Ile
  SITE (583)..(583): Xaa at position 583 is Phe, Tyr, Met, His, Ile, Leu, Val Ala, or Gly
  SITE (601)..(601): Xaa at position 601 is Leu, Ala, Val, Gly, or Ile
  SITE (603)..(603): Xaa at position 603 is Val, Ala, Gly, Leu, or Ile
  SITE (605)..(605): Xaa at position 605 is Ala, Gly, or Pro
  SITE (609)..(609): Xaa at position 609 is Val, Ala, Gly, Leu, or Ile
  SITE (612)..(612): Xaa at position 612 is Leu, Ala, Val, Gly, or Ile
  SITE (617)..(617): Xaa at position 617 is Val, Ala, Gly, Leu, or Ile
  SITE (618)..(618): Xaa at position 618 is Leu, Ala, Val, Gly, or Ile
  SITE (631)..(631): Xaa at position 631 is Val, Ala, Gly, Leu, or Ile
  SITE (657)..(657): Xaa at position 657 is Val, Ala, Gly, Leu, or Ile
  SITE (670)..(670): Xaa at position 670 is Ile, Ala, Val, Leu, or Gly
  SITE (674)..(674): Xaa at position 674 is Val, Ala, Gly, Leu, or Ile
  SITE (680)..(680): Xaa at position 680 is Leu, Ala, Val, Gly, or Ile
  SITE (689)..(689): Xaa at position 689 is Ala, Gly, or Pro
  SITE (691)..(691): Xaa at position 691 is Phe, Tyr, Met, His, Ile, Leu, Val Ala, or Gly
  SITE (714)..(714): Xaa at position 714 is Leu, Ala, Val, Gly, or Ile
  SITE (716)..(716): Xaa at position 716 is Leu, Ala, Val, Gly, or Ile
  SITE (718)..(718): Xaa at position 718 is Leu, Ala, Val, Gly, or Ile
  SITE (729)..(729): Xaa at position 729 is Ile, Ala, Val, Leu, or Gly
  SITE (731)..(731): Xaa at position 731 is Leu, Ala, Val, Gly, or Ile
  SITE (733)..(733): Xaa at position 733 is Leu, Ala, Val, Gly, or Ile
  SITE (748)..(748): Xaa at position 748 is Leu, Ala, Val, Gly, or Ile
  SITE (764)..(764): Xaa at position 764 is Phe, Tyr, Met, His, Ile, Leu, Val Ala, or Gly
  SITE (792)..(792): Xaa at position 792 is Leu, Ala, Val, Gly, or Ile
  SITE (794)..(794): Xaa at position 794 is Val, Ala, Gly, Leu, or Ile
  SITE (800)..(800): Xaa at position 800 is Phe, Tyr, Met, His, Ile, Leu, Val Ala, or Gly
  SITE (802)..(802): Xaa at position 802 is Val, Ala, Gly, Leu, or Ile
  SITE (804)..(804): Xaa at position 804 is Val, Ala, Gly, Leu, or Ile
  SITE (806)..(806): Xaa at position 806 is Val, Ala, Gly, Leu, or Ile
  SITE (818)..(818): Xaa at position 818 is Val, Ala, Gly, Leu, or Ile
  SITE (820)..(820): Xaa at position 820 is Phe, Tyr, Met, His, Ile, Leu, Val Ala, or Gly
  SITE (822)..(822): Xaa at position 822 is Phe, Tyr, Met, His, Ile, Leu, Val Ala, or Gly
  SITE (864)..(864): Xaa at position 864 is Cys, Ala, Val, Gly, Ser, or Thr
  SITE (881)..(881): Xaa at position 881 is Ile, Ala, Val, Leu, or Gly
  SITE (883)..(883): Xaa at position 883 is Phe, Tyr, Met, His, Ile, Leu, Val Ala, or Gly
  SITE (889)..(889): Xaa at position 889 is Ala, Gly, or Pro
  SITE (895)..(895): Xaa at position 895 is Leu, Ala, Val, Gly, or Ile
  SITE (897)..(897): Xaa at position 897 is Leu, Ala, Val, Gly, or Ile
  SITE (899)..(899): Xaa at position 899 is Ala, Gly, or Pro
  SITE (925)..(925): Xaa at position 925 is Val, Ala, Gly, Leu, or Ile
  SITE (951)..(951): Xaa at position 951 is Met, Ile, Leu, Val, Ala, or Gly
  SITE (953)..(953): Xaa at position 953 is His, Phe, Tyr, Lys, Arg, Gly, Ser Thr, Ala, Val, Leu, Ile, Asn, Met, or Gln
  SITE (955)..(955): Xaa at position 955 is Tyr, Phe, Met, His, Ile, Leu, Val Ala, or Gly
  SITE (957)..(957): Xaa at position 957 is Val, Ala, Gly, Leu, or Ile
  SITE (965)..(965): Xaa at position 965 is Leu, Ala, Val, Gly, or Ile
  SITE (967)..(967): Xaa at position 967 is Ile, Ala, Val, Leu, or Gly
  SITE (969)..(969): Xaa at position 969 is Leu, Ala, Val, Gly, or Ile
  SITE (971)..(971): Xaa at position 971 is Phe, Tyr, Met, His, Ile, Leu, Val Ala, or Gly
  SITE (973)..(973): Xaa at position 973 is Val, Ala, Gly, Leu, or Ile
  SITE (977)..(977): Xaa at position 977 is Leu, Ala, Val, Gly, or Ile
  SITE (982)..(982): Xaa at position 982 is Ile, Ala, Val, Leu, or Gly
  SITE (983)..(983): Xaa at position 983 is Trp, Tyr, Phe, Met, His, Ile, Leu Val, Ala, or Gly
  SITE (1014)..(1014): Xaa at position 1014 is Leu, Ala, Val, Gly, or Ile
  SITE (1020)..(1020): Xaa at position 1020 is Val, Ala, Gly, Leu, or Ile
  SITE (1025)..(1025): Xaa at position 1025 is Ala, Gly, or Pro
  SITE (1027)..(1027): Xaa at position 1027 is Cys, Ala, Val, Gly, Ser, or Thr
  SITE (1032)..(1032): Xaa at position 1032 is Cys, Ala, Val, Gly, Ser, or Thr
  SITE (1037)..(1037): Xaa at position 1037 is Phe, Tyr, Met, His, Ile, Leu Val, Ala, or Gly
  SITE (1039)..(1039): Xaa at position 1039 is Ile, Ala, Val, Leu, or Gly
  SITE (1043)..(1043): Xaa at position 1043 is Phe, Tyr, Met, His, Ile, Leu Val, Ala, or Gly
  SITE (1045)..(1045): Xaa at position 1045 is Ala, Gly, or Pro
  SITE (1047)..(1047): Xaa at position 1047 is Leu, Ala, Val, Gly, or Ile
  SITE (1051)..(1051): Xaa at position 1051 is Leu, Ala, Val, Gly, or Ile
  SITE (1055)..(1055): Xaa at position 1055 is Trp, Tyr, Phe, Met, His, Ile Leu, Val, Ala, or Gly
  SITE (1064)..(1064): Xaa at position 1064 is Leu, Ala, Val, Gly, or Ile
  SITE (1066)..(1066): Xaa at position 1066 is Ile, Ala, Val, Leu, or Gly
  SITE (1070)..(1070): Xaa at position 1070 is Ala, Gly, or Pro
  SITE (1072)..(1072): Xaa at position 1072 is Ile, Ala, Val, Leu, or Gly
  SITE (1097)..(1097): Xaa at position 1097 is Val, Ala, Gly, Leu, or Ile
MALRVLLLTALTLCHGFNLDTENAMTXQENARGXGQSVVQLQGSRXXXGXPQEIVAANQRGSXYQXDYSTGSCEPIRLQVPVEXVNXSXGLSLAATTSPPQXXXXGPTVHQTCSENTYVKGLXXLFGSNLRQQPQKFPEALRGCPQEDSDXXXXXDGSGSXIPHDFRRXKEXXSTXXEQXKKSKTLXSXXQXSEEFRIHXTXKEXQNNPNPRSLXKPITQLLGRTHTXTGXRKXVREXFNITNGARKNAFKXXXXXTDGEKFGDPLGYEDXXPEXDREGXXRYXXGXGDXXRSEKSRQEXNTXXSKPPRDHVXQXNNXEXXKTIQNQXREKXXAIEGTQTGSSSSFEHEMSQEGFSAAITSNGPXXSTVGSYDWAGGXFLYTSKEKSTFXNMTRVDSDXNDAYXGYAAAIXLRNRVQSXXXGXPRYQHIGLXXXXRQNTGMWESNANVKGTQIGAYFGASLCSXDXDSNGSTDXXXXGXPHYYEQTRGGQXSXXPLPRGRARWQCDAVXYGEQGQPWGRXGAALTVXGDXNGDKLTDXXXGXPGEEDNRGXXXXXHGTSGSGISPSHSQRXXGSKLSPRXQYXGQSLSGGQDLTMDGLVDXTXGXQGHXLLXRSQPXXRVKAIMEFNPREXARNVFECNDQVVKGKEAGEVRVCLHXQKSTRDRLREGQXQSVXTYDLAXDSGRPHSRXVXNETKNSTRRQTQVLGLTQTCETXKXQXPNCIEDPVSPXVXRXNFSLVGTPLSAFGNXRPVLAEDAQRLFTALXPFEKNCGNDNICQDDLSITFSFMSLDCXVXGGPREXNXTXTXRNDGEDSYRTQXTXFXPLDLSYRKVSTLQNQRSQRSWRLACESASSTEVSGALKSTSXSINHPIFPENSEVTFNXTXDVDSKXSLGNKXLXKXNVTSENNMPRTNKTEFQLELPVKYAXYMVVTSHGVSTKYLNFTASENTSRVXQXQXQXSNLGQRSXPXSXVXLXPVRXNQTVXXDRPQVTFSENLSSTCHTKERLPSHSDFLAEXRKAPVXNCSIXVXQRIQXDIPFXGXQEEXNXTXKGNXSFDXYIKTSHNHXLXVSTXEXLFNDSVFTLLPGQGAFVRSQTETKXEPFEVPNPLPLIVGSSVGGLLLLALITAALYKLGFFKRQYKDMMSEGGPPGAEPQ

SEQ ID NO: 283 - protein, 842 aa, Homo sapiens
  SITE (16)..(16): Xaa at position 16 is Val, Ala, Gly, Leu, or Ile
  SITE (25)..(25): Xaa at position 25 is Val, Ala, Gly, Leu, or Ile
  SITE (28)..(28): Xaa at position 28 is Leu, Ala, Val, Gly, or Ile
  SITE (36)..(36): Xaa at position 36 is Leu, Ala, Val, Gly, or Ile
  SITE (54)..(54): Xaa at position 54 is Phe, Tyr, Met, His, Ile, Leu, Val Ala, or Gly
  SITE (55)..(55): Xaa at position 55 is Ala, Gly, or Pro
  SITE (57)..(57): Xaa at position 57 is Ala, Gly, or Pro
  SITE (60)..(60): Xaa at position 60 is Val, Ala, Gly, Leu, or Ile
  SITE (64)..(64): Xaa at position 64 is Leu, Ala, Val, Gly, or Ile
  SITE (83)..(83): Xaa at position 83 is Ile, Ala, Val, Leu, or Gly
  SITE (84)..(84): Xaa at position 84 is Tyr, Phe, Met, His, Ile, Leu, Val Ala, or Gly
  SITE (85)..(85): Xaa at position 85 is Tyr, Phe, Met, His, Ile, Leu, Val Ala, or Gly
  SITE (86)..(86): Xaa at position 86 is Leu, Ala, Val, Gly, or Ile
  SITE (88)..(88): Xaa at position 88 is Leu, Ala, Val, Gly, or Ile
  SITE (90)..(90): Xaa at position 90 is Phe, Tyr, Met, His, Ile, Leu, Val Ala, or Gly
  SITE (96)..(96): Xaa at position 96 is Leu, Ala, Val, Gly, or Ile
  SITE (100)..(100): Xaa at position 100 is Met, Ile, Leu, Val, Ala, or Gly
  SITE (101)..(101): Xaa at position 101 is Val, Ala, Gly, Leu, or Ile
  SITE (105)..(105): Xaa at position 105 is Leu, Ala, Val, Gly, or Ile
  SITE (108)..(108): Xaa at position 108 is Ala, Gly, or Pro
  SITE (109)..(109): Xaa at position 109 is Cys, Ala, Val, Gly, Ser, or Thr
  SITE (118)..(118): Xaa at position 118 is Leu, Ala, Val, Gly, or Ile
  SITE (123)..(123): Xaa at position 123 is Leu, Ala, Val, Gly, or Ile
  SITE (132)..(132): Xaa at position 132 is Leu, Ala, Val, Gly, or Ile
  SITE (137)..(137): Xaa at position 137 is Leu, Ala, Val, Gly, or Ile
  SITE (140)..(140): Xaa at position 140 is Leu, Ala, Val, Gly, or Ile
  SITE (141)..(141): Xaa at position 141 is Ala, Gly, or Pro
  SITE (142)..(142): Xaa at position 142 is Ala, Gly, or Pro
  SITE (143)..(143): Xaa at position 143 is Cys, Ala, Val, Gly, Ser, or Thr
  SITE (144)..(144): Xaa at position 144 is Phe, Tyr, Met, His, Ile, Leu, Val Ala, or Gly
  SITE (148)..(148): Xaa at position 148 is Met, Ile, Leu, Val, Ala, or Gly
  SITE (149)..(149): Xaa at position 149 is Ala, Gly, or Pro
  SITE (151)..(151): Xaa at position 151 is Leu, Ala, Val, Gly, or Ile
  SITE (153)..(153): Xaa at position 153 is Leu, Ala, Val, Gly, or Ile
  SITE (154)..(154): Xaa at position 154 is Ala, Gly, or Pro
  SITE (155)..(155): Xaa at position 155 is Ala, Gly, or Pro
  SITE (156)..(156): Xaa at position 156 is Tyr, Phe, Met, His, Ile, Leu, Val Ala, or Gly
  SITE (158)..(158): Xaa at position 158 is Tyr, Phe, Met, His, Ile, Leu, Val Ala, or Gly
  SITE (160)..(160): Xaa at position 160 is Ile, Ala, Val, Leu, or Gly
  SITE (162)..(162): Xaa at position 162 is Tyr, Phe, Met, His, Ile, Leu, Val Ala, or Gly
  SITE (201)..(201): Xaa at position 201 is Val, Ala, Gly, Leu, or Ile
  SITE (203)..(203): Xaa at position 203 is Phe, Tyr, Met, His, Ile, Leu, Val Ala, or Gly
  SITE (222)..(222): Xaa at position 222 is Val, Ala, Gly, Leu, or Ile
  SITE (224)..(224): Xaa at position 224 is Ala, Gly, or Pro
  SITE (238)..(238): Xaa at position 238 is Val, Ala, Gly, Leu, or Ile
  SITE (239)..(239): Xaa at position 239 is Val, Ala, Gly, Leu, or Ile
  SITE (242)..(242): Xaa at position 242 is Met, Ile, Leu, Val, Ala, or Gly
  SITE (244)..(244): Xaa at position 244 is Leu, Ala, Val, Gly, or Ile
  SITE (245)..(245): Xaa at position 245 is Trp, Tyr, Phe, Met, His, Ile, Leu Val, Ala, or Gly
  SITE (247)..(247): Xaa at position 247 is Ala, Gly, or Pro
  SITE (273)..(273): Xaa at position 273 is Ala, Gly, or Pro
  SITE (276)..(276): Xaa at position 276 is Ile, Ala, Val, Leu, or Gly
  SITE (280)..(280): Xaa at position 280 is Leu, Ala, Val, Gly, or Ile
  SITE (294)..(294): Xaa at position 294 is Leu, Ala, Val, Gly, or Ile
  SITE (298)..(298): Xaa at position 298 is Tyr, Phe, Met, His, Ile, Leu, Val Ala, or Gly
  SITE (299)..(299): Xaa at position 299 is Phe, Tyr, Met, His, Ile, Leu, Val Ala, or Gly
  SITE (300)..(300): Xaa at position 300 is Val, Ala, Gly, Leu, or Ile
  SITE (301)..(301): Xaa at position 301 is Val, Ala, Gly, Leu, or Ile
  SITE (302)..(302): Xaa at position 302 is Ala, Gly, or Pro
  SITE (303)..(303): Xaa at position 303 is Ala, Gly, or Pro
  SITE (305)..(305): Xaa at position 305 is Leu, Ala, Val, Gly, or Ile
  SITE (308)..(308): Xaa at position 308 is Ile, Ala, Val, Leu, or Gly
  SITE (309)..(309): Xaa at position 309 is Ile, Ala, Val, Leu, or Gly
  SITE (317)..(317): Xaa at position 317 is Phe, Tyr, Met, His, Ile, Leu, Val Ala, or Gly
  SITE (327)..(327): Xaa at position 327 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (334)..(334): Xaa at position 334 is Val, Ala, Gly, Leu, or Ile
  SITE (336)..(336): Xaa at position 336 is Ile, Ala, Val, Leu, or Gly
  SITE (338)..(338): Xaa at position 338 is Leu, Ala, Val, Gly, or Ile
  SITE (345)..(345): Xaa at position 345 is Leu, Ala, Val, Gly, or Ile
  SITE (346)..(346): Xaa at position 346 is Ala, Gly, or Pro
  SITE (347)..(347): Xaa at position 347 is Ile, Ala, Val, Leu, or Gly
  SITE (350)..(350): Xaa at position 350 is Leu, Ala, Val, Gly, or Ile
  SITE (351)..(351): Xaa at position 351 is Met, Ile, Leu, Val, Ala, or Gly
  SITE (354)..(354): Xaa at position 354 is Leu, Ala, Val, Gly, or Ile
  SITE (357)..(357): Xaa at position 357 is Leu, Ala, Val, Gly, or Ile
  SITE (360)..(360): Xaa at position 360 is Met, Ile, Leu, Val, Ala, or Gly
  SITE (365)..(365): Xaa at position 365 is Ala, Gly, or Pro
  SITE (368)..(368): Xaa at position 368 is Val, Ala, Gly, Leu, or Ile
  SITE (373)..(373): Xaa at position 373 is Cys, Ala, Val, Gly, Ser, or Thr
  SITE (374)..(374): Xaa at position 374 is Ala, Gly, or Pro
  SITE (375)..(375): Xaa at position 375 is Tyr, Phe, Met, His, Ile, Leu, Val Ala, or Gly
  SITE (380)..(380): Xaa at position 380 is Val, Ala, Gly, Leu, or Ile
  SITE (388)..(388): Xaa at position 388 is Trp, Tyr, Phe, Met, His, Ile, Leu Val, Ala, or Gly
  SITE (392)..(392): Xaa at position 392 is Leu, Ala, Val, Gly, or Ile
  SITE (393)..(393): Xaa at position 393 is Leu, Ala, Val, Gly, or Ile
  SITE (396)..(396): Xaa at position 396 is Leu, Ala, Val, Gly, or Ile
  SITE (397)..(397): Xaa at position 397 is Leu, Ala, Val, Gly, or Ile
  SITE (400)..(400): Xaa at position 400 is His, Phe, Tyr, Lys, Arg, Gly, Ser Thr, Ala, Val, Leu, Ile, Asn, Met, or Gln
  SITE (403)..(403): Xaa at position 403 is Ile, Ala, Val, Leu, or Gly
  SITE (404)..(404): Xaa at position 404 is Ile, Ala, Val, Leu, or Gly
  SITE (407)..(407): Xaa at position 407 is Ile, Ala, Val, Leu, or Gly
  SITE (411)..(411): Xaa at position 411 is Phe, Tyr, Met, His, Ile, Leu, Val Ala, or Gly
  SITE (415)..(415): Xaa at position 415 is Val, Ala, Gly, Leu, or Ile
  SITE (418)..(418): Xaa at position 418 is Ala, Gly, or Pro
  SITE (429)..(429): Xaa at position 429 is Met, Ile, Leu, Val, Ala, or Gly
  SITE (431)..(431): Xaa at position 431 is Leu, Ala, Val, Gly, or Ile
  SITE (432)..(432): Xaa at position 432 is Val, Ala, Gly, Leu, or Ile
  SITE (440)..(440): Xaa at position 440 is Ile, Ala, Val, Leu, or Gly
  SITE (442)..(442): Xaa at position 442 is Met, Ile, Leu, Val, Ala, or Gly
  SITE (443)..(443): Xaa at position 443 is Ala, Gly, or Pro
  SITE (445)..(445): Xaa at position 445 is Leu, Ala, Val, Gly, or Ile
  SITE (446)..(446): Xaa at position 446 is Cys, Ala, Val, Gly, Ser, or Thr
  SITE (447)..(447): Xaa at position 447 is Ile, Ala, Val, Leu, or Gly
  SITE (448)..(448): Xaa at position 448 is Ala, Gly, or Pro
  SITE (452)..(452): Xaa at position 452 is Ala, Gly, or Pro
  SITE (453)..(453): Xaa at position 453 is Val, Ala, Gly, Leu, or Ile
  SITE (456)..(456): Xaa at position 456 is Val, Ala, Gly, Leu, or Ile
  SITE (457)..(457): Xaa at position 457 is Ala, Gly, or Pro
  SITE (459)..(459): Xaa at position 459 is Ile, Ala, Val, Leu, or Gly
  SITE (460)..(460): Xaa at position 460 is His, Phe, Tyr, Lys, Arg, Gly, Ser Thr, Ala, Val, Leu, Ile, Asn, Met, or Gln
  SITE (464)..(464): Xaa at position 464 is Leu, Ala, Val, Gly, or Ile
  SITE (469)..(469): Xaa at position 469 is Phe, Tyr, Met, His, Ile, Leu, Val Ala, or Gly
  SITE (472)..(472): Xaa at position 472 is Phe, Tyr, Met, His, Ile, Leu, Val Ala, or Gly
  SITE (475)..(475): Xaa at position 475 is Leu, Ala, Val, Gly, or Ile
  SITE (487)..(487): Xaa at position 487 is Ile, Ala, Val, Leu, or Gly
  SITE (492)..(492): Xaa at position 492 is Trp, Tyr, Phe, Met, His, Ile, Leu Val, Ala, or Gly
  SITE (493)..(493): Xaa at position 493 is Leu, Ala, Val, Gly, or Ile
  SITE (494)..(494): Xaa at position 494 is Val, Ala, Gly, Leu, or Ile
  SITE (501)..(501): Xaa at position 501 is Ala, Gly, or Pro
  SITE (503)..(503): Xaa at position 503 is Val, Ala, Gly, Leu, or Ile
  SITE (504)..(504): Xaa at position 504 is Ile, Ala, Val, Leu, or Gly
  SITE (512)..(512): Xaa at position 512 is Phe, Tyr, Met, His, Ile, Leu, Val Ala, or Gly
  SITE (513)..(513): Xaa at position 513 is Ile, Ala, Val, Leu, or Gly
  SITE (516)..(516): Xaa at position 516 is Leu, Ala, Val, Gly, or Ile
  SITE (519)..(519): Xaa at position 519 is Leu, Ala, Val, Gly, or Ile
  SITE (522)..(522): Xaa at position 522 is Leu, Ala, Val, Gly, or Ile
  SITE (523)..(523): Xaa at position 523 is Leu, Ala, Val, Gly, or Ile
  SITE (531)..(531): Xaa at position 531 is Phe, Tyr, Met, His, Ile, Leu, Val Ala, or Gly
  SITE (532)..(532): Xaa at position 532 is Ile, Ala, Val, Leu, or Gly
  SITE (538)..(538): Xaa at position 538 is Val, Ala, Gly, Leu, or Ile
  SITE (544)..(544): Xaa at position 544 is Leu, Ala, Val, Gly, or Ile
  SITE (546)..(546): Xaa at position 546 is Phe, Tyr, Met, His, Ile, Leu, Val Ala, or Gly
  SITE (550)..(550): Xaa at position 550 is Leu, Ala, Val, Gly, or Ile
  SITE (563)..(563): Xaa at position 563 is Leu, Ala, Val, Gly, or Ile
  SITE (564)..(564): Xaa at position 564 is Phe, Tyr, Met, His, Ile, Leu, Val Ala, or Gly
  SITE (566)..(566): Xaa at position 566 is Ile, Ala, Val, Leu, or Gly
  SITE (571)..(571): Xaa at position 571 is Ile, Ala, Val, Leu, or Gly
  SITE (574)..(574): Xaa at position 574 is Tyr, Phe, Met, His, Ile, Leu, Val Ala, or Gly
  SITE (578)..(578): Xaa at position 578 is Leu, Ala, Val, Gly, or Ile
  SITE (579)..(579): Xaa at position 579 is Leu, Ala, Val, Gly, or Ile
  SITE (581)..(581): Xaa at position 581 is Cys, Ala, Val, Gly, Ser, or Thr
  SITE (582)..(582): Xaa at position 582 is Leu, Ala, Val, Gly, or Ile
  SITE (583)..(583): Xaa at position 583 is His, Phe, Tyr, Lys, Arg, Gly, Ser Thr, Ala, Val, Leu, Ile, Asn, Met, or Gln
  SITE (584)..(584): Xaa at position 584 is Val, Ala, Gly, Leu, or Ile
  SITE (585)..(585): Xaa at position 585 is Ile, Ala, Val, Leu, or Gly
  SITE (591)..(591): Xaa at position 591 is Ile, Ala, Val, Leu, or Gly
  SITE (604)..(604): Xaa at position 604 is Val, Ala, Gly, Leu, or Ile
  SITE (605)..(605): Xaa at position 605 is Met, Ile, Leu, Val, Ala, or Gly
  SITE (606)..(606): Xaa at position 606 is Ile, Ala, Val, Leu, or Gly
  SITE (610)..(610): Xaa at position 610 is Ala, Gly, or Pro
  SITE (611)..(611): Xaa at position 611 is Ala, Gly, or Pro
  SITE (616)..(616): Xaa at position 616 is Met, Ile, Leu, Val, Ala, or Gly
  SITE (617)..(617): Xaa at position 617 is Ala, Gly, or Pro
  SITE (620)..(620): Xaa at position 620 is Ile, Ala, Val, Leu, or Gly
  SITE (621)..(621): Xaa at position 621 is Ile, Ala, Val, Leu, or Gly
  SITE (623)..(623): Xaa at position 623 is Leu, Ala, Val, Gly, or Ile
  SITE (624)..(624): Xaa at position 624 is Val, Ala, Gly, Leu, or Ile
  SITE (626)..(626): Xaa at position 626 is Ala, Gly, or Pro
  SITE (627)..(627): Xaa at position 627 is Ile, Ala, Val, Leu, or Gly
  SITE (630)..(630): Xaa at position 630 is Val, Ala, Gly, Leu, or Ile
  SITE (631)..(631): Xaa at position 631 is Val, Ala, Gly, Leu, or Ile
  SITE (636)..(636): Xaa at position 636 is Ala, Gly, or Pro
  SITE (637)..(637): Xaa at position 637 is Val, Ala, Gly, Leu, or Ile
  SITE (641)..(641): Xaa at position 641 is Leu, Ala, Val, Gly, or Ile
  SITE (643)..(643): Xaa at position 643 is Val, Ala, Gly, Leu, or Ile
  SITE (646)..(646): Xaa at position 646 is Leu, Ala, Val, Gly, or Ile
  SITE (653)..(653): Xaa at position 653 is Leu, Ala, Val, Gly, or Ile
  SITE (654)..(654): Xaa at position 654 is Ala, Gly, or Pro
  SITE (657)..(657): Xaa at position 657 is Val, Ala, Gly, Leu, or Ile
  SITE (658)..(658): Xaa at position 658 is Ile, Ala, Val, Leu, or Gly
  SITE (660)..(660): Xaa at position 660 is Ala, Gly, or Pro
  SITE (661)..(661): Xaa at position 661 is Ala, Gly, or Pro
  SITE (663)..(663): Xaa at position 663 is Leu, Ala, Val, Gly, or Ile
  SITE (667)..(667): Xaa at position 667 is Ile, Ala, Val, Leu, or Gly
  SITE (670)..(670): Xaa at position 670 is Ala, Gly, or Pro
  SITE (680)..(680): Xaa at position 680 is Met, Ile, Leu, Val, Ala, or Gly
  SITE (682)..(682): Xaa at position 682 is Phe, Tyr, Met, His, Ile, Leu, Val Ala, or Gly
  SITE (683)..(683): Xaa at position 683 is Met, Ile, Leu, Val, Ala, or Gly
  SITE (684)..(684): Xaa at position 684 is Leu, Ala, Val, Gly, or Ile
  SITE (687)..(687): Xaa at position 687 is Ala, Gly, or Pro
  SITE (688)..(688): Xaa at position 688 is Leu, Ala, Val, Gly, or Ile
  SITE (690)..(690): Xaa at position 690 is Ile, Ala, Val, Leu, or Gly
  SITE (696)..(696): Xaa at position 696 is Ala, Gly, or Pro
  SITE (700)..(700): Xaa at position 700 is Met, Ile, Leu, Val, Ala, or Gly
  SITE (701)..(701): Xaa at position 701 is Ala, Gly, or Pro
  SITE (712)..(712): Xaa at position 712 is Phe, Tyr, Met, His, Ile, Leu, Val Ala, or Gly
  SITE (729)..(729): Xaa at position 729 is Ala, Gly, or Pro
  SITE (736)..(736): Xaa at position 736 is Ile, Ala, Val, Leu, or Gly
  SITE (739)..(739): Xaa at position 739 is Leu, Ala, Val, Gly, or Ile
  SITE (742)..(742): Xaa at position 742 is Val, Ala, Gly, Leu, or Ile
  SITE (743)..(743): Xaa at position 743 is Ile, Ala, Val, Leu, or Gly
  SITE (746)..(746): Xaa at position 746 is Leu, Ala, Val, Gly, or Ile
  SITE (759)..(759): Xaa at position 759 is Phe, Tyr, Met, His, Ile, Leu, Val Ala, or Gly
  SITE (762)..(762): Xaa at position 762 is Ile, Ala, Val, Leu, or Gly
  SITE (765)..(765): Xaa at position 765 is Met, Ile, Leu, Val, Ala, or Gly
  SITE (766)..(766): Xaa at position 766 is Leu, Ala, Val, Gly, or Ile
  SITE (772)..(772): Xaa at position 772 is Phe, Tyr, Met, His, Ile, Leu, Val Ala, or Gly
  SITE (775)..(775): Xaa at position 775 is Phe, Tyr, Met, His, Ile, Leu, Val Ala, or Gly
  SITE (778)..(778): Xaa at position 778 is Tyr, Phe, Met, His, Ile, Leu, Val Ala, or Gly
  SITE (781)..(781): Xaa at position 781 is Tyr, Phe, Met, His, Ile, Leu, Val Ala, or Gly
  SITE (782)..(782): Xaa at position 782 is Ile, Ala, Val, Leu, or Gly
  SITE (784)..(784): Xaa at position 784 is Cys, Ala, Val, Gly, Ser, or Thr
  SITE (788)..(788): Xaa at position 788 is Val, Ala, Gly, Leu, or Ile
  SITE (792)..(792): Xaa at position 792 is Tyr, Phe, Met, His, Ile, Leu, Val Ala, or Gly
  SITE (802)..(802): Xaa at position 802 is Val, Ala, Gly, Leu, or Ile
  SITE (803)..(803): Xaa at position 803 is Ile, Ala, Val, Leu, or Gly
  SITE (806)..(806): Xaa at position 806 is Ile, Ala, Val, Leu, or Gly
  SITE (807)..(807): Xaa at position 807 is Ala, Gly, or Pro
  SITE (812)..(812): Xaa at position 812 is Phe, Tyr, Met, His, Ile, Leu, Val Ala, or Gly
  SITE (818)..(818): Xaa at position 818 is Ile, Ala, Val, Leu, or Gly
  SITE (819)..(819): Xaa at position 819 is Ala, Gly, or Pro
  SITE (821)..(821): Xaa at position 821 is Tyr, Phe, Met, His, Ile, Leu, Val Ala, or Gly
  SITE (822)..(822): Xaa at position 822 is Ala, Gly, or Pro
  SITE (826)..(826): Xaa at position 826 is Trp, Tyr, Phe, Met, His, Ile, Leu Val, Ala, or Gly
MSRPLSDQEKRKQISXRGLAGVENXTEXKKNFNRHXHFTLVKDRNVATPRDYYXXLXHTXRDHXVGRWIRTQQHYYEKDPKRXXXXSXEXYMGRTXQNTXXNLAXENXXDEATYQLGXDMEEXEEIEEDAGXGNGGXGRXXXXXLDSXXTXGXXXXGXGXRXEFGIFNQKISGGWQMEEADDWLRYGNPWEKARPEFTLPXHXYGHVEHTSQGAKWVDTQVXLXMPYDTPVPGYRNNXXNTXRXXSXKAPNDFNLKDFNVGGYIQAVLDRNLXENXSRVXYPNDNFFEGKELRXKQEXXXXXXTXQDXXRRFKSSKXGCRDPVRTNXDAXPDKXAXQXNDTHPSXXXPEXXRIXVDXERXDWDKXWDXTVRTXXXTNHTXLPEALERXPVHXXETXXPRXLQXXYEXNQRXLNRXAAXFPGDVDRLRRXSXXEEGAVKRXNXXHXXXXGSHXXNGXXRXXSEIXKKTIXKDXYEXEPHKFQNKTNGXTPRRXXXLCNPGLXEXXAERIGEDXXSDXDQXRKXXSFVDDEAXXRDVAKXKQENKXKXAAYXEREYKVHINPNSXXDXQVKRXHEXKRQXXNXXXXXTLYNRXKREPNKFFVPRTXXXGGKXXPGYHXXKMXXRXXTXXGDXXNHDPXXGDRXRXIFXENYRVSXXEKXXPXXDXSEQXSTXGTEASGTGNXKXXXNGXXTXGTMDGXNVEXXEEAGEENFFIXGMRVEDVDKLDQRGYNXQEYYDRXPEXRQXXEQXSSGFFSPKQPDLXKDXVNXXMHHDRXKVXADXEDXXKXQEKXSALXKNPREWTRMXXRNXXTSGKXSSDRTXXQXXREIXGVEPSRQRLPAPDEAI

SEQ ID NO: 284 - protein, 1324 aa, Murine coronavirus
  strain A59 (MHV-A59) (Murine hepatitis virus)
  SITE (16)..(16): Xaa at position 16 is Ile, Ala, Val, Leu, or Gly
  SITE (44)..(44): Xaa at position 44 is Val, Ala, Gly, Leu, or Ile
  SITE (79)..(79): Xaa at position 79 is Leu, Ala, Val, Gly, or Ile
  SITE (87)..(87): Xaa at position 87 is Val, Ala, Gly, Leu, or Ile
  SITE (96)..(96): Xaa at position 96 is Tyr, Phe, Met, His, Ile, Leu, Val Ala, or Gly
  SITE (104)..(104): Xaa at position 104 is Ile, Ala, Val, Leu, or Gly
  SITE (106)..(106): Xaa at position 106 is Ala, Gly, or Pro
  SITE (108)..(108): Xaa at position 108 is Val, Ala, Gly, Leu, or Ile
  SITE (111)..(111): Xaa at position 111 is Leu, Ala, Val, Gly, or Ile
  SITE (121)..(121): Xaa at position 121 is Ala, Gly, or Pro
  SITE (128)..(128): Xaa at position 128 is Ile, Ala, Val, Leu, or Gly
  SITE (132)..(132): Xaa at position 132 is Phe, Tyr, Met, His, Ile, Leu, Val Ala, or Gly
  SITE (140)..(140): Xaa at position 140 is Val, Ala, Gly, Leu, or Ile
  SITE (148)..(148): Xaa at position 148 is Ile, Ala, Val, Leu, or Gly
  SITE (150)..(150): Xaa at position 150 is Ala, Gly, or Pro
  SITE (152)..(152): Xaa at position 152 is Val, Ala, Gly, Leu, or Ile
  SITE (153)..(153): Xaa at position 153 is Cys, Ala, Val, Gly, Ser, or Thr
  SITE (157)..(157): Xaa at position 157 is Ile, Ala, Val, Leu, or Gly
  SITE (158)..(158): Xaa at position 158 is Cys, Ala, Val, Gly, Ser, or Thr
  SITE (165)..(165): Xaa at position 165 is Cys, Ala, Val, Gly, Ser, or Thr
  SITE (202)..(202): Xaa at position 202 is Phe, Tyr, Met, His, Ile, Leu, Val Ala, or Gly
  SITE (205)..(205): Xaa at position 205 is His, Phe, Tyr, Lys, Arg, Gly, Ser Thr, Ala, Val, Leu, Ile, Asn, Met, or Gln
  SITE (215)..(215): Xaa at position 215 is Ala, Gly, or Pro
  SITE (226)..(226): Xaa at position 226 is Phe, Tyr, Met, His, Ile, Leu, Val Ala, or Gly
  SITE (240)..(240): Xaa at position 240 is Tyr, Phe, Met, His, Ile, Leu, Val Ala, or Gly
  SITE (241)..(241): Xaa at position 241 is Val, Ala, Gly, Leu, or Ile
  SITE (244)..(244): Xaa at position 244 is Phe, Tyr, Met, His, Ile, Leu, Val Ala, or Gly
  SITE (245)..(245): Xaa at position 245 is Ile, Ala, Val, Leu, or Gly
  SITE (246)..(246): Xaa at position 246 is Cys, Ala, Val, Gly, Ser, or Thr
  SITE (258)..(258): Xaa at position 258 is Tyr, Phe, Met, His, Ile, Leu, Val Ala, or Gly
  SITE (268)..(268): Xaa at position 268 is Tyr, Phe, Met, His, Ile, Leu, Val Ala, or Gly
  SITE (269)..(269): Xaa at position 269 is Leu, Ala, Val, Gly, or Ile
  SITE (270)..(270): Xaa at position 270 is Phe, Tyr, Met, His, Ile, Leu, Val Ala, or Gly
  SITE (292)..(292): Xaa at position 292 is Ile, Ala, Val, Leu, or Gly
  SITE (319)..(319): Xaa at position 319 is Val, Ala, Gly, Leu, or Ile
  SITE (354)..(354): Xaa at position 354 is Cys, Ala, Val, Gly, Ser, or Thr
  SITE (385)..(385): Xaa at position 385 is Phe, Tyr, Met, His, Ile, Leu, Val Ala, or Gly
  SITE (393)..(393): Xaa at position 393 is Phe, Tyr, Met, His, Ile, Leu, Val Ala, or Gly
  SITE (395)..(395): Xaa at position 395 is Val, Ala, Gly, Leu, or Ile
  SITE (411)..(411): Xaa at position 411 is Leu, Ala, Val, Gly, or Ile
  SITE (414)..(414): Xaa at position 414 is Ala, Gly, or Pro
  SITE (416)..(416): Xaa at position 416 is Tyr, Phe, Met, His, Ile, Leu, Val Ala, or Gly
  SITE (429)..(429): Xaa at position 429 is Tyr, Phe, Met, His, Ile, Leu, Val Ala, or Gly
  SITE (468)..(468): Xaa at position 468 is Ala, Gly, or Pro
  SITE (471)..(471): Xaa at position 471 is Cys, Ala, Val, Gly, Ser, or Thr
  SITE (474)..(474): Xaa at position 474 is Val, Ala, Gly, Leu, or Ile
  SITE (479)..(479): Xaa at position 479 is Cys, Ala, Val, Gly, Ser, or Thr
  SITE (481)..(481): Xaa at position 481 is Cys, Ala, Val, Gly, Ser, or Thr
  SITE (482)..(482): Xaa at position 482 is Ala, Gly, or Pro
  SITE (499)..(499): Xaa at position 499 is Ala, Gly, or Pro
  SITE (529)..(529): Xaa at position 529 is Ala, Gly, or Pro
  SITE (534)..(534): Xaa at position 534 is Ile, Ala, Val, Leu, or Gly
  SITE (549)..(549): Xaa at position 549 is Ile, Ala, Val, Leu, or Gly
  SITE (550)..(550): Xaa at position 550 is Phe, Tyr, Met, His, Ile, Leu, Val Ala, or Gly
  SITE (551)..(551): Xaa at position 551 is Ala, Gly, or Pro
  SITE (585)..(585): Xaa at position 585 is Leu, Ala, Val, Gly, or Ile
  SITE (594)..(594): Xaa at position 594 is Phe, Tyr, Met, His, Ile, Leu, Val Ala, or Gly
  SITE (619)..(619): Xaa at position 619 is Phe, Tyr, Met, His, Ile, Leu, Val Ala, or Gly
  SITE (641)..(641): Xaa at position 641 is Ala, Gly, or Pro
  SITE (652)..(652): Xaa at position 652 is Leu, Ala, Val, Gly, or Ile
  SITE (658)..(658): Xaa at position 658 is Cys, Ala, Val, Gly, Ser, or Thr
  SITE (661)..(661): Xaa at position 661 is Val, Ala, Gly, Leu, or Ile
  SITE (682)..(682): Xaa at position 682 is Cys, Ala, Val, Gly, Ser, or Thr
  SITE (706)..(706): Xaa at position 706 is Cys, Ala, Val, Gly, Ser, or Thr
  SITE (775)..(775): Xaa at position 775 is Cys, Ala, Val, Gly, Ser, or Thr
  SITE (780)..(780): Xaa at position 780 is Cys, Ala, Val, Gly, Ser, or Thr
  SITE (786)..(786): Xaa at position 786 is Cys, Ala, Val, Gly, Ser, or Thr
  SITE (800)..(800): Xaa at position 800 is Val, Ala, Gly, Leu, or Ile
  SITE (876)..(876): Xaa at position 876 is Leu, Ala, Val, Gly, or Ile
  SITE (891)..(891): Xaa at position 891 is Tyr, Phe, Met, His, Ile, Leu, Val Ala, or Gly
  SITE (900)..(900): Xaa at position 900 is Val, Ala, Gly, Leu, or Ile
  SITE (906)..(906): Xaa at position 906 is Val, Ala, Gly, Leu, or Ile
  SITE (912)..(912): Xaa at position 912 is Ile, Ala, Val, Leu, or Gly
  SITE (931)..(931): Xaa at position 931 is Ala, Gly, or Pro
  SITE (952)..(952): Xaa at position 952 is Val, Ala, Gly, Leu, or Ile
  SITE (956)..(956): Xaa at position 956 is Ile, Ala, Val, Leu, or Gly
  SITE (980)..(980): Xaa at position 980 is Ala, Gly, or Pro
  SITE (994)..(994): Xaa at position 994 is Ala, Gly, or Pro
  SITE (998)..(998): Xaa at position 998 is Ile, Ala, Val, Leu, or Gly
  SITE (1030)..(1030): Xaa at position 1030 is Ile, Ala, Val, Leu, or Gly
  SITE (1039)..(1039): Xaa at position 1039 is Ala, Gly, or Pro
  SITE (1046)..(1046): Xaa at position 1046 is Leu, Ala, Val, Gly, or Ile
  SITE (1047)..(1047): Xaa at position 1047 is Ile, Ala, Val, Leu, or Gly
  SITE (1053)..(1053): Xaa at position 1053 is Ala, Gly, or Pro
  SITE (1054)..(1054): Xaa at position 1054 is Leu, Ala, Val, Gly, or Ile
  SITE (1067)..(1067): Xaa at position 1067 is Leu, Ala, Val, Gly, or Ile
  SITE (1072)..(1072): Xaa at position 1072 is Ala, Gly, or Pro
  SITE (1075)..(1075): Xaa at position 1075 is Ala, Gly, or Pro
  SITE (1079)..(1079): Xaa at position 1079 is Val, Ala, Gly, Leu, or Ile
  SITE (1099)..(1099): Xaa at position 1099 is Ile, Ala, Val, Leu, or Gly
  SITE (1103)..(1103): Xaa at position 1103 is Val, Ala, Gly, Leu, or Ile
  SITE (1111)..(1111): Xaa at position 1111 is Tyr, Phe, Met, His, Ile, Leu Val, Ala, or Gly
  SITE (1112)..(1112): Xaa at position 1112 is Phe, Tyr, Met, His, Ile, Leu Val, Ala, or Gly
  SITE (1113)..(1113): Xaa at position 1113 is Ile, Ala, Val, Leu, or Gly
  SITE (1114)..(1114): Xaa at position 1114 is His, Phe, Tyr, Lys, Arg, Gly Ser, Thr, Ala, Val, Leu, Ile, Asn, Met, or Gln
MLFVFILFLPSCLGYXGDFRCIQLVNSNGANVSAPSISTETVEXSQGLGTYYVLDRVYLNATLLLTGYYPVDGSKFRNXALRGTNSXSLSWFQPPXLNQFNDGXFXKXQNXKTSTPSGATXYFPTIVXGSLXGYTSYTVXIEPYNGVXMXSXXQYTXXQLPYTDXKPNTNGNKLIGFWHTDVKPPICVLKRNFTLNVNADAXYFXFYQHGGTFYXYYADKPSATTXLFSVYIGDILTQYXXLPXXXNPTAGSTFAPRXWVTPLVKRQXXXNFNQKGVITSAVDCASSYTSEXKCKTQSMLPSTGVYELSGYTVQPVGVXYRRVANLPACNIEEWLTARSVPSPLNWERKTFQNXNFNLSSLLRYVQAESLFCNNIDASKVYGRCXGSISVDKXAXPRSRQVDLQLGNSGFXQTXNXKIDTAATSCQLHXTLPKNNVTINNHNPSSWNRRYGFNDAGVFGKNQHDVVYXQQXFTXRSSYXPXXQPDIVSPCTTQTKPKSXFVNVGDHCEGLGVLEDNCGNADPHKGCICXNNSFXGWSHDTCLVNDRCQXXXNILLNGINSGTTCSTDLQLPNTEVVTGICVKYDXYGITGQGVXKEVKADYYNSWQTLLYDVNGNLNGXRDLTTNKTYTIRSCYSGRVSAXFHKDAPEPALXYRNINXSYXFSNNISREENPLNYFDSYLGXVVNADNRTDEALPNCDLRMGAGLXVDYSKSRRAHRSVSTGYRLTTFEPYTPMLVNDSVQSVDGLYEMQIPTNFTIGHHEEFIQTRSPKVTIDXAAFVXGDNTAXRQQLVEYGSFCVNXNAILNEVNNLLDNMQLQVASALMQGVTISSRLPDGISGPIDDINFSPLLGCIGSTCAEDGNGPSAIRGRSAIEDLXFDKVKLSDVGFVEAXNNCTGGQEXRDLLCXQSFNGXKVLPPVLSESQISGYTTGXTAAAMFPPWSAAAGVPFSLSXQYRXNGLGVTMNVLSENQKMIASAFNNXLGAIQDGFDATNSXLGKXQSVVNANAEALNNLLNQLSNRFGAISASLQEXLTRLEAVEXKAQIDRXXNGRLTXXNAYISKQLSDSTXIKVSXAQXIEKXNECVKSQTTRINFCGNGNHXLSLXQNAPYGLXXXXFSYVPISFTTANVSPGLCISGDRGLAPKAGYFVQDDGEWKFTGSSYYYPEPITDKNSVIMSSCAVNYTKAPEVFLNTSIPNPPDFKEELDKWFKNQTSIAPDLSLDFEKLNVTLLDLTYEMNRIQDAIKKLNESYINLKEVGTYEMYVKWPWYVWLLIGLAGVAVCVLLFFICCCTGCGSCCFKKCGNCCDEYGGHQDSIVIHNISSHED

SEQ ID NO: 285 - protein, 501 aa, Homo sapiens
  SITE (141)..(141): Xaa at position 141 is Trp, Tyr, Phe, Met, His, Ile, Leu Val, Ala, or Gly
  SITE (151)..(151): Xaa at position 151 is Cys, Ala, Val, Gly, Ser, or Thr
  SITE (157)..(157): Xaa at position 157 is Tyr, Phe, Met, His, Ile, Leu, Val Ala, or Gly
  SITE (165)..(165): Xaa at position 165 is Cys, Ala, Val, Gly, Ser, or Thr
  SITE (329)..(329): Xaa at position 329 is Val, Ala, Gly, Leu, or Ile
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRXQPPGIYRSSXSIQVTXFPFDWQNXTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVXLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 286 - protein, 206 aa, Homo sapiens
  SITE (15)..(15): Xaa at position 15 is His, Phe, Tyr, Lys, Arg, Gly, Ser Thr, Ala, Val, Leu, Ile, Asn, Met, or Gln
  SITE (17)..(17): Xaa at position 17 is Val, Ala, Gly, Leu, or Ile
  SITE (18)..(18): Xaa at position 18 is Ile, Ala, Val, Leu, or Gly
  SITE (19)..(19): Xaa at position 19 is Met, Ile, Leu, Val, Ala, or Gly
  SITE (20)..(20): Xaa at position 20 is Val, Ala, Gly, Leu, or Ile
  SITE (25)..(25): Xaa at position 25 is Val, Ala, Gly, Leu, or Ile
  SITE (30)..(30): Xaa at position 30 is Leu, Ala, Val, Gly, or Ile
  SITE (34)..(34): Xaa at position 34 is Phe, Tyr, Met, His, Ile, Leu, Val Ala, or Gly
  SITE (55)..(55): Xaa at position 55 is Val, Ala, Gly, Leu, or Ile
  SITE (57)..(57): Xaa at position 57 is Leu, Ala, Val, Gly, or Ile
  SITE (62)..(62): Xaa at position 62 is Val, Ala, Gly, Leu, or Ile
  SITE (64)..(64): Xaa at position 64 is Ile, Ala, Val, Leu, or Gly
  SITE (66)..(66): Xaa at position 66 is Ile, Ala, Val, Leu, or Gly
  SITE (67)..(67): Xaa at position 67 is Leu, Ala, Val, Gly, or Ile
  SITE (70)..(70): Xaa at position 70 is Ala, Gly, or Pro
  SITE (78)..(78): Xaa at position 78 is Ile, Ala, Val, Leu, or Gly
  SITE (83)..(83): Xaa at position 83 is Phe, Tyr, Met, His, Ile, Leu, Val Ala, or Gly
  SITE (89)..(89): Xaa at position 89 is Phe, Tyr, Met, His, Ile, Leu, Val Ala, or Gly
  SITE (90)..(90): Xaa at position 90 is Leu, Ala, Val, Gly, or Ile
  SITE (91)..(91): Xaa at position 91 is Cys, Ala, Val, Gly, Ser, or Thr
  SITE (92)..(92): Xaa at position 92 is Val, Ala, Gly, Leu, or Ile
  SITE (93)..(93): Xaa at position 93 is Phe, Tyr, Met, His, Ile, Leu, Val Ala, or Gly
  SITE (95)..(95): Xaa at position 95 is Ile, Ala, Val, Leu, or Gly
  SITE (101)..(101): Xaa at position 101 is Phe, Tyr, Met, His, Ile, Leu, Val Ala, or Gly
  SITE (107)..(107): Xaa at position 107 is Phe, Tyr, Met, His, Ile, Leu, Val Ala, or Gly
  SITE (111)..(111): Xaa at position 111 is Ile, Ala, Val, Leu, or Gly
  SITE (114)..(114): Xaa at position 114 is Val, Ala, Gly, Leu, or Ile
  SITE (120)..(120): Xaa at position 120 is Val, Ala, Gly, Leu, or Ile
  SITE (122)..(122): Xaa at position 122 is Phe, Tyr, Met, His, Ile, Leu, Val Ala, or Gly
  SITE (123)..(123): Xaa at position 123 is Leu, Ala, Val, Gly, or Ile
  SITE (124)..(124): Xaa at position 124 is Leu, Ala, Val, Gly, or Ile
  SITE (125)..(125): Xaa at position 125 is Val, Ala, Gly, Leu, or Ile
  SITE (131)..(131): Xaa at position 131 is Leu, Ala, Val, Gly, or Ile
  SITE (137)..(137): Xaa at position 137 is Val, Ala, Gly, Leu, or Ile
  SITE (142)..(142): Xaa at position 142 is Ala, Gly, or Pro
  SITE (146)..(146): Xaa at position 146 is Ala, Gly, or Pro
  SITE (158)..(158): Xaa at position 158 is Ala, Gly, or Pro
  SITE (164)..(164): Xaa at position 164 is Val, Ala, Gly, Leu, or Ile
  SITE (167)..(167): Xaa at position 167 is Val, Ala, Gly, Leu, or Ile
  SITE (168)..(168): Xaa at position 168 is Phe, Tyr, Met, His, Ile, Leu, Val Ala, or Gly
  SITE (171)..(171): Xaa at position 171 is Leu, Ala, Val, Gly, or Ile
  SITE (172)..(172): Xaa at position 172 is Met, Ile, Leu, Val, Ala, or Gly
  SITE (175)..(175): Xaa at position 175 is Ile, Ala, Val, Leu, or Gly
  SITE (180)..(180): Xaa at position 180 is Met, Ile, Leu, Val, Ala, or Gly
MAANKPKGQNSLALXKXXXXGSGGXGKSAXTLQXMYDEFVEDYEPTKADSYRKKXVXDGEEXQXDXXDTXGQEDYAAXRDNYXRSGEGXXXXXSXTEMESXAATADXREQXLRXKEDENXPXXXXGNKSDXEDKRQXSVEEXKNRXEQWNVNYVETSXKTRANXDKXXFDXXREXRARKXEDSKEKNGKKKRKSLAKRIRERCCIL

SEQ ID NO: 287 - protein, 421 aa, Homo sapiens
  SITE (27)..(27): Xaa at position 27 is Ala, Gly, or Pro
  SITE (52)..(52): Xaa at position 52 is Ala, Gly, or Pro
  SITE (55)..(55): Xaa at position 55 is Phe, Tyr, Met, His, Ile, Leu, Val Ala, or Gly
  SITE (56)..(56): Xaa at position 56 is Ala, Gly, or Pro
  SITE (60)..(60): Xaa at position 60 is Ile, Ala, Val, Leu, or Gly
  SITE (65)..(65): Xaa at position 65 is Ala, Gly, or Pro
  SITE (78)..(78): Xaa at position 78 is Ile, Ala, Val, Leu, or Gly
  SITE (81)..(81): Xaa at position 81 is Ala, Gly, or Pro
  SITE (87)..(87): Xaa at position 87 is Met, Ile, Leu, Val, Ala, or Gly
  SITE (91)..(91): Xaa at position 91 is Ile, Ala, Val, Leu, or Gly
  SITE (106)..(106): Xaa at position 106 is Cys, Ala, Val, Gly, Ser, or Thr
  SITE (107)..(107): Xaa at position 107 is Leu, Ala, Val, Gly, or Ile
  SITE (108)..(108): Xaa at position 108 is Ile, Ala, Val, Leu, or Gly
  SITE (112)..(112): Xaa at position 112 is Leu, Ala, Val, Gly, or Ile
  SITE (113)..(113): Xaa at position 113 is Ala, Gly, or Pro
  SITE (116)..(116): Xaa at position 116 is Cys, Ala, Val, Gly, Ser, or Thr
  SITE (119)..(119): Xaa at position 119 is Val, Ala, Gly, Leu, or Ile
  SITE (122)..(122): Xaa at position 122 is Ala, Gly, or Pro
  SITE (131)..(131): Xaa at position 131 is Met, Ile, Leu, Val, Ala, or Gly
  SITE (133)..(133): Xaa at position 133 is Ile, Ala, Val, Leu, or Gly
  SITE (145)..(145): Xaa at position 145 is Tyr, Phe, Met, His, Ile, Leu, Val Ala, or Gly
  SITE (146)..(146): Xaa at position 146 is Leu, Ala, Val, Gly, or Ile
  SITE (149)..(149): Xaa at position 149 is Met, Ile, Leu, Val, Ala, or Gly
  SITE (156)..(156): Xaa at position 156 is Cys, Ala, Val, Gly, Ser, or Thr
  SITE (157)..(157): Xaa at position 157 is Ala, Gly, or Pro
  SITE (159)..(159): Xaa at position 159 is Cys, Ala, Val, Gly, Ser, or Thr
  SITE (172)..(172): Xaa at position 172 is Ile, Ala, Val, Leu, or Gly
  SITE (185)..(185): Xaa at position 185 is Ile, Ala, Val, Leu, or Gly
  SITE (192)..(192): Xaa at position 192 is Ile, Ala, Val, Leu, or Gly
  SITE (200)..(200): Xaa at position 200 is Trp, Tyr, Phe, Met, His, Ile, Leu Val, Ala, or Gly
  SITE (201)..(201): Xaa at position 201 is Tyr, Phe, Met, His, Ile, Leu, Val Ala, or Gly
  SITE (202)..(202): Xaa at position 202 is Phe, Tyr, Met, His, Ile, Leu, Val Ala, or Gly
  SITE (203)..(203): Xaa at position 203 is Leu, Ala, Val, Gly, or Ile
  SITE (204)..(204): Xaa at position 204 is Leu, Ala, Val, Gly, or Ile
  SITE (205)..(205): Xaa at position 205 is Ala, Gly, or Pro
  SITE (215)..(215): Xaa at position 215 is Ala, Gly, or Pro
  SITE (218)..(218): Xaa at position 218 is Ala, Gly, or Pro
  SITE (219)..(219): Xaa at position 219 is Phe, Tyr, Met, His, Ile, Leu, Val Ala, or Gly
  SITE (222)..(222): Xaa at position 222 is Phe, Tyr, Met, His, Ile, Leu, Val Ala, or Gly
  SITE (223)..(223): Xaa at position 223 is Ile, Ala, Val, Leu, or Gly
  SITE (224)..(224): Xaa at position 224 is Val, Ala, Gly, Leu, or Ile
  SITE (233)..(233): Xaa at position 233 is Ile, Ala, Val, Leu, or Gly
  SITE (244)..(244): Xaa at position 244 is Cys, Ala, Val, Gly, Ser, or Thr
  SITE (250)..(250): Xaa at position 250 is Ile, Ala, Val, Leu, or Gly
  SITE (252)..(252): Xaa at position 252 is Phe, Tyr, Met, His, Ile, Leu, Val Ala, or Gly
  SITE (255)..(255): Xaa at position 255 is Val, Ala, Gly, Leu, or Ile
  SITE (257)..(257): Xaa at position 257 is Val, Ala, Gly, Leu, or Ile
  SITE (263)..(263): Xaa at position 263 is Leu, Ala, Val, Gly, or Ile
  SITE (272)..(272): Xaa at position 272 is Val, Ala, Gly, Leu, or Ile
  SITE (273)..(273): Xaa at position 273 is Ala, Gly, or Pro
  SITE (276)..(276): Xaa at position 276 is Ala, Gly, or Pro
  SITE (283)..(283): Xaa at position 283 is Val, Ala, Gly, Leu, or Ile
  SITE (284)..(284): Xaa at position 284 is Val, Ala, Gly, Leu, or Ile
  SITE (285)..(285): Xaa at position 285 is Ala, Gly, or Pro
  SITE (286)..(286): Xaa at position 286 is Ala, Gly, or Pro
  SITE (288)..(288): Xaa at position 288 is Ala, Gly, or Pro
  SITE (289)..(289): Xaa at position 289 is Val, Ala, Gly, Leu, or Ile
  SITE (291)..(291): Xaa at position 291 is Leu, Ala, Val, Gly, or Ile
  SITE (292)..(292): Xaa at position 292 is Ala, Gly, or Pro
  SITE (295)..(295): Xaa at position 295 is Ala, Gly, or Pro
  SITE (299)..(299): Xaa at position 299 is Ala, Gly, or Pro
  SITE (303)..(303): Xaa at position 303 is Ala, Gly, or Pro
  SITE (326)..(326): Xaa at position 326 is Met, Ile, Leu, Val, Ala, or Gly
  SITE (330)..(330): Xaa at position 330 is Val, Ala, Gly, Leu, or Ile
  SITE (333)..(333): Xaa at position 333 is Ala, Gly, or Pro
  SITE (335)..(335): Xaa at position 335 is Met, Ile, Leu, Val, Ala, or Gly
  SITE (340)..(340): Xaa at position 340 is Ala, Gly, or Pro
  SITE (341)..(341): Xaa at position 341 is Ala, Gly, or Pro
  SITE (354)..(354): Xaa at position 354 is Ala, Gly, or Pro
  SITE (357)..(357): Xaa at position 357 is Ala, Gly, or Pro
  SITE (361)..(361): Xaa at position 361 is Ala, Gly, or Pro
  SITE (365)..(365): Xaa at position 365 is Ala, Gly, or Pro
  SITE (368)..(368): Xaa at position 368 is Leu, Ala, Val, Gly, or Ile
  SITE (369)..(369): Xaa at position 369 is Ala, Gly, or Pro
  SITE (372)..(372): Xaa at position 372 is Ala, Gly, or Pro
  SITE (387)..(387): Xaa at position 387 is Val, Ala, Gly, Leu, or Ile
  SITE (394)..(394): Xaa at position 394 is Ala, Gly, or Pro
  SITE (397)..(397): Xaa at position 397 is Tyr, Phe, Met, His, Ile, Leu, Val Ala, or Gly
MAAGFGRCCRVLRSISRFHWRSQHTKXNRQREPGLGFSFEFTEQQKEFQATXRKXXREEXIPVAXEYDKTGEYPVPLXRRXWELGLXNTHXPENCGGLGLGTFDAXXXSEEXXYGXTGXQTXIEGNSLGQXPXIIAGNDQQKKKXXGRXTEEPLMXXYXVTEPGAGSDVAGXKTKAEKKGDEYIXNGQKMWXTNGGKANXXXXXXRSDPDPKAPXNKXXTGXXXEADTPGIQXGRKELNMGQRXSDTRGXVXEDXKXPKENVXIGDGAGFKXXMGXFDKTRPXXXXGXXGXXQRXLDEXTKYXLERKTFGKLLVEHQAISFMLAEXAMKXELXRXSYQRXXWEVDSGRRNTYYXSIXKAFXGDIXNQXXTDXVQILGGNGFNTEYPXEKLMRDXKIXQIYEGTSQIQRLIVAREHIDKYKN

SEQ ID NO: 288 - protein, 822 aa, Homo sapiens
  SITE (51)..(51): Xaa at position 51 is Leu, Ala, Val, Gly, or Ile
  SITE (53)..(53): Xaa at position 53 is Leu, Ala, Val, Gly, or Ile
  SITE (55)..(55): Xaa at position 55 is Cys, Ala, Val, Gly, Ser, or Thr
  SITE (86)..(86): Xaa at position 86 is Val, Ala, Gly, Leu, or Ile
  SITE (88)..(88): Xaa at position 88 is Val, Ala, Gly, Leu, or Ile
  SITE (101)..(101): Xaa at position 101 is Cys, Ala, Val, Gly, Ser, or Thr
  SITE (114)..(114): Xaa at position 114 is Phe, Tyr, Met, His, Ile, Leu, Val Ala, or Gly
  SITE (174)..(174): Xaa at position 174 is Val, Ala, Gly, Leu, or Ile
  SITE (176)..(176): Xaa at position 176 is Phe, Tyr, Met, His, Ile, Leu, Val Ala, or Gly
  SITE (178)..(178): Xaa at position 178 is Cys, Ala, Val, Gly, Ser, or Thr
  SITE (215)..(215): Xaa at position 215 is Ile, Ala, Val, Leu, or Gly
  SITE (217)..(217): Xaa at position 217 is Met, Ile, Leu, Val, Ala, or Gly
  SITE (220)..(220): Xaa at position 220 is Val, Ala, Gly, Leu, or Ile
  SITE (228)..(228): Xaa at position 228 is Tyr, Phe, Met, His, Ile, Leu, Val Ala, or Gly
  SITE (230)..(230): Xaa at position 230 is Cys, Ala, Val, Gly, Ser, or Thr
  SITE (232)..(232): Xaa at position 232 is Val, Ala, Gly, Leu, or Ile
  SITE (275)..(275): Xaa at position 275 is Phe, Tyr, Met, His, Ile, Leu, Val Ala, or Gly
  SITE (277)..(277): Xaa at position 277 is Cys, Ala, Val, Gly, Ser, or Thr
  SITE (341)..(341): Xaa at position 341 is Cys, Ala, Val, Gly, Ser, or Thr
  SITE (343)..(343): Xaa at position 343 is Ala, Gly, or Pro
  SITE (356)..(356): Xaa at position 356 is Leu, Ala, Val, Gly, or Ile
MWSWKCLLFWAVLVTATLCTARPSPTLPEQAQPWGAPVEVESFLVHPGDLXQXRXRLRDDVQSINWLRDGVQLAESNRTRITGEEXEXQDSVPADSGLYAXVTSSPSGSDTTYXSVNVSDALPSSEDDDDDDDSSSEEKETDNTKPNRMPVAPYWTSPEKMEKKLHAVPAAKTXKXKXPSSGTPNPTLRWLKNGKEFKPDHRIGGYKVRYATWSXIXDSXVPSDKGNXTXIXENEYGSINHTYQLDVVERSPHRPILQAGLPANKTVALGSNVEXMXKVYSDPQPHIQWLKHIEVNGSKIGPDNLPYVQILKTAGVNTTDKEMEVLHLRNVSFEDAGEYTXLXGNSIGLSHHSAWXTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 289 - protein, 515 aa, Homo sapiens
  SITE (33)..(33): Xaa at position 33 is Ile, Ala, Val, Leu, or Gly
  SITE (34)..(34): Xaa at position 34 is Phe, Tyr, Met, His, Ile, Leu, Val Ala, or Gly
  SITE (35)..(35): Xaa at position 35 is Ile, Ala, Val, Leu, or Gly
  SITE (36)..(36): Xaa at position 36 is Ile, Ala, Val, Leu, or Gly
  SITE (37)..(37): Xaa at position 37 is Met, Ile, Leu, Val, Ala, or Gly
  SITE (39)..(39): Xaa at position 39 is Ala, Gly, or Pro
  SITE (44)..(44): Xaa at position 44 is Ala, Gly, or Pro
  SITE (48)..(48): Xaa at position 48 is Ile, Ala, Val, Leu, or Gly
  SITE (52)..(52): Xaa at position 52 is Ile, Ala, Val, Leu, or Gly
  SITE (53)..(53): Xaa at position 53 is Trp, Tyr, Phe, Met, His, Ile, Leu Val, Ala, or Gly
  SITE (55)..(55): Xaa at position 55 is Leu, Ala, Val, Gly, or Ile
  SITE (67)..(67): Xaa at position 67 is Ile, Ala, Val, Leu, or Gly
  SITE (68)..(68): Xaa at position 68 is Val, Ala, Gly, Leu, or Ile
  SITE (70)..(70): Xaa at position 70 is Tyr, Phe, Met, His, Ile, Leu, Val Ala, or Gly
  SITE (71)..(71): Xaa at position 71 is Ala, Gly, or Pro
  SITE (88)..(88): Xaa at position 88 is Phe, Tyr, Met, His, Ile, Leu, Val Ala, or Gly
  SITE (101)..(101): Xaa at position 101 is Phe, Tyr, Met, His, Ile, Leu, Val Ala, or Gly
  SITE (118)..(118): Xaa at position 118 is Tyr, Phe, Met, His, Ile, Leu, Val Ala, or Gly
  SITE (121)..(121): Xaa at position 121 is Leu, Ala, Val, Gly, or Ile
  SITE (125)..(125): Xaa at position 125 is Met, Ile, Leu, Val, Ala, or Gly
  SITE (134)..(134): Xaa at position 134 is Ala, Gly, or Pro
  SITE (137)..(137): Xaa at position 137 is Leu, Ala, Val, Gly, or Ile
  SITE (138)..(138): Xaa at position 138 is Phe, Tyr, Met, His, Ile, Leu, Val Ala, or Gly
  SITE (139)..(139): Xaa at position 139 is Tyr, Phe, Met, His, Ile, Leu, Val Ala, or Gly
  SITE (140)..(140): Xaa at position 140 is Leu, Ala, Val, Gly, or Ile
  SITE (147)..(147): Xaa at position 147 is Tyr, Phe, Met, His, Ile, Leu, Val Ala, or Gly
  SITE (150)..(150): Xaa at position 150 is Val, Ala, Gly, Leu, or Ile
  SITE (154)..(154): Xaa at position 154 is Ile, Ala, Val, Leu, or Gly
  SITE (158)..(158): Xaa at position 158 is Cys, Ala, Val, Gly, Ser, or Thr
  SITE (167)..(167): Xaa at position 167 is Ile, Ala, Val, Leu, or Gly
  SITE (168)..(168): Xaa at position 168 is Ile, Ala, Val, Leu, or Gly
  SITE (196)..(196): Xaa at position 196 is Ile, Ala, Val, Leu, or Gly
  SITE (197)..(197): Xaa at position 197 is Tyr, Phe, Met, His, Ile, Leu, Val Ala, or Gly
  SITE (199)..(199): Xaa at position 199 is Ile, Ala, Val, Leu, or Gly
  SITE (202)..(202): Xaa at position 202 is Tyr, Phe, Met, His, Ile, Leu, Val Ala, or Gly
  SITE (207)..(207): Xaa at position 207 is Met, Ile, Leu, Val, Ala, or Gly
  SITE (230)..(230): Xaa at position 230 is Ile, Ala, Val, Leu, or Gly
  SITE (232)..(232): Xaa at position 232 is Cys, Ala, Val, Gly, Ser, or Thr
  SITE (233)..(233): Xaa at position 233 is Val, Ala, Gly, Leu, or Ile
  SITE (235)..(235): Xaa at position 235 is Leu, Ala, Val, Gly, or Ile
  SITE (255)..(255): Xaa at position 255 is Ile, Ala, Val, Leu, or Gly
  SITE (256)..(256): Xaa at position 256 is Ile, Ala, Val, Leu, or Gly
  SITE (259)..(259): Xaa at position 259 is Val, Ala, Gly, Leu, or Ile
  SITE (260)..(260): Xaa at position 260 is Met, Ile, Leu, Val, Ala, or Gly
  SITE (264)..(264): Xaa at position 264 is Leu, Ala, Val, Gly, or Ile
  SITE (265)..(265): Xaa at position 265 is Leu, Ala, Val, Gly, or Ile
  SITE (267)..(267): Xaa at position 267 is Met, Ile, Leu, Val, Ala, or Gly
  SITE (268)..(268): Xaa at position 268 is Leu, Ala, Val, Gly, or Ile
  SITE (269)..(269): Xaa at position 269 is Cys, Ala, Val, Gly, Ser, or Thr
  SITE (271)..(271): Xaa at position 271 is Val, Ala, Gly, Leu, or Ile
  SITE (272)..(272): Xaa at position 272 is Ala, Gly, or Pro
  SITE (273)..(273): Xaa at position 273 is Met, Ile, Leu, Val, Ala, or Gly
  SITE (284)..(284): Xaa at position 284 is Val, Ala, Gly, Leu, or Ile
  SITE (308)..(308): Xaa at position 308 is Tyr, Phe, Met, His, Ile, Leu, Val Ala, or Gly
  SITE (322)..(322): Xaa at position 322 is Tyr, Phe, Met, His, Ile, Leu, Val Ala, or Gly
  SITE (337)..(337): Xaa at position 337 is Phe, Tyr, Met, His, Ile, Leu, Val Ala, or Gly
  SITE (338)..(338): Xaa at position 338 is Ala, Gly, or Pro
  SITE (339)..(339): Xaa at position 339 is Ala, Gly, or Pro
  SITE (340)..(340): Xaa at position 340 is Val, Ala, Gly, Leu, or Ile
  SITE (341)..(341): Xaa at position 341 is Val, Ala, Gly, Leu, or Ile
  SITE (342)..(342): Xaa at position 342 is Leu, Ala, Val, Gly, or Ile
  SITE (344)..(344): Xaa at position 344 is Val, Ala, Gly, Leu, or Ile
  SITE (349)..(349): Xaa at position 349 is Trp, Tyr, Phe, Met, His, Ile, Leu Val, Ala, or Gly
  SITE (354)..(354): Xaa at position 354 is Phe, Tyr, Met, His, Ile, Leu, Val Ala, or Gly
  SITE (355)..(355): Xaa at position 355 is Ile, Ala, Val, Leu, or Gly
  SITE (356)..(356): Xaa at position 356 is Leu, Ala, Val, Gly, or Ile
  SITE (358)..(358): Xaa at position 358 is Cys, Ala, Val, Gly, Ser, or Thr
  SITE (361)..(361): Xaa at position 361 is Ala, Gly, or Pro
  SITE (367)..(367): Xaa at position 367 is Ala, Gly, or Pro
  SITE (369)..(369): Xaa at position 369 is Val, Ala, Gly, Leu, or Ile
  SITE (371)..(371): Xaa at position 371 is Leu, Ala, Val, Gly, or Ile
  SITE (391)..(391): Xaa at position 391 is Val, Ala, Gly, Leu, or Ile
  SITE (392)..(392): Xaa at position 392 is Ile, Ala, Val, Leu, or Gly
  SITE (394)..(394): Xaa at position 394 is Val, Ala, Gly, Leu, or Ile
  SITE (399)..(399): Xaa at position 399 is Ala, Gly, or Pro
  SITE (440)..(440): Xaa at position 440 is Leu, Ala, Val, Gly, or Ile
  SITE (444)..(444): Xaa at position 444 is Val, Ala, Gly, Leu, or Ile
  SITE (452)..(452): Xaa at position 452 is Phe, Tyr, Met, His, Ile, Leu, Val Ala, or Gly
  SITE (464)..(464): Xaa at position 464 is Ile, Ala, Val, Leu, or Gly
  SITE (465)..(465): Xaa at position 465 is Phe, Tyr, Met, His, Ile, Leu, Val Ala, or Gly
  SITE (492)..(492): Xaa at position 492 is Ala, Gly, or Pro
MAEQVALSRTQVCGILREELFQGDAFHQSDTHXXXXXGXSGDLXKKKXYPTXXWXFRDGLLPENTFXXGXXRSRLTVADIRKQSEPFXKATPEEKLKLEDXFARNSYVAGQYDDAASXQRXNSHXNALHLGSQXNRXXXXALPPTVXEAXTKNXHESXMSQIGWNRXXVEKPFGRDLQSSDRLSNHISSLFREDQXXRXDHXLGKEXVQNLMVLRFANRIFGPIWNRDNXAXXIXTFKEPFGTEGRGGYFDEFGXXRDXXQNHXXQXXXLXXXEKPASTNSDDXRDEKVKVLKCISEVQANNVVLGQXVGNPDGEGEATKGXLDDPTVPRGSTTATXXXXXXYXENERXDGVPXXXRXGKXLNERKXEXRXQFHDVAGDIFHQQCKRNELXXRXQPNEXVYTKMMTKKPGMFFNPEESELDLTYGNRYKNVKLPDAYERXILDXFCGSQMHXVRSDELREAWRXXTPLLHQIELEKPKPIPYIYGSRGPTEXDELMKRVGFQYEGTYKWVNPHKL

SEQ ID NO: 290 - protein, 3685 aa, Homo sapiens
  SITE (25)..(25): Xaa at position 25 is Val, Ala, Gly, Leu, or Ile
  SITE (29)..(29): Xaa at position 29 is Phe, Tyr, Met, His, Ile, Leu, Val Ala, or Gly
  SITE (40)..(40): Xaa at position 40 is Leu, Ala, Val, Gly, or Ile
  SITE (50)..(50): Xaa at position 50 is Leu, Ala, Val, Gly, or Ile
  SITE (51)..(51): Xaa at position 51 is Leu, Ala, Val, Gly, or Ile
  SITE (54)..(54): Xaa at position 54 is Leu, Ala, Val, Gly, or Ile
  SITE (77)..(77): Xaa at position 77 is Val, Ala, Gly, Leu, or Ile
  SITE (80)..(80): Xaa at position 80 is Ala, Gly, or Pro
  SITE (81)..(81): Xaa at position 81 is Leu, Ala, Val, Gly, or Ile
  SITE (84)..(84): Xaa at position 84 is Leu, Ala, Val, Gly, or Ile
  SITE (99)..(99): Xaa at position 99 is Ile, Ala, Val, Leu, or Gly
  SITE (111)..(111): Xaa at position 111 is Ile, Ala, Val, Leu, or Gly
  SITE (114)..(114): Xaa at position 114 is Ile, Ala, Val, Leu, or Gly
  SITE (140)..(140): Xaa at position 140 is Leu, Ala, Val, Gly, or Ile
  SITE (143)..(143): Xaa at position 143 is Trp, Tyr, Phe, Met, His, Ile, Leu Val, Ala, or Gly
  SITE (144)..(144): Xaa at position 144 is Val, Ala, Gly, Leu, or Ile
  SITE (156)..(156): Xaa at position 156 is Val, Ala, Gly, Leu, or Ile
  SITE (168)..(168): Xaa at position 168 is Ala, Gly, or Pro
  SITE (171)..(171): Xaa at position 171 is Ala, Gly, or Pro
  SITE (172)..(172): Xaa at position 172 is Leu, Ala, Val, Gly, or Ile
  SITE (173)..(173): Xaa at position 173 is Ile, Ala, Val, Leu, or Gly
  SITE (196)..(196): Xaa at position 196 is Leu, Ala, Val, Gly, or Ile
  SITE (199)..(199): Xaa at position 199 is Ala, Gly, or Pro
  SITE (200)..(200): Xaa at position 200 is Phe, Tyr, Met, His, Ile, Leu, Val Ala, or Gly
  SITE (203)..(203): Xaa at position 203 is Ala, Gly, or Pro
  SITE (228)..(228): Xaa at position 228 is Ile, Ala, Val, Leu, or Gly
  SITE (231)..(231): Xaa at position 231 is Tyr, Phe, Met, His, Ile, Leu, Val Ala, or Gly
  SITE (232)..(232): Xaa at position 232 is Ile, Ala, Val, Leu, or Gly
  SITE (235)..(235): Xaa at position 235 is Leu, Ala, Val, Gly, or Ile
  SITE (344)..(344): Xaa at position 344 is Tyr, Phe, Met, His, Ile, Leu, Val Ala, or Gly
  SITE (348)..(348): Xaa at position 348 is Leu, Ala, Val, Gly, or Ile
  SITE (355)..(355): Xaa at position 355 is Leu, Ala, Val, Gly, or Ile
  SITE (375)..(375): Xaa at position 375 is Val, Ala, Gly, Leu, or Ile
  SITE (382)..(382): Xaa at position 382 is His, Phe, Tyr, Lys, Arg, Gly, Ser Thr, Ala, Val, Leu, Ile, Asn, Met, or Gln
  SITE (399)..(399): Xaa at position 399 is Ile, Ala, Val, Leu, or Gly
  SITE (420)..(420): Xaa at position 420 is Val, Ala, Gly, Leu, or Ile
  SITE (427)..(427): Xaa at position 427 is Leu, Ala, Val, Gly, or Ile
  SITE (445)..(445): Xaa at position 445 is Leu, Ala, Val, Gly, or Ile
  SITE (3053)..(3053): Xaa at position 3053 is Leu, Ala, Val, Gly, or Ile
  SITE (3070)..(3070): Xaa at position 3070 is Val, Ala, Gly, Leu, or Ile
  SITE (3073)..(3073): Xaa at position 3073 is Tyr, Phe, Met, His, Ile, Leu Val, Ala, or Gly
  SITE (3088)..(3088): Xaa at position 3088 is Met, Ile, Leu, Val, Ala, or Gly
  SITE (3098)..(3098): Xaa at position 3098 is Leu, Ala, Val, Gly, or Ile
  SITE (3109)..(3109): Xaa at position 3109 is Ala, Gly, or Pro
  SITE (3112)..(3112): Xaa at position 3112 is Leu, Ala, Val, Gly, or Ile
  SITE (3115)..(3115): Xaa at position 3115 is Leu, Ala, Val, Gly, or Ile
  SITE (3119)..(3119): Xaa at position 3119 is Leu, Ala, Val, Gly, or Ile
  SITE (3121)..(3121): Xaa at position 3121 is Leu, Ala, Val, Gly, or Ile
  SITE (3129)..(3129): Xaa at position 3129 is Ala, Gly, or Pro
  SITE (3145)..(3145): Xaa at position 3145 is Met, Ile, Leu, Val, Ala, or Gly
  SITE (3150)..(3150): Xaa at position 3150 is Ile, Ala, Val, Leu, or Gly
  SITE (3153)..(3153): Xaa at position 3153 is Cys, Ala, Val, Gly, Ser, or Thr
  SITE (3154)..(3154): Xaa at position 3154 is Leu, Ala, Val, Gly, or Ile
  SITE (3158)..(3158): Xaa at position 3158 is Tyr, Phe, Met, His, Ile, Leu Val, Ala, or Gly
  SITE (3175)..(3175): Xaa at position 3175 is Val, Ala, Gly, Leu, or Ile
  SITE (3178)..(3178): Xaa at position 3178 is Cys, Ala, Val, Gly, Ser, or Thr
  SITE (3179)..(3179): Xaa at position 3179 is Leu, Ala, Val, Gly, or Ile
  SITE (3181)..(3181): Xaa at position 3181 is Trp, Tyr, Phe, Met, His, Ile Leu, Val, Ala, or Gly
  SITE (3182)..(3182): Xaa at position 3182 is Leu, Ala, Val, Gly, or Ile
  SITE (3183)..(3183): Xaa at position 3183 is Leu, Ala, Val, Gly, or Ile
  SITE (3199)..(3199): Xaa at position 3199 is Phe, Tyr, Met, His, Ile, Leu Val, Ala, or Gly
  SITE (3204)..(3204): Xaa at position 3204 is Ile, Ala, Val, Leu, or Gly
  SITE (3206)..(3206): Xaa at position 3206 is Leu, Ala, Val, Gly, or Ile
  SITE (3207)..(3207): Xaa at position 3207 is Cys, Ala, Val, Gly, Ser, or Thr
  SITE (3229)..(3229): Xaa at position 3229 is Cys, Ala, Val, Gly, Ser, or Thr
  SITE (3234)..(3234): Xaa at position 3234 is Leu, Ala, Val, Gly, or Ile
  SITE (3238)..(3238): Xaa at position 3238 is Leu, Ala, Val, Gly, or Ile
  SITE (3242)..(3242): Xaa at position 3242 is Ile, Ala, Val, Leu, or Gly
  SITE (3244)..(3244): Xaa at position 3244 is Ile, Ala, Val, Leu, or Gly
  SITE (3263)..(3263): Xaa at position 3263 is Val, Ala, Gly, Leu, or Ile
  SITE (3266)..(3266): Xaa at position 3266 is Cys, Ala, Val, Gly, Ser, or Thr
  SITE (3294)..(3294): Xaa at position 3294 is Trp, Tyr, Phe, Met, His, Ile Leu, Val, Ala, or Gly
  SITE (3295)..(3295): Xaa at position 3295 is Leu, Ala, Val, Gly, or Ile
  SITE (3297)..(3297): Xaa at position 3297 is Val, Ala, Gly, Leu, or Ile
  SITE (3298)..(3298): Xaa at position 3298 is Leu, Ala, Val, Gly, or Ile
MLWWEEVEDCYEREDVQKKTFTKWXNAQXSKFGKQHIENXFSDLQDGRRXXDLXEGLTGQKLPKEKGSTRVHALNNXNKXXRVXQNNNVDLVNIGSTDXVDGNHKLTLGLXWNXILHWQVKNVMKNIMAGLQQTNSEKIXLSXXRQSTRNYPQVNXINFTTSWSDGLXLNXXXHSHRPDLFDWNSVVCQQSATQRXEHXXNIXRYQLGIEKLLDPEDVDTTYPDKKSXLMXXTSXFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRXQTAXEEVLSWXLSAEDTLQAQGEISNDVEVXKDQFHTXEGYMMDLTAHQGRVGNXLQLGSKLIGTGKLSEDEETEXQEQMNLXNSRWECLRVASMEKQSNXHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFXSTSVQGPWERAISPNKXPYXINHETQTTCWDHPKXTELYQSLADXNNVRFSAYRTXMKXRRXQKAXCXDLLSLSAXCDALDQHNLKQNDQPXDILQXINXXTTIXDRLEQEHNNLVNVPLCXDMXXNXXXNVYDTGRTGRIRVLSXKTGIXSXXKAHLEDKYRYLFKQVASSTGFXDQRRXGLLXHDSXQXPRQLGEVASFGGSNIEPSXRSXFQFANNKPEIEAALFLDWMRLEPQSMVXXPXXHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 291 - protein, 935 aa, Homo sapiens
  SITE (20)..(20): Xaa at position 20 is Leu, Ala, Val, Gly, or Ile
  SITE (24)..(24): Xaa at position 24 is Val, Ala, Gly, Leu, or Ile
  SITE (38)..(38): Xaa at position 38 is Leu, Ala, Val, Gly, or Ile
  SITE (39)..(39): Xaa at position 39 is Ala, Gly, or Pro
  SITE (40)..(40): Xaa at position 40 is Ile, Ala, Val, Leu, or Gly
  SITE (41)..(41): Xaa at position 41 is Leu, Ala, Val, Gly, or Ile
  SITE (53)..(53): Xaa at position 53 is Ile, Ala, Val, Leu, or Gly
  SITE (60)..(60): Xaa at position 60 is Ala, Gly, or Pro
  SITE (63)..(63): Xaa at position 63 is Ile, Ala, Val, Leu, or Gly
  SITE (81)..(81): Xaa at position 81 is Val, Ala, Gly, Leu, or Ile
  SITE (85)..(85): Xaa at position 85 is Ile, Ala, Val, Leu, or Gly
  SITE (94)..(94): Xaa at position 94 is Val, Ala, Gly, Leu, or Ile
  SITE (97)..(97): Xaa at position 97 is Phe, Tyr, Met, His, Ile, Leu, Val Ala, or Gly
  SITE (98)..(98): Xaa at position 98 is Leu, Ala, Val, Gly, or Ile
  SITE (114)..(114): Xaa at position 114 is Val, Ala, Gly, Leu, or Ile
  SITE (124)..(124): Xaa at position 124 is Val, Ala, Gly, Leu, or Ile
  SITE (135)..(135): Xaa at position 135 is Leu, Ala, Val, Gly, or Ile
  SITE (152)..(152): Xaa at position 152 is Cys, Ala, Val, Gly, Ser, or Thr
  SITE (155)..(155): Xaa at position 155 is Leu, Ala, Val, Gly, or Ile
  SITE (156)..(156): Xaa at position 156 is Ile, Ala, Val, Leu, or Gly
  SITE (168)..(168): Xaa at position 168 is Ala, Gly, or Pro
  SITE (169)..(169): Xaa at position 169 is Val, Ala, Gly, Leu, or Ile
  SITE (170)..(170): Xaa at position 170 is Val, Ala, Gly, Leu, or Ile
  SITE (181)..(181): Xaa at position 181 is Met, Ile, Leu, Val, Ala, or Gly
  SITE (185)..(185): Xaa at position 185 is Leu, Ala, Val, Gly, or Ile
  SITE (195)..(195): Xaa at position 195 is Cys, Ala, Val, Gly, Ser, or Thr
  SITE (206)..(206): Xaa at position 206 is Val, Ala, Gly, Leu, or Ile
  SITE (211)..(211): Xaa at position 211 is Ile, Ala, Val, Leu, or Gly
  SITE (212)..(212): Xaa at position 212 is Leu, Ala, Val, Gly, or Ile
  SITE (213)..(213): Xaa at position 213 is Val, Ala, Gly, Leu, or Ile
  SITE (214)..(214): Xaa at position 214 is Val, Ala, Gly, Leu, or Ile
  SITE (222)..(222): Xaa at position 222 is Val, Ala, Gly, Leu, or Ile
  SITE (227)..(227): Xaa at position 227 is Ile, Ala, Val, Leu, or Gly
  SITE (231)..(231): Xaa at position 231 is Ala, Gly, or Pro
  SITE (233)..(233): Xaa at position 233 is Val, Ala, Gly, Leu, or Ile
  SITE (234)..(234): Xaa at position 234 is Ile, Ala, Val, Leu, or Gly
  SITE (256)..(256): Xaa at position 256 is Val, Ala, Gly, Leu, or Ile
  SITE (261)..(261): Xaa at position 261 is Ala, Gly, or Pro
  SITE (268)..(268): Xaa at position 268 is Ile, Ala, Val, Leu, or Gly
  SITE (278)..(278): Xaa at position 278 is Met, Ile, Leu, Val, Ala, or Gly
  SITE (281)..(281): Xaa at position 281 is Ala, Gly, or Pro
  SITE (283)..(283): Xaa at position 283 is Leu, Ala, Val, Gly, or Ile
  SITE (284)..(284): Xaa at position 284 is Met, Ile, Leu, Val, Ala, or Gly
  SITE (291)..(291): Xaa at position 291 is Ala, Gly, or Pro
  SITE (393)..(393): Xaa at position 393 is Leu, Ala, Val, Gly, or Ile
  SITE (394)..(394): Xaa at position 394 is Val, Ala, Gly, Leu, or Ile
  SITE (396)..(396): Xaa at position 396 is Ala, Gly, or Pro
  SITE (397)..(397): Xaa at position 397 is Leu, Ala, Val, Gly, or Ile
  SITE (405)..(405): Xaa at position 405 is Val, Ala, Gly, Leu, or Ile
  SITE (406)..(406): Xaa at position 406 is Phe, Tyr, Met, His, Ile, Leu, Val Ala, or Gly
  SITE (407)..(407): Xaa at position 407 is Ala, Gly, or Pro
  SITE (480)..(480): Xaa at position 480 is Val, Ala, Gly, Leu, or Ile
  SITE (497)..(497): Xaa at position 497 is Leu, Ala, Val, Gly, or Ile
  SITE (502)..(502): Xaa at position 502 is Ile, Ala, Val, Leu, or Gly
  SITE (518)..(518): Xaa at position 518 is Phe, Tyr, Met, His, Ile, Leu, Val Ala, or Gly
MAPAEILNGKEISAQIRARXKNQXTQLKEQVPGFTPRXXXXQVGNRDDSNLYXNVKLKAXEEXGIKATHIKLPRTTTESEXMKYXTSLNEDSTXHGXXVQLPLDSENSINTEEXINAIAPEKDXDGLTSINAGRXARGDLNDCFIPCTPKGXLEXXKETGVPIAGRHXXXVGRSKIVGAPXHDLXLWNNATVTTXHSKTAHLDEEXNKGDXXXXATGQPEMXKGEWXKPGXIXXDCGINYVPDDKKPNGRKVVGDXAYDEXKERASFXTPVPGGVGPXTVXMXXQSTVESXKRFLEKFKPGKWMIQYNNLNLKTPVPSDIDISRSCKPKPIGKLAREIGLLSEEVELYGETKAKVLLSALERLKHRPDGKYVVVTGITPTPLGEGKSTTTIGXXQXXGAHLYQNXXXCVRQPSQGPTFGIKGGAAGGGYSQVIPMEEFNLHLTGDIHAITAANNLVAAAIDARIFHELTQTDKALFNRLXPSVNGVRRFSDIQIRRXKRLGXEKTDPTTLTDEEINRXARLDIDPETITWQRVLDTNDRFLRKITIGQAPTEKGHTRTAQFDISVASEIMAVLALTTSLEDMRERLGKMVVASSKKGEPVSAEDLGVSGALTVLMKDAIKPNLMQTLEGTPVFVHAGPFANIAHGNSSIIADRIALKLVGPEGFVVTEAGFGADIGMEKFFNIKCRYSGLCPHVVVLVATVRALKMHGGGPTVTAGLPLPKAYIQENLELVEKGFSNLKKQIENARMFGIPVVVAVNAFKTDTESELDLISRLSREHGAFDAVKCTHWAEGGKGALALAQAVQRAAQAPSSFQLLYDLKLPVEDKIRIIAQKIYGADDIELLPEAQHKAEVYTKQGFGNLPICMAKTHLSLSHNPEQKGVPTGFILPIRDIRASVGAGFLYPLVGTMSTMPGLPTRPCFYDIDLDPETEQVNGLF

SEQ ID NO: 292 - protein, 493 aa, Homo sapiens
  SITE (26)..(26): Xaa at position 26 is Ala, Gly, or Pro
  SITE (29)..(29): Xaa at position 29 is Val, Ala, Gly, Leu, or Ile
  SITE (36)..(36): Xaa at position 36 is Ala, Gly, or Pro
  SITE (51)..(51): Xaa at position 51 is Ala, Gly, or Pro
  SITE (72)..(72): Xaa at position 72 is Val, Ala, Gly, Leu, or Ile
  SITE (103)..(103): Xaa at position 103 is Ile, Ala, Val, Leu, or Gly
  SITE (106)..(106): Xaa at position 106 is Val, Ala, Gly, Leu, or Ile
  SITE (108)..(108): Xaa at position 108 is Val, Ala, Gly, Leu, or Ile
  SITE (188)..(188): Xaa at position 188 is Ile, Ala, Val, Leu, or Gly
  SITE (200)..(200): Xaa at position 200 is Ile, Ala, Val, Leu, or Gly
  SITE (207)..(207): Xaa at position 207 is Ile, Ala, Val, Leu, or Gly
  SITE (267)..(267): Xaa at position 267 is Phe, Tyr, Met, His, Ile, Leu, Val Ala, or Gly
  SITE (313)..(313): Xaa at position 313 is Leu, Ala, Val, Gly, or Ile
  SITE (328)..(328): Xaa at position 328 is Val, Ala, Gly, Leu, or Ile
  SITE (329)..(329): Xaa at position 329 is Val, Ala, Gly, Leu, or Ile
  SITE (336)..(336): Xaa at position 336 is Ala, Gly, or Pro
  SITE (350)..(350): Xaa at position 350 is Cys, Ala, Val, Gly, Ser, or Thr
  SITE (367)..(367): Xaa at position 367 is Phe, Tyr, Met, His, Ile, Leu, Val Ala, or Gly
  SITE (376)..(376): Xaa at position 376 is Val, Ala, Gly, Leu, or Ile
  SITE (380)..(380): Xaa at position 380 is Phe, Tyr, Met, His, Ile, Leu, Val Ala, or Gly
  SITE (426)..(426): Xaa at position 426 is Leu, Ala, Val, Gly, or Ile
MLAATVLTLALLGNAHACSKGTSHEXGIXCRITKPXLLVLNHETAKVIQTXFQRASYPDITGEKAMMLLGQXKYGLHNIQISHLSIASSQVELVEAKSIDVSXQNXSXVFKGTLKYGYTTAWWLGIDQSIDFEIDSAIDLQINTQLTCDSGRVRTDAPDCYLSFHKLLLHLQGEREPGWIKQLFTNFXSFTLKLVLKGQXCKEINVXSNIMADFVQTRAASILSDGDIGVDISLTGDPVITASYLESHHKGHFIYKNVSEDLPLPTXSPTLLGDSRMLYFWFSERVFHSLAKVAFQDGRLMLSLMGDEFKAVXETWGFNTNQEIFQEXXGGFPSQXQVTVHCLKMPKISXQNKGVVVNSSVMVKFLXPRPDQQHSXAYTXEEDIVTTVQASYSKKKLFLSLLDFQITPKTVSNLTESSSESVQSFXQSMITAVGIPEVMSRLEVVFTALMNSKGVSLFDIINPEIITRDGFLLLQMDFGFPEHLLVDFLQSLS

SEQ ID NO: 293 - protein, 297 aa, Homo sapiens
  SITE (146)..(146): Xaa at position 146 is Phe, Tyr, Met, His, Ile, Leu, Val Ala, or Gly
  SITE (147)..(147): Xaa at position 147 is Leu, Ala, Val, Gly, or Ile
  SITE (152)..(152): Xaa at position 152 is Leu, Ala, Val, Gly, or Ile
  SITE (162)..(162): Xaa at position 162 is Ile, Ala, Val, Leu, or Gly
  SITE (164)..(164): Xaa at position 164 is Ile, Ala, Val, Leu, or Gly
  SITE (167)..(167): Xaa at position 167 is Cys, Ala, Val, Gly, Ser, or Thr
  SITE (182)..(182): Xaa at position 182 is Tyr, Phe, Met, His, Ile, Leu, Val Ala, or Gly
  SITE (183)..(183): Xaa at position 183 is Cys, Ala, Val, Gly, Ser, or Thr
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHXXKMESXNFIRAHTPYXNXYNXEPANPSEKNSPSTQXXYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 294 - protein, 770 aa, Mus musculus
  SITE (476)..(476): Xaa at position 476 is Tyr, Phe, Met, His, Ile, Leu, Val Ala, or Gly
  SITE (479)..(479): Xaa at position 479 is Ala, Gly, or Pro
  SITE (490)..(490): Xaa at position 490 is Val, Ala, Gly, Leu, or Ile
  SITE (497)..(497): Xaa at position 497 is Tyr, Phe, Met, His, Ile, Leu, Val Ala, or Gly
  SITE (509)..(509): Xaa at position 509 is Leu, Ala, Val, Gly, or Ile
  SITE (512)..(512): Xaa at position 512 is Phe, Tyr, Met, His, Ile, Leu, Val Ala, or Gly
  SITE (523)..(523): Xaa at position 523 is Ala, Gly, or Pro
  SITE (537)..(537): Xaa at position 537 is Ile, Ala, Val, Leu, or Gly
  SITE (548)..(548): Xaa at position 548 is Leu, Ala, Val, Gly, or Ile
  SITE (580)..(580): Xaa at position 580 is Met, Ile, Leu, Val, Ala, or Gly
  SITE (749)..(749): Xaa at position 749 is Leu, Ala, Val, Gly, or Ile
  SITE (752)..(752): Xaa at position 752 is Met, Ile, Leu, Val, Ala, or Gly
MLPSLALLLLAAWTVRALEVPTDGNAGLLAEPQIAMFCGKLNMHMNVQNGKWESDPSGTKTCIGTKEGILQYCQEVYPELQITNVVEANQPVTIQNWCKRGRKQCKTHTHIVIPYRCLVGEFVSDALLVPDKCKFLHQERMDVCETHLHWHTVAKETCSEKSTNLHDYGMLLPCGIDKFRGVEFVCCPLAEESDSVDSADAEEDDSDVWWGGADTDYADGGEDKVVEVAEEEEVADVEEEEADDDEDVEDGDEVEEEAEEPYEEATERTTSTATTTTTTTESVEEVVREVCSEQAETGPCRAMISRWYFDVTEGKCVPFFYGGCGGNRNNFDTEEYCMAVCGSVSTQSLLKTTSEPLPQDPDKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENXITXLQAVPPRPHHXFNMLKKXVRAEQKDRQHTXKHXEHVRMVDPKKXAQIRSQVMTHLRVXYERMNQSLSLXYNVPAVAEEIQDEVDELLQKEQNYSDDVLANXISEPRISYGNDALMPSLTETKTTVELLPVNGEFSLDDLQPWHPFGVDSVPANTENEVEPVDARPAADRGLTTRPGSGLTNIKTEEISEVKMDAEFGHDSGFEVRHQKLVFFAEDVGSNKGAIIGLMVGGVVIATVIVITLVMLKKKQYTSIHHGVVEVDAAVTPEERHXSKXQQNGYENPTYKFFEQMQN

SEQ ID NO: 295 - protein, 3177 aa, Homo sapiens
  SITE (3112)..(3112): Xaa at position 3112 is Cys, Ala, Val, Gly, Ser, or Thr
  SITE (3158)..(3158): Xaa at position 3158 is Cys, Ala, Val, Gly, Ser, or Thr
  SITE (3162)..(3162): Xaa at position 3162 is Cys, Ala, Val, Gly, Ser, or Thr
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDIXKLPKDEGTCRDFILKWYYDPNTKSCARFWYGGCGGNENKFGSQKEXEKVXAPVLAKPGVISVMGT

SEQ ID NO: 296 - protein, 2224 aa, Homo sapiens
  SITE (36)..(36): Xaa at position 36 is Val, Ala, Gly, Leu, or Ile
  SITE (37)..(37): Xaa at position 37 is Ala, Gly, or Pro
  SITE (38)..(38): Xaa at position 38 is Ala, Gly, or Pro
  SITE (65)..(65): Xaa at position 65 is Val, Ala, Gly, Leu, or Ile
  SITE (66)..(66): Xaa at position 66 is Tyr, Phe, Met, His, Ile, Leu, Val Ala, or Gly
  SITE (85)..(85): Xaa at position 85 is Leu, Ala, Val, Gly, or Ile
  SITE (86)..(86): Xaa at position 86 is Leu, Ala, Val, Gly, or Ile
  SITE (92)..(92): Xaa at position 92 is Ala, Gly, or Pro
  SITE (98)..(98): Xaa at position 98 is Ile, Ala, Val, Leu, or Gly
  SITE (100)..(100): Xaa at position 100 is Val, Ala, Gly, Leu, or Ile
  SITE (102)..(102): Xaa at position 102 is Phe, Tyr, Met, His, Ile, Leu, Val Ala, or Gly
  SITE (110)..(110): Xaa at position 110 is Leu, Ala, Val, Gly, or Ile
  SITE (112)..(112): Xaa at position 112 is Ile, Ala, Val, Leu, or Gly
  SITE (113)..(113): Xaa at position 113 is His, Phe, Tyr, Lys, Arg, Gly, Ser Thr, Ala, Val, Leu, Ile, Asn, Met, or Gln
  SITE (126)..(126): Xaa at position 126 is Ala, Gly, or Pro
  SITE (142)..(142): Xaa at position 142 is Val, Ala, Gly, Leu, or Ile
  SITE (150)..(150): Xaa at position 150 is Tyr, Phe, Met, His, Ile, Leu, Val Ala, or Gly
  SITE (152)..(152): Xaa at position 152 is Trp, Tyr, Phe, Met, His, Ile, Leu Val, Ala, or Gly
  SITE (154)..(154): Xaa at position 154 is Ile, Ala, Val, Leu, or Gly
  SITE (167)..(167): Xaa at position 167 is Cys, Ala, Val, Gly, Ser, or Thr
  SITE (171)..(171): Xaa at position 171 is Ile, Ala, Val, Leu, or Gly
  SITE (172)..(172): Xaa at position 172 is Tyr, Phe, Met, His, Ile, Leu, Val Ala, or Gly
  SITE (186)..(186): Xaa at position 186 is Leu, Ala, Val, Gly, or Ile
  SITE (187)..(187): Xaa at position 187 is Ile, Ala, Val, Leu, or Gly
  SITE (190)..(190): Xaa at position 190 is Leu, Ala, Val, Gly, or Ile
  SITE (192)..(192): Xaa at position 192 is Ile, Ala, Val, Leu, or Gly
  SITE (193)..(193): Xaa at position 193 is Cys, Ala, Val, Gly, Ser, or Thr
  SITE (213)..(213): Xaa at position 213 is Leu, Ala, Val, Gly, or Ile
  SITE (214)..(214): Xaa at position 214 is Leu, Ala, Val, Gly, or Ile
  SITE (215)..(215): Xaa at position 215 is Phe, Tyr, Met, His, Ile, Leu, Val Ala, or Gly
  SITE (216)..(216): Xaa at position 216 is Ala, Gly, or Pro
  SITE (218)..(218): Xaa at position 218 is Phe, Tyr, Met, His, Ile, Leu, Val Ala, or Gly
  SITE (234)..(234): Xaa at position 234 is Val, Ala, Gly, Leu, or Ile
  SITE (238)..(238): Xaa at position 238 is Val, Ala, Gly, Leu, or Ile
  SITE (245)..(245): Xaa at position 245 is Ile, Ala, Val, Leu, or Gly
  SITE (247)..(247): Xaa at position 247 is Val, Ala, Gly, Leu, or Ile
  SITE (253)..(253): Xaa at position 253 is Ile, Ala, Val, Leu, or Gly
  SITE (255)..(255): Xaa at position 255 is Trp, Tyr, Phe, Met, His, Ile, Leu Val, Ala, or Gly
  SITE (256)..(256): Xaa at position 256 is His, Phe, Tyr, Lys, Arg, Gly, Ser Thr, Ala, Val, Leu, Ile, Asn, Met, or Gln
  SITE (257)..(257): Xaa at position 257 is Leu, Ala, Val, Gly, or Ile
  SITE (258)..(258): Xaa at position 258 is Leu, Ala, Val, Gly, or Ile
  SITE (267)..(267): Xaa at position 267 is Phe, Tyr, Met, His, Ile, Leu, Val Ala, or Gly
  SITE (269)..(269): Xaa at position 269 is Ile, Ala, Val, Leu, or Gly
  SITE (270)..(270): Xaa at position 270 is His, Phe, Tyr, Lys, Arg, Gly, Ser Thr, Ala, Val, Leu, Ile, Asn, Met, or Gln
  SITE (271)..(271): Xaa at position 271 is Phe, Tyr, Met, His, Ile, Leu, Val Ala, or Gly
  SITE (276)..(276): Xaa at position 276 is Leu, Ala, Val, Gly, or Ile
  SITE (288)..(288): Xaa at position 288 is Leu, Ala, Val, Gly, or Ile
  SITE (289)..(289): Xaa at position 289 is Val, Ala, Gly, Leu, or Ile
  SITE (296)..(296): Xaa at position 296 is Ala, Gly, or Pro
  SITE (298)..(298): Xaa at position 298 is Met, Ile, Leu, Val, Ala, or Gly
  SITE (306)..(306): Xaa at position 306 is Trp, Tyr, Phe, Met, His, Ile, Leu Val, Ala, or Gly
  SITE (308)..(308): Xaa at position 308 is Ile, Ala, Val, Leu, or Gly
  SITE (315)..(315): Xaa at position 315 is His, Phe, Tyr, Lys, Arg, Gly, Ser Thr, Ala, Val, Leu, Ile, Asn, Met, or Gln
  SITE (320)..(320): Xaa at position 320 is Met, Ile, Leu, Val, Ala, or Gly
  SITE (324)..(324): Xaa at position 324 is Ile, Ala, Val, Leu, or Gly
  SITE (354)..(354): Xaa at position 354 is Ile, Ala, Val, Leu, or Gly
  SITE (355)..(355): Xaa at position 355 is Ala, Gly, or Pro
  SITE (356)..(356): Xaa at position 356 is Ala, Gly, or Pro
  SITE (363)..(363): Xaa at position 363 is Tyr, Phe, Met, His, Ile, Leu, Val Ala, or Gly
  SITE (391)..(391): Xaa at position 391 is Tyr, Phe, Met, His, Ile, Leu, Val Ala, or Gly
  SITE (394)..(394): Xaa at position 394 is Val, Ala, Gly, Leu, or Ile
  SITE (395)..(395): Xaa at position 395 is Met, Ile, Leu, Val, Ala, or Gly
  SITE (431)..(431): Xaa at position 431 is Leu, Ala, Val, Gly, or Ile
  SITE (435)..(435): Xaa at position 435 is Phe, Tyr, Met, His, Ile, Leu, Val Ala, or Gly
  SITE (443)..(443): Xaa at position 443 is Tyr, Phe, Met, His, Ile, Leu, Val Ala, or Gly
  SITE (483)..(483): Xaa at position 483 is Tyr, Phe, Met, His, Ile, Leu, Val Ala, or Gly
  SITE (487)..(487): Xaa at position 487 is Ile, Ala, Val, Leu, or Gly
  SITE (500)..(500): Xaa at position 500 is Cys, Ala, Val, Gly, Ser, or Thr
  SITE (516)..(516): Xaa at position 516 is Ala, Gly, or Pro
  SITE (519)..(519): Xaa at position 519 is Leu, Ala, Val, Gly, or Ile
  SITE (523)..(523): Xaa at position 523 is Leu, Ala, Val, Gly, or Ile
  SITE (524)..(524): Xaa at position 524 is Leu, Ala, Val, Gly, or Ile
  SITE (525)..(525): Xaa at position 525 is Ile, Ala, Val, Leu, or Gly
  SITE (526)..(526): Xaa at position 526 is Cys, Ala, Val, Gly, Ser, or Thr
  SITE (546)..(546): Xaa at position 546 is Ala, Gly, or Pro
  SITE (548)..(548): Xaa at position 548 is Phe, Tyr, Met, His, Ile, Leu, Val Ala, or Gly
  SITE (586)..(586): Xaa at position 586 is Met, Ile, Leu, Val, Ala, or Gly
  SITE (589)..(589): Xaa at position 589 is Ile, Ala, Val, Leu, or Gly
  SITE (593)..(593): Xaa at position 593 is Val, Ala, Gly, Leu, or Ile
  SITE (608)..(608): Xaa at position 608 is Val, Ala, Gly, Leu, or Ile
  SITE (610)..(610): Xaa at position 610 is Trp, Tyr, Phe, Met, His, Ile, Leu Val, Ala, or Gly
  SITE (611)..(611): Xaa at position 611 is His, Phe, Tyr, Lys, Arg, Gly, Ser Thr, Ala, Val, Leu, Ile, Asn, Met, or Gln
  SITE (612)..(612): Xaa at position 612 is Phe, Tyr, Met, His, Ile, Leu, Val Ala, or Gly
  SITE (621)..(621): Xaa at position 621 is Ile, Ala, Val, Leu, or Gly
  SITE (624)..(624): Xaa at position 624 is Ile, Ala, Val, Leu, or Gly
  SITE (629)..(629): Xaa at position 629 is His, Phe, Tyr, Lys, Arg, Gly, Ser Thr, Ala, Val, Leu, Ile, Asn, Met, or Gln
  SITE (631)..(631): Xaa at position 631 is Phe, Tyr, Met, His, Ile, Leu, Val Ala, or Gly
  SITE (643)..(643): Xaa at position 643 is Leu, Ala, Val, Gly, or Ile
  SITE (651)..(651): Xaa at position 651 is Val, Ala, Gly, Leu, or Ile
  SITE (653)..(653): Xaa at position 653 is Val, Ala, Gly, Leu, or Ile
  SITE (655)..(655): Xaa at position 655 is Met, Ile, Leu, Val, Ala, or Gly
  SITE (661)..(661): Xaa at position 661 is Trp, Tyr, Phe, Met, His, Ile, Leu Val, Ala, or Gly
  SITE (663)..(663): Xaa at position 663 is Leu, Ala, Val, Gly, or Ile
  SITE (675)..(675): Xaa at position 675 is Leu, Ala, Val, Gly, or Ile
  SITE (679)..(679): Xaa at position 679 is Phe, Tyr, Met, His, Ile, Leu, Val Ala, or Gly
  SITE (1584)..(1584): Xaa at position 1584 is Ile, Ala, Val, Leu, or Gly
  SITE (1585)..(1585): Xaa at position 1585 is Ala, Gly, or Pro
  SITE (1586)..(1586): Xaa at position 1586 is Ala, Gly, or Pro
  SITE (1618)..(1618): Xaa at position 1618 is Val, Ala, Gly, Leu, or Ile
  SITE (1620)..(1620): Xaa at position 1620 is Phe, Tyr, Met, His, Ile, Leu Val, Ala, or Gly
  SITE (1643)..(1643): Xaa at position 1643 is Ile, Ala, Val, Leu, or Gly
  SITE (1648)..(1648): Xaa at position 1648 is Ile, Ala, Val, Leu, or Gly
  SITE (1650)..(1650): Xaa at position 1650 is Ala, Gly, or Pro
  SITE (1656)..(1656): Xaa at position 1656 is Ile, Ala, Val, Leu, or Gly
  SITE (1658)..(1658): Xaa at position 1658 is Val, Ala, Gly, Leu, or Ile
  SITE (1660)..(1660): Xaa at position 1660 is Phe, Tyr, Met, His, Ile, Leu Val, Ala, or Gly
  SITE (1668)..(1668): Xaa at position 1668 is Tyr, Phe, Met, His, Ile, Leu Val, Ala, or Gly
  SITE (1670)..(1670): Xaa at position 1670 is Leu, Ala, Val, Gly, or Ile
  SITE (1671)..(1671): Xaa at position 1671 is His, Phe, Tyr, Lys, Arg, Gly Ser, Thr, Ala, Val, Leu, Ile, Asn, Met, or Gln
  SITE (1672)..(1672): Xaa at position 1672 is Ala, Gly, or Pro
  SITE (1675)..(1675): Xaa at position 1675 is Leu, Ala, Val, Gly, or Ile
  SITE (1677)..(1677): Xaa at position 1677 is Tyr, Phe, Met, His, Ile, Leu Val, Ala, or Gly
  SITE (1708)..(1708): Xaa at position 1708 is Tyr, Phe, Met, His, Ile, Leu Val, Ala, or Gly
  SITE (1710)..(1710): Xaa at position 1710 is Trp, Tyr, Phe, Met, His, Ile Leu, Val, Ala, or Gly
  SITE (1712)..(1712): Xaa at position 1712 is Ala, Gly, or Pro
  SITE (1729)..(1729): Xaa at position 1729 is Ala, Gly, or Pro
  SITE (1730)..(1730): Xaa at position 1730 is Tyr, Phe, Met, His, Ile, Leu Val, Ala, or Gly
  SITE (1744)..(1744): Xaa at position 1744 is Leu, Ala, Val, Gly, or Ile
  SITE (1745)..(1745): Xaa at position 1745 is Ile, Ala, Val, Leu, or Gly
  SITE (1748)..(1748): Xaa at position 1748 is Leu, Ala, Val, Gly, or Ile
  SITE (1750)..(1750): Xaa at position 1750 is Ile, Ala, Val, Leu, or Gly
  SITE (1751)..(1751): Xaa at position 1751 is Cys, Ala, Val, Gly, Ser, or Thr
  SITE (1769)..(1769): Xaa at position 1769 is Phe, Tyr, Met, His, Ile, Leu Val, Ala, or Gly
  SITE (1770)..(1770): Xaa at position 1770 is Val, Ala, Gly, Leu, or Ile
  SITE (1771)..(1771): Xaa at position 1771 is Leu, Ala, Val, Gly, or Ile
  SITE (1772)..(1772): Xaa at position 1772 is Leu, Ala, Val, Gly, or Ile
  SITE (1776)..(1776): Xaa at position 1776 is Phe, Tyr, Met, His, Ile, Leu Val, Ala, or Gly
  SITE (1807)..(1807): Xaa at position 1807 is Ala, Gly, or Pro
  SITE (1808)..(1808): Xaa at position 1808 is Ile, Ala, Val, Leu, or Gly
  SITE (1818)..(1818): Xaa at position 1818 is Leu, Ala, Val, Gly, or Ile
  SITE (1820)..(1820): Xaa at position 1820 is Met, Ile, Leu, Val, Ala, or Gly
  SITE (1826)..(1826): Xaa at position 1826 is Val, Ala, Gly, Leu, or Ile
  SITE (1828)..(1828): Xaa at position 1828 is Leu, Ala, Val, Gly, or Ile
  SITE (1830)..(1830): Xaa at position 1830 is Leu, Ala, Val, Gly, or Ile
  SITE (1839)..(1839): Xaa at position 1839 is Ile, Ala, Val, Leu, or Gly
  SITE (1840)..(1840): Xaa at position 1840 is His, Phe, Tyr, Lys, Arg, Gly Ser, Thr, Ala, Val, Leu, Ile, Asn, Met, or Gln
  SITE (1841)..(1841): Xaa at position 1841 is Val, Ala, Gly, Leu, or Ile
  SITE (1842)..(1842): Xaa at position 1842 is Val, Ala, Gly, Leu, or Ile
  SITE (1844)..(1844): Xaa at position 1844 is Phe, Tyr, Met, His, Ile, Leu Val, Ala, or Gly
  SITE (1845)..(1845): Xaa at position 1845 is His, Phe, Tyr, Lys, Arg, Gly Ser, Thr, Ala, Val, Leu, Ile, Asn, Met, or Gln
  SITE (1849)..(1849): Xaa at position 1849 is Leu, Ala, Val, Gly, or Ile
  SITE (1864)..(1864): Xaa at position 1864 is Leu, Ala, Val, Gly, or Ile
  SITE (1872)..(1872): Xaa at position 1872 is Leu, Ala, Val, Gly, or Ile
  SITE (1882)..(1882): Xaa at position 1882 is Trp, Tyr, Phe, Met, His, Ile Leu, Val, Ala, or Gly
  SITE (1884)..(1884): Xaa at position 1884 is Leu, Ala, Val, Gly, or Ile
  SITE (1888)..(1888): Xaa at position 1888 is Val, Ala, Gly, Leu, or Ile
  SITE (1896)..(1896): Xaa at position 1896 is Met, Ile, Leu, Val, Ala, or Gly
  SITE (1900)..(1900): Xaa at position 1900 is Phe, Tyr, Met, His, Ile, Leu Val, Ala, or Gly
  SITE (1902)..(1902): Xaa at position 1902 is Ile, Ala, Val, Leu, or Gly
  SITE (1907)..(1907): Xaa at position 1907 is Cys, Ala, Val, Gly, Ser, or Thr
  SITE (1913)..(1913): Xaa at position 1913 is Leu, Ala, Val, Gly, or Ile
  SITE (1937)..(1937): Xaa at position 1937 is Ala, Gly, or Pro
  SITE (1947)..(1947): Xaa at position 1947 is Ala, Gly, or Pro
  SITE (1948)..(1948): Xaa at position 1948 is Trp, Tyr, Phe, Met, His, Ile Leu, Val, Ala, or Gly
  SITE (1963)..(1963): Xaa at position 1963 is Ile, Ala, Val, Leu, or Gly
  SITE (1971)..(1971): Xaa at position 1971 is Val, Ala, Gly, Leu, or Ile
  SITE (1993)..(1993): Xaa at position 1993 is Phe, Tyr, Met, His, Ile, Leu Val, Ala, or Gly
  SITE (2032)..(2032): Xaa at position 2032 is Phe, Tyr, Met, His, Ile, Leu Val, Ala, or Gly
  SITE (2043)..(2043): Xaa at position 2043 is Ile, Ala, Val, Leu, or Gly
  SITE (2054)..(2054): Xaa at position 2054 is Leu, Ala, Val, Gly, or Ile
  SITE (2056)..(2056): Xaa at position 2056 is Leu, Ala, Val, Gly, or Ile
  SITE (2072)..(2072): Xaa at position 2072 is Met, Ile, Leu, Val, Ala, or Gly
  SITE (2101)..(2101): Xaa at position 2101 is Ala, Gly, or Pro
  SITE (2111)..(2111): Xaa at position 2111 is Ala, Gly, or Pro
  SITE (2112)..(2112): Xaa at position 2112 is Trp, Tyr, Phe, Met, His, Ile Leu, Val, Ala, or Gly
  SITE (2114)..(2114): Xaa at position 2114 is Ala, Gly, or Pro
  SITE (2123)..(2123): Xaa at position 2123 is Leu, Ala, Val, Gly, or Ile
  SITE (2125)..(2125): Xaa at position 2125 is Ile, Ala, Val, Leu, or Gly
  SITE (2133)..(2133): Xaa at position 2133 is Ile, Ala, Val, Leu, or Gly
  SITE (2135)..(2135): Xaa at position 2135 is Ala, Gly, or Pro
  SITE (2136)..(2136): Xaa at position 2136 is Ile, Ala, Val, Leu, or Gly
  SITE (2141)..(2141): Xaa at position 2141 is Cys, Ala, Val, Gly, Ser, or Thr
  SITE (2150)..(2150): Xaa at position 2150 is Val, Ala, Gly, Leu, or Ile
  SITE (2153)..(2153): Xaa at position 2153 is Tyr, Phe, Met, His, Ile, Leu Val, Ala, or Gly
  SITE (2155)..(2155): Xaa at position 2155 is Ile, Ala, Val, Leu, or Gly
  SITE (2178)..(2178): Xaa at position 2178 is Phe, Tyr, Met, His, Ile, Leu Val, Ala, or Gly
  SITE (2196)..(2196): Xaa at position 2196 is Ile, Ala, Val, Leu, or Gly
  SITE (2201)..(2201): Xaa at position 2201 is Ile, Ala, Val, Leu, or Gly
  SITE (2203)..(2203): Xaa at position 2203 is Val, Ala, Gly, Leu, or Ile
  SITE (2212)..(2212): Xaa at position 2212 is Ile, Ala, Val, Leu, or Gly
  SITE (2213)..(2213): Xaa at position 2213 is Ala, Gly, or Pro
  SITE (2214)..(2214): Xaa at position 2214 is Leu, Ala, Val, Gly, or Ile
  SITE (2216)..(2216): Xaa at position 2216 is Leu, Ala, Val, Gly, or Ile
  SITE (2218)..(2218): Xaa at position 2218 is Leu, Ala, Val, Gly, or Ile
MFPGCPRLWVLVVLGTSWVGWGSQGTEAAQLRQFYXXXQGISWSYRPEPTNSSLNLSVTSFKKIXXREYEPYFKKEKPQSTISGXXGPTLYXEVGDIXKXHXKNKADKPXSXXPQGIRYSKLSEGXSYLDHTFPAEKMDDAXAPGREYTXEXSXSEDSGPTHDDPPXLTHXXYSHENLIEDFNSGXXGPXLXXKKGTLTEGGTQKTFDKQIVXXXXVXDESKSWSQSSSLMYTXNGYXNGTMPDXTXCAHDHXSXXXXGMSSGPELXSXXXNGQVXEQNHHKVSAITXXSATSTTXNXTVGPEGKXIXSSLTPKXLQAGXQAYXDIKNCPKKTRNLKKITREQRRHMKRWEYFXXXEEVIWDXAPVIPANMDKKYRSQHLDNFSNQIGKHXKKXXYTQYEDESFTKHTVNPNMKEDGILGPIIRAQVRDTXKIVXKNMASRPXSIYPHGVTFSPYEDEVNSSFTSGRNNTMIRAVQPGETYTXKWNXLEFDEPTENDAQXLTRPYYSDVDIMRDIXSGXIGLXXXXKSRSLDRRGIQRAADIEQQXVXAVFDENKSWYLEDNINKFCENPDEVKRDDPKFYESNIXSTXNGYXPESITTLGFCFDDTXQXXXCSVGTQNEXLTXHFTGXSXIYGKRHEDTLTXFPMRGESXTXTXDNVGTXMXTSMNSSPRSKKXRLKXRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYXXXEEISWDYSEFVQRETDIEDSDDIPEDTTYKKXVXRKYLDSTFTKRDPRGEYEEHLGXLGPIXRXEVDDVXQXRXKNLASRPXSXXXHGXSXEKSSEGKTYEDDSPEWFKEDNAVQPNSSYTXVXHXTERSGPESPGSACRAWXXYSAVNPEKDIHSGXXGPXLXXQKGILHKDSNMPMDMREXXXXFMTXDEKKSWYYEKKSRSSWRLTSSEMKKSHEFHXXNGMIYSLPGXKXYEQEWXRXHXLNIGGSQDXXXXHXXGQTXLENGNKQHQLGVWPXLPGSFKTXEMKASKPGWXLXNTEXGENQRAGXQTPXLXMDRDXRMPMGXSTGIISDSQIKASEFLGYWEPRLXRLNNGGSYNXXSVEKLAAEFASKPWXQVDMQKEXIITGIQTQGAKHYLKSCYTTEXYVAYSSNQINWQIFKGNSTRNVMYFNGNSDASTIKENQXDPPIVARYIRXSPTRAYNRPTXRXELQGCEVNGCSTPLGXENGKIENKQITASSFKKSWWGDYWEPFRXRLNAQGRVNXXQXKANNNKQWXEXDLLKIKKXTXXITQGXKSLSSEMYXKSXTXHYSEQGVEWKPYRLKSSMVDKIXEGNTNTKGHVKNFFNPPXISRFXRXIPKTWNQSXXXRXEXFGCDIY

SEQ ID NO: 297 - protein, 317 aa, Homo sapiens
  SITE (41)..(41): Xaa at position 41 is Ala, Gly, or Pro
  SITE (53)..(53): Xaa at position 53 is Leu, Ala, Val, Gly, or Ile
  SITE (58)..(58): Xaa at position 58 is Val, Ala, Gly, Leu, or Ile
  SITE (60)..(60): Xaa at position 60 is Leu, Ala, Val, Gly, or Ile
  SITE (62)..(62): Xaa at position 62 is Cys, Ala, Val, Gly, Ser, or Thr
  SITE (73)..(73): Xaa at position 73 is Ile, Ala, Val, Leu, or Gly
  SITE (75)..(75): Xaa at position 75 is Trp, Tyr, Phe, Met, His, Ile, Leu Val, Ala, or Gly
  SITE (94)..(94): Xaa at position 94 is Ala, Gly, or Pro
  SITE (102)..(102): Xaa at position 102 is Tyr, Phe, Met, His, Ile, Leu, Val Ala, or Gly
  SITE (104)..(104): Xaa at position 104 is Cys, Ala, Val, Gly, Ser, or Thr
  SITE (117)..(117): Xaa at position 117 is Leu, Ala, Val, Gly, or Ile
  SITE (120)..(120): Xaa at position 120 is Leu, Ala, Val, Gly, or Ile
  SITE (124)..(124): Xaa at position 124 is Leu, Ala, Val, Gly, or Ile
  SITE (125)..(125): Xaa at position 125 is Val, Ala, Gly, Leu, or Ile
  SITE (126)..(126): Xaa at position 126 is Leu, Ala, Val, Gly, or Ile
  SITE (131)..(131): Xaa at position 131 is Leu, Ala, Val, Gly, or Ile
  SITE (133)..(133): Xaa at position 133 is Phe, Tyr, Met, His, Ile, Leu, Val Ala, or Gly
  SITE (139)..(139): Xaa at position 139 is Ile, Ala, Val, Leu, or Gly
  SITE (141)..(141): Xaa at position 141 is Leu, Ala, Val, Gly, or Ile
  SITE (143)..(143): Xaa at position 143 is Cys, Ala, Val, Gly, Ser, or Thr
  SITE (144)..(144): Xaa at position 144 is His, Phe, Tyr, Lys, Arg, Gly, Ser Thr, Ala, Val, Leu, Ile, Asn, Met, or Gln
  SITE (154)..(154): Xaa at position 154 is Val, Ala, Gly, Leu, or Ile
  SITE (156)..(156): Xaa at position 156 is Phe, Tyr, Met, His, Ile, Leu, Val Ala, or Gly
  SITE (157)..(157): Xaa at position 157 is Phe, Tyr, Met, His, Ile, Leu, Val Ala, or Gly
  SITE (172)..(172): Xaa at position 172 is Phe, Tyr, Met, His, Ile, Leu, Val Ala, or Gly
  SITE (177)..(177): Xaa at position 177 is Ala, Gly, or Pro
  SITE (185)..(185): Xaa at position 185 is Tyr, Phe, Met, His, Ile, Leu, Val Ala, or Gly
  SITE (187)..(187): Xaa at position 187 is Cys, Ala, Val, Gly, Ser, or Thr
  SITE (203)..(203): Xaa at position 203 is Ile, Ala, Val, Leu, or Gly
  SITE (205)..(205): Xaa at position 205 is Val, Ala, Gly, Leu, or Ile
MTMETQMSQNVCPRNLWLLQPLTVLLLLASADSQAAAPPKXVLKLEPPWINVXQEDSXTXTXQGARSPESDSXQXFHNGNLIPTHTQPSYRFKXNNNDSGEXTXQTGQTSLSDPVHXTVXSEWXXXQTPHXEXQEGETXMXRXXSWKDKPLVKXTXXQNGKSQKFSHLDPTXSIPQXNHSHSGDXHXTGNIGYTLFSSKPVTXTXQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 298 - protein, 396 aa, Homo sapiens
  SITE (305)..(305): Xaa at position 305 is Phe, Tyr, Met, His, Ile, Leu, Val Ala, or Gly
  SITE (329)..(329): Xaa at position 329 is Cys, Ala, Val, Gly, Ser, or Thr
  SITE (343)..(343): Xaa at position 343 is Ala, Gly, or Pro
  SITE (371)..(371): Xaa at position 371 is Met, Ile, Leu, Val, Ala, or Gly
  SITE (393)..(393): Xaa at position 393 is Cys, Ala, Val, Gly, Ser, or Thr
  SITE (395)..(395): Xaa at position 395 is Cys, Ala, Val, Gly, Ser, or Thr
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDXSDVGWNDWIVAPPGYHAFYCHGEXPFPLADHLNSTNHXIVQTLVNSVNSKIPKACCVPTELSAISXLYLDENEKVVLKNYQDMVVEGXGXR

SEQ ID NO: 299 - protein, 408 aa, Homo sapiens
  SITE (317)..(317): Xaa at position 317 is Phe, Tyr, Met, His, Ile, Leu, Val Ala, or Gly
  SITE (341)..(341): Xaa at position 341 is Cys, Ala, Val, Gly, Ser, or Thr
  SITE (355)..(355): Xaa at position 355 is Ala, Gly, or Pro
  SITE (383)..(383): Xaa at position 383 is Met, Ile, Leu, Val, Ala, or Gly
  SITE (405)..(405): Xaa at position 405 is Cys, Ala, Val, Gly, Ser, or Thr
  SITE (407)..(407): Xaa at position 407 is Cys, Ala, Val, Gly, Ser, or Thr
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDXSDVGWNDWIVAPPGYQAFYCHGDXPFPLADHLNSTNHXIVQTLVNSVNSSIPKACCVPTELSAISXLYLDEYDKVVLKNYQEMVVEGXGXR

SEQ ID NO: 300 - protein, 1306 aa, Homo sapiens
  SITE (46)..(46): Xaa at position 46 is Ala, Gly, or Pro
  SITE (49)..(49): Xaa at position 49 is Phe, Tyr, Met, His, Ile, Leu, Val Ala, or Gly
  SITE (57)..(57): Xaa at position 57 is Ala, Gly, or Pro
  SITE (86)..(86): Xaa at position 86 is Ala, Gly, or Pro
  SITE (97)..(97): Xaa at position 97 is Trp, Tyr, Phe, Met, His, Ile, Leu Val, Ala, or Gly
  SITE (101)..(101): Xaa at position 101 is Ala, Gly, or Pro
  SITE (105)..(105): Xaa at position 105 is Tyr, Phe, Met, His, Ile, Leu, Val Ala, or Gly
  SITE (117)..(117): Xaa at position 117 is Leu, Ala, Val, Gly, or Ile
  SITE (121)..(121): Xaa at position 121 is Ile, Ala, Val, Leu, or Gly
  SITE (132)..(132): Xaa at position 132 is Leu, Ala, Val, Gly, or Ile
  SITE (147)..(147): Xaa at position 147 is Met, Ile, Leu, Val, Ala, or Gly
  SITE (172)..(172): Xaa at position 172 is Leu, Ala, Val, Gly, or Ile
  SITE (176)..(176): Xaa at position 176 is Leu, Ala, Val, Gly, or Ile
  SITE (185)..(185): Xaa at position 185 is Leu, Ala, Val, Gly, or Ile
  SITE (186)..(186): Xaa at position 186 is Leu, Ala, Val, Gly, or Ile
  SITE (188)..(188): Xaa at position 188 is Ala, Gly, or Pro
  SITE (189)..(189): Xaa at position 189 is Trp, Tyr, Phe, Met, His, Ile, Leu Val, Ala, or Gly
  SITE (192)..(192): Xaa at position 192 is Trp, Tyr, Phe, Met, His, Ile, Leu Val, Ala, or Gly
  SITE (193)..(193): Xaa at position 193 is His, Phe, Tyr, Lys, Arg, Gly, Ser Thr, Ala, Val, Leu, Ile, Asn, Met, or Gln
  SITE (196)..(196): Xaa at position 196 is Ala, Gly, or Pro
  SITE (200)..(200): Xaa at position 200 is Leu, Ala, Val, Gly, or Ile
  SITE (204)..(204): Xaa at position 204 is Tyr, Phe, Met, His, Ile, Leu, Val Ala, or Gly
  SITE (207)..(207): Xaa at position 207 is Phe, Tyr, Met, His, Ile, Leu, Val Ala, or Gly
  SITE (214)..(214): Xaa at position 214 is Ala, Gly, or Pro
  SITE (231)..(231): Xaa at position 231 is Tyr, Phe, Met, His, Ile, Leu, Val Ala, or Gly
  SITE (240)..(240): Xaa at position 240 is Leu, Ala, Val, Gly, or Ile
  SITE (244)..(244): Xaa at position 244 is Tyr, Phe, Met, His, Ile, Leu, Val Ala, or Gly
  SITE (247)..(247): Xaa at position 247 is Leu, Ala, Val, Gly, or Ile
  SITE (251)..(251): Xaa at position 251 is Tyr, Phe, Met, His, Ile, Leu, Val Ala, or Gly
  SITE (254)..(254): Xaa at position 254 is Leu, Ala, Val, Gly, or Ile
  SITE (255)..(255): Xaa at position 255 is His, Phe, Tyr, Lys, Arg, Gly, Ser Thr, Ala, Val, Leu, Ile, Asn, Met, or Gln
  SITE (256)..(256): Xaa at position 256 is Ala, Gly, or Pro
  SITE (258)..(258): Xaa at position 258 is Val, Ala, Gly, Leu, or Ile
  SITE (262)..(262): Xaa at position 262 is Leu, Ala, Val, Gly, or Ile
  SITE (271)..(271): Xaa at position 271 is Ile, Ala, Val, Leu, or Gly
  SITE (277)..(277): Xaa at position 277 is Ile, Ala, Val, Leu, or Gly
  SITE (279)..(279): Xaa at position 279 is Ala, Gly, or Pro
  SITE (280)..(280): Xaa at position 280 is His, Phe, Tyr, Lys, Arg, Gly, Ser Thr, Ala, Val, Leu, Ile, Asn, Met, or Gln
  SITE (282)..(282): Xaa at position 282 is Leu, Ala, Val, Gly, or Ile
  SITE (287)..(287): Xaa at position 287 is Ala, Gly, or Pro
  SITE (290)..(290): Xaa at position 290 is Trp, Tyr, Phe, Met, His, Ile, Leu Val, Ala, or Gly
  SITE (293)..(293): Xaa at position 293 is Ile, Ala, Val, Leu, or Gly
  SITE (297)..(297): Xaa at position 297 is Val, Ala, Gly, Leu, or Ile
  SITE (306)..(306): Xaa at position 306 is Leu, Ala, Val, Gly, or Ile
  SITE (308)..(308): Xaa at position 308 is Val, Ala, Gly, Leu, or Ile
  SITE (312)..(312): Xaa at position 312 is Met, Ile, Leu, Val, Ala, or Gly
  SITE (319)..(319): Xaa at position 319 is Ala, Gly, or Pro
  SITE (322)..(322): Xaa at position 322 is Met, Ile, Leu, Val, Ala, or Gly
  SITE (323)..(323): Xaa at position 323 is Phe, Tyr, Met, His, Ile, Leu, Val Ala, or Gly
  SITE (326)..(326): Xaa at position 326 is Ala, Gly, or Pro
  SITE (329)..(329): Xaa at position 329 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (333)..(333): Xaa at position 333 is Leu, Ala, Val, Gly, or Ile
  SITE (342)..(342): Xaa at position 342 is Phe, Tyr, Met, His, Ile, Leu, Val Ala, or Gly
  SITE (366)..(366): Xaa at position 366 is Phe, Tyr, Met, His, Ile, Leu, Val Ala, or Gly
  SITE (372)..(372): Xaa at position 372 is Phe, Tyr, Met, His, Ile, Leu, Val Ala, or Gly
  SITE (374)..(374): Xaa at position 374 is Ile, Ala, Val, Leu, or Gly
  SITE (388)..(388): Xaa at position 388 is Val, Ala, Gly, Leu, or Ile
  SITE (389)..(389): Xaa at position 389 is His, Phe, Tyr, Lys, Arg, Gly, Ser Thr, Ala, Val, Leu, Ile, Asn, Met, or Gln
  SITE (392)..(392): Xaa at position 392 is Met, Ile, Leu, Val, Ala, or Gly
  SITE (395)..(395): Xaa at position 395 is Ile, Ala, Val, Leu, or Gly
  SITE (397)..(397): Xaa at position 397 is Tyr, Phe, Met, His, Ile, Leu, Val Ala, or Gly
  SITE (401)..(401): Xaa at position 401 is Tyr, Phe, Met, His, Ile, Leu, Val Ala, or Gly
  SITE (408)..(408): Xaa at position 408 is Leu, Ala, Val, Gly, or Ile
  SITE (416)..(416): Xaa at position 416 is Phe, Tyr, Met, His, Ile, Leu, Val Ala, or Gly
  SITE (419)..(419): Xaa at position 419 is Ala, Gly, or Pro
  SITE (420)..(420): Xaa at position 420 is Ile, Ala, Val, Leu, or Gly
  SITE (423)..(423): Xaa at position 423 is Val, Ala, Gly, Leu, or Ile
  SITE (424)..(424): Xaa at position 424 is Leu, Ala, Val, Gly, or Ile
  SITE (426)..(426): Xaa at position 426 is Leu, Ala, Val, Gly, or Ile
  SITE (434)..(434): Xaa at position 434 is Leu, Ala, Val, Gly, or Ile
  SITE (439)..(439): Xaa at position 439 is Leu, Ala, Val, Gly, or Ile
  SITE (453)..(453): Xaa at position 453 is Tyr, Phe, Met, His, Ile, Leu, Val Ala, or Gly
  SITE (454)..(454): Xaa at position 454 is Leu, Ala, Val, Gly, or Ile
  SITE (455)..(455): Xaa at position 455 is Leu, Ala, Val, Gly, or Ile
  SITE (457)..(457): Xaa at position 457 is Met, Ile, Leu, Val, Ala, or Gly
  SITE (458)..(458): Xaa at position 458 is Ala, Gly, or Pro
  SITE (459)..(459): Xaa at position 459 is Leu, Ala, Val, Gly, or Ile
  SITE (463)..(463): Xaa at position 463 is Ala, Gly, or Pro
  SITE (465)..(465): Xaa at position 465 is Leu, Ala, Val, Gly, or Ile
  SITE (467)..(467): Xaa at position 467 is Phe, Tyr, Met, His, Ile, Leu, Val Ala, or Gly
  SITE (470)..(470): Xaa at position 470 is Leu, Ala, Val, Gly, or Ile
  SITE (471)..(471): Xaa at position 471 is Val, Ala, Gly, Leu, or Ile
  SITE (474)..(474): Xaa at position 474 is Trp, Tyr, Phe, Met, His, Ile, Leu Val, Ala, or Gly
  SITE (492)..(492): Xaa at position 492 is Trp, Tyr, Phe, Met, His, Ile, Leu Val, Ala, or Gly
  SITE (495)..(495): Xaa at position 495 is Leu, Ala, Val, Gly, or Ile
  SITE (502)..(502): Xaa at position 502 is Ile, Ala, Val, Leu, or Gly
  SITE (503)..(503): Xaa at position 503 is Cys, Ala, Val, Gly, Ser, or Thr
  SITE (513)..(513): Xaa at position 513 is Phe, Tyr, Met, His, Ile, Leu, Val Ala, or Gly
  SITE (515)..(515): Xaa at position 515 is Ala, Gly, or Pro
  SITE (517)..(517): Xaa at position 517 is Ala, Gly, or Pro
  SITE (521)..(521): Xaa at position 521 is Val, Ala, Gly, Leu, or Ile
  SITE (531)..(531): Xaa at position 531 is Phe, Tyr, Met, His, Ile, Leu, Val Ala, or Gly
  SITE (532)..(532): Xaa at position 532 is Val, Ala, Gly, Leu, or Ile
  SITE (535)..(535): Xaa at position 535 is Val, Ala, Gly, Leu, or Ile
  SITE (536)..(536): Xaa at position 536 is Leu, Ala, Val, Gly, or Ile
  SITE (538)..(538): Xaa at position 538 is Phe, Tyr, Met, His, Ile, Leu, Val Ala, or Gly
  SITE (540)..(540): Xaa at position 540 is Phe, Tyr, Met, His, Ile, Leu, Val Ala, or Gly
  SITE (541)..(541): Xaa at position 541 is His, Phe, Tyr, Lys, Arg, Gly, Ser Thr, Ala, Val, Leu, Ile, Asn, Met, or Gln
  SITE (544)..(544): Xaa at position 544 is Leu, Ala, Val, Gly, or Ile
  SITE (557)..(557): Xaa at position 557 is Cys, Ala, Val, Gly, Ser, or Thr
  SITE (559)..(559): Xaa at position 559 is Ile, Ala, Val, Leu, or Gly
  SITE (565)..(565): Xaa at position 565 is Ala, Gly, or Pro
  SITE (569)..(569): Xaa at position 569 is Leu, Ala, Val, Gly, or Ile
  SITE (573)..(573): Xaa at position 573 is Leu, Ala, Val, Gly, or Ile
  SITE (584)..(584): Xaa at position 584 is Val, Ala, Gly, Leu, or Ile
  SITE (585)..(585): Xaa at position 585 is Leu, Ala, Val, Gly, or Ile
  SITE (596)..(596): Xaa at position 596 is Ala, Gly, or Pro
  SITE (599)..(599): Xaa at position 599 is Leu, Ala, Val, Gly, or Ile
  SITE (602)..(602): Xaa at position 602 is Tyr, Phe, Met, His, Ile, Leu, Val Ala, or Gly
  SITE (603)..(603): Xaa at position 603 is Phe, Tyr, Met, His, Ile, Leu, Val Ala, or Gly
  SITE (606)..(606): Xaa at position 606 is Val, Ala, Gly, Leu, or Ile
  SITE (649)..(649): Xaa at position 649 is Ala, Gly, or Pro
  SITE (652)..(652): Xaa at position 652 is Phe, Tyr, Met, His, Ile, Leu, Val Ala, or Gly
  SITE (674)..(674): Xaa at position 674 is Tyr, Phe, Met, His, Ile, Leu, Val Ala, or Gly
  SITE (700)..(700): Xaa at position 700 is Tyr, Phe, Met, His, Ile, Leu, Val Ala, or Gly
  SITE (704)..(704): Xaa at position 704 is Ala, Gly, or Pro
  SITE (717)..(717): Xaa at position 717 is Ile, Ala, Val, Leu, or Gly
  SITE (720)..(720): Xaa at position 720 is Ile, Ala, Val, Leu, or Gly
  SITE (721)..(721): Xaa at position 721 is Ile, Ala, Val, Leu, or Gly
  SITE (732)..(732): Xaa at position 732 is Leu, Ala, Val, Gly, or Ile
  SITE (747)..(747): Xaa at position 747 is Met, Ile, Leu, Val, Ala, or Gly
  SITE (770)..(770): Xaa at position 770 is Leu, Ala, Val, Gly, or Ile
  SITE (774)..(774): Xaa at position 774 is Met, Ile, Leu, Val, Ala, or Gly
  SITE (783)..(783): Xaa at position 783 is Leu, Ala, Val, Gly, or Ile
  SITE (784)..(784): Xaa at position 784 is Leu, Ala, Val, Gly, or Ile
  SITE (786)..(786): Xaa at position 786 is Ala, Gly, or Pro
  SITE (787)..(787): Xaa at position 787 is Trp, Tyr, Phe, Met, His, Ile, Leu Val, Ala, or Gly
  SITE (790)..(790): Xaa at position 790 is Trp, Tyr, Phe, Met, His, Ile, Leu Val, Ala, or Gly
  SITE (794)..(794): Xaa at position 794 is Ala, Gly, or Pro
  SITE (798)..(798): Xaa at position 798 is Ile, Ala, Val, Leu, or Gly
  SITE (802)..(802): Xaa at position 802 is Tyr, Phe, Met, His, Ile, Leu, Val Ala, or Gly
  SITE (805)..(805): Xaa at position 805 is Tyr, Phe, Met, His, Ile, Leu, Val Ala, or Gly
  SITE (808)..(808): Xaa at position 808 is Leu, Ala, Val, Gly, or Ile
  SITE (812)..(812): Xaa at position 812 is Ala, Gly, or Pro
  SITE (821)..(821): Xaa at position 821 is Ala, Gly, or Pro
  SITE (829)..(829): Xaa at position 829 is Tyr, Phe, Met, His, Ile, Leu, Val Ala, or Gly
  SITE (838)..(838): Xaa at position 838 is Leu, Ala, Val, Gly, or Ile
  SITE (842)..(842): Xaa at position 842 is Phe, Tyr, Met, His, Ile, Leu, Val Ala, or Gly
  SITE (845)..(845): Xaa at position 845 is Leu, Ala, Val, Gly, or Ile
  SITE (848)..(848): Xaa at position 848 is Leu, Ala, Val, Gly, or Ile
  SITE (849)..(849): Xaa at position 849 is Tyr, Phe, Met, His, Ile, Leu, Val Ala, or Gly
  SITE (852)..(852): Xaa at position 852 is Leu, Ala, Val, Gly, or Ile
  SITE (853)..(853): Xaa at position 853 is His, Phe, Tyr, Lys, Arg, Gly, Ser Thr, Ala, Val, Leu, Ile, Asn, Met, or Gln
  SITE (854)..(854): Xaa at position 854 is Ala, Gly, or Pro
  SITE (856)..(856): Xaa at position 856 is Val, Ala, Gly, Leu, or Ile
  SITE (859)..(859): Xaa at position 859 is Ala, Gly, or Pro
  SITE (860)..(860): Xaa at position 860 is Leu, Ala, Val, Gly, or Ile
  SITE (869)..(869): Xaa at position 869 is Ile, Ala, Val, Leu, or Gly
  SITE (875)..(875): Xaa at position 875 is Ile, Ala, Val, Leu, or Gly
  SITE (877)..(877): Xaa at position 877 is Ala, Gly, or Pro
  SITE (878)..(878): Xaa at position 878 is His, Phe, Tyr, Lys, Arg, Gly, Ser Thr, Ala, Val, Leu, Ile, Asn, Met, or Gln
  SITE (879)..(879): Xaa at position 879 is Leu, Ala, Val, Gly, or Ile
  SITE (880)..(880): Xaa at position 880 is Leu, Ala, Val, Gly, or Ile
  SITE (885)..(885): Xaa at position 885 is Ala, Gly, or Pro
  SITE (888)..(888): Xaa at position 888 is Trp, Tyr, Phe, Met, His, Ile, Leu Val, Ala, or Gly
  SITE (891)..(891): Xaa at position 891 is Ile, Ala, Val, Leu, or Gly
  SITE (895)..(895): Xaa at position 895 is Val, Ala, Gly, Leu, or Ile
  SITE (901)..(901): Xaa at position 901 is Ala, Gly, or Pro
  SITE (904)..(904): Xaa at position 904 is Met, Ile, Leu, Val, Ala, or Gly
  SITE (909)..(909): Xaa at position 909 is Ala, Gly, or Pro
  SITE (910)..(910): Xaa at position 910 is Met, Ile, Leu, Val, Ala, or Gly
  SITE (920)..(920): Xaa at position 920 is Met, Ile, Leu, Val, Ala, or Gly
  SITE (921)..(921): Xaa at position 921 is Phe, Tyr, Met, His, Ile, Leu, Val Ala, or Gly
  SITE (924)..(924): Xaa at position 924 is Ala, Gly, or Pro
  SITE (927)..(927): Xaa at position 927 is Phe, Tyr, Met, His, Ile, Leu, Val Ala, or Gly
  SITE (928)..(928): Xaa at position 928 is Phe, Tyr, Met, His, Ile, Leu, Val Ala, or Gly
  SITE (931)..(931): Xaa at position 931 is Leu, Ala, Val, Gly, or Ile
  SITE (940)..(940): Xaa at position 940 is Phe, Tyr, Met, His, Ile, Leu, Val Ala, or Gly
  SITE (946)..(946): Xaa at position 946 is Leu, Ala, Val, Gly, or Ile
  SITE (956)..(956): Xaa at position 956 is Val, Ala, Gly, Leu, or Ile
  SITE (964)..(964): Xaa at position 964 is Phe, Tyr, Met, His, Ile, Leu, Val Ala, or Gly
  SITE (970)..(970): Xaa at position 970 is Phe, Tyr, Met, His, Ile, Leu, Val Ala, or Gly
  SITE (972)..(972): Xaa at position 972 is Ile, Ala, Val, Leu, or Gly
  SITE (983)..(983): Xaa at position 983 is Leu, Ala, Val, Gly, or Ile
  SITE (986)..(986): Xaa at position 986 is Ala, Gly, or Pro
  SITE (987)..(987): Xaa at position 987 is His, Phe, Tyr, Lys, Arg, Gly, Ser Thr, Ala, Val, Leu, Ile, Asn, Met, or Gln
  SITE (990)..(990): Xaa at position 990 is Met, Ile, Leu, Val, Ala, or Gly
  SITE (993)..(993): Xaa at position 993 is Ile, Ala, Val, Leu, or Gly
  SITE (995)..(995): Xaa at position 995 is Tyr, Phe, Met, His, Ile, Leu, Val Ala, or Gly
  SITE (999)..(999): Xaa at position 999 is Tyr, Phe, Met, His, Ile, Leu, Val Ala, or Gly
  SITE (1004)..(1004): Xaa at position 1004 is Val, Ala, Gly, Leu, or Ile
  SITE (1005)..(1005): Xaa at position 1005 is Ala, Gly, or Pro
  SITE (1006)..(1006): Xaa at position 1006 is Leu, Ala, Val, Gly, or Ile
  SITE (1010)..(1010): Xaa at position 1010 is Ala, Gly, or Pro
  SITE (1014)..(1014): Xaa at position 1014 is Phe, Tyr, Met, His, Ile, Leu Val, Ala, or Gly
  SITE (1017)..(1017): Xaa at position 1017 is Ala, Gly, or Pro
  SITE (1018)..(1018): Xaa at position 1018 is Ile, Ala, Val, Leu, or Gly
  SITE (1021)..(1021): Xaa at position 1021 is Val, Ala, Gly, Leu, or Ile
  SITE (1022)..(1022): Xaa at position 1022 is Leu, Ala, Val, Gly, or Ile
  SITE (1023)..(1023): Xaa at position 1023 is Ala, Gly, or Pro
  SITE (1024)..(1024): Xaa at position 1024 is Leu, Ala, Val, Gly, or Ile
  SITE (1026)..(1026): Xaa at position 1026 is Val, Ala, Gly, Leu, or Ile
  SITE (1032)..(1032): Xaa at position 1032 is Leu, Ala, Val, Gly, or Ile
  SITE (1037)..(1037): Xaa at position 1037 is Leu, Ala, Val, Gly, or Ile
  SITE (1051)..(1051): Xaa at position 1051 is Phe, Tyr, Met, His, Ile, Leu Val, Ala, or Gly
  SITE (1052)..(1052): Xaa at position 1052 is Leu, Ala, Val, Gly, or Ile
  SITE (1053)..(1053): Xaa at position 1053 is Met, Ile, Leu, Val, Ala, or Gly
  SITE (1055)..(1055): Xaa at position 1055 is Met, Ile, Leu, Val, Ala, or Gly
  SITE (1056)..(1056): Xaa at position 1056 is Ala, Gly, or Pro
  SITE (1057)..(1057): Xaa at position 1057 is Leu, Ala, Val, Gly, or Ile
  SITE (1060)..(1060): Xaa at position 1060 is Ile, Ala, Val, Leu, or Gly
  SITE (1061)..(1061): Xaa at position 1061 is Ala, Gly, or Pro
  SITE (1063)..(1063): Xaa at position 1063 is Ile, Ala, Val, Leu, or Gly
  SITE (1065)..(1065): Xaa at position 1065 is Phe, Tyr, Met, His, Ile, Leu Val, Ala, or Gly
  SITE (1067)..(1067): Xaa at position 1067 is Tyr, Phe, Met, His, Ile, Leu Val, Ala, or Gly
  SITE (1068)..(1068): Xaa at position 1068 is Leu, Ala, Val, Gly, or Ile
  SITE (1069)..(1069): Xaa at position 1069 is Val, Ala, Gly, Leu, or Ile
  SITE (1072)..(1072): Xaa at position 1072 is Trp, Tyr, Phe, Met, His, Ile Leu, Val, Ala, or Gly
  SITE (1090)..(1090): Xaa at position 1090 is Trp, Tyr, Phe, Met, His, Ile Leu, Val, Ala, or Gly
  SITE (1093)..(1093): Xaa at position 1093 is Leu, Ala, Val, Gly, or Ile
  SITE (1100)..(1100): Xaa at position 1100 is Leu, Ala, Val, Gly, or Ile
  SITE (1101)..(1101): Xaa at position 1101 is Cys, Ala, Val, Gly, Ser, or Thr
  SITE (1111)..(1111): Xaa at position 1111 is Phe, Tyr, Met, His, Ile, Leu Val, Ala, or Gly
  SITE (1115)..(1115): Xaa at position 1115 is Ala, Gly, or Pro
  SITE (1119)..(1119): Xaa at position 1119 is Ile, Ala, Val, Leu, or Gly
  SITE (1129)..(1129): Xaa at position 1129 is Phe, Tyr, Met, His, Ile, Leu Val, Ala, or Gly
  SITE (1130)..(1130): Xaa at position 1130 is Val, Ala, Gly, Leu, or Ile
  SITE (1133)..(1133): Xaa at position 1133 is Ile, Ala, Val, Leu, or Gly
  SITE (1134)..(1134): Xaa at position 1134 is Ile, Ala, Val, Leu, or Gly
  SITE (1136)..(1136): Xaa at position 1136 is Phe, Tyr, Met, His, Ile, Leu Val, Ala, or Gly
  SITE (1138)..(1138): Xaa at position 1138 is Phe, Tyr, Met, His, Ile, Leu Val, Ala, or Gly
  SITE (1139)..(1139): Xaa at position 1139 is His, Phe, Tyr, Lys, Arg, Gly Ser, Thr, Ala, Val, Leu, Ile, Asn, Met, or Gln
  SITE (1141)..(1141): Xaa at position 1141 is Ala, Gly, or Pro
  SITE (1142)..(1142): Xaa at position 1142 is Leu, Ala, Val, Gly, or Ile
  SITE (1143)..(1143): Xaa at position 1143 is Cys, Ala, Val, Gly, Ser, or Thr
  SITE (1153)..(1153): Xaa at position 1153 is His, Phe, Tyr, Lys, Arg, Gly Ser, Thr, Ala, Val, Leu, Ile, Asn, Met, or Gln
  SITE (1155)..(1155): Xaa at position 1155 is Cys, Ala, Val, Gly, Ser, or Thr
  SITE (1157)..(1157): Xaa at position 1157 is Ile, Ala, Val, Leu, or Gly
  SITE (1163)..(1163): Xaa at position 1163 is Ala, Gly, or Pro
  SITE (1167)..(1167): Xaa at position 1167 is Leu, Ala, Val, Gly, or Ile
  SITE (1170)..(1170): Xaa at position 1170 is Ala, Gly, or Pro
  SITE (1171)..(1171): Xaa at position 1171 is Met, Ile, Leu, Val, Ala, or Gly
  SITE (1175)..(1175): Xaa at position 1175 is Phe, Tyr, Met, His, Ile, Leu Val, Ala, or Gly
  SITE (1182)..(1182): Xaa at position 1182 is Ala, Gly, or Pro
  SITE (1183)..(1183): Xaa at position 1183 is Met, Ile, Leu, Val, Ala, or Gly
  SITE (1186)..(1186): Xaa at position 1186 is Ile, Ala, Val, Leu, or Gly
  SITE (1194)..(1194): Xaa at position 1194 is Ala, Gly, or Pro
  SITE (1196)..(1196): Xaa at position 1196 is Ala, Gly, or Pro
  SITE (1197)..(1197): Xaa at position 1197 is Met, Ile, Leu, Val, Ala, or Gly
  SITE (1200)..(1200): Xaa at position 1200 is Tyr, Phe, Met, His, Ile, Leu Val, Ala, or Gly
  SITE (1201)..(1201): Xaa at position 1201 is Phe, Tyr, Met, His, Ile, Leu Val, Ala, or Gly
  SITE (1204)..(1204): Xaa at position 1204 is Leu, Ala, Val, Gly, or Ile
  SITE (1208)..(1208): Xaa at position 1208 is Leu, Ala, Val, Gly, or Ile
MGAASGRRGPGLLLPLPLLLLLPPQPALALDPGLQPGNFSADEAGXQLXAQSYNSSXEQVLFQSVAASWAHDTNITAENARRQEEXALLSQEFAEAXGQKXKELXEPIWQNFTDPQXRRIXGAVRTLGSANXPLAKRQQYNALLSNXSRIYSTAKVCLPNKTATCWSLDPDXTNIXASSRSYAMXXFXXEGXXNAXGIPXKPLXEDXTALSNEXYKQDGFTDTGAYWRSWXNSPTFEDDXEHLXQQXEPLXLNXXXFXRRAXHRRYGDRYXNLRGPXPXXLXGDMWXQSXENXYDMXVPFPDKPNXDXTSTXLQQGWNXTHXXRVXEEXXTSXELSPMPPEXWEGSMLEKPADGREVVCHASAWDXYNRKDXRXKQCTRVTMDQLSTXXHEXGHXQXYLQXKDLPVSXRRGANPGXHEXXGDXXAXSVSTPEHXHKIGXLDRVTNDTESDINXXXKXXXEKIXFXPXGYXXDQXRWGVFSGRTPPSRYNFDXWYXRTKYQGXXPPVTRNETHXDXGXKFHXPNVTPYIRYXXSFXXQXQXXEAXCKEAGYEGPLHQXDXYRSTKXGAKXRKVXQAGSSRPWQEXXKDMVGLDALDXQPXLKXXQPXTQWLQEQNQQNGEVLGWPEYQWHPPLPDNYPEGIDLVTDEAEXSKXVEEYDRTSQVVWNEYAEANWNXNTNITTETSKILLQKNMQIANHTLKXGTQXRKFDVNQLQNTTXKRXXKKVQDLERAAXPAQELEEYNKILLDXETTYSVATVCHPNGSCLQLEPDXTNVXATSRKYEDXXWXXEGXRDKXGRAXLQFXPKXVEXINQXARLNGYVDXGDSWRSMXETPSLEQDXERLXQEXQPXXLNXXXYXRRXXHRHYGAQHXNLEGPXPXXXXGNMWXQTXSNXYDLXVPFPSXPSXDTTEXXLKQGWTPRRXXKEXDDXXTSXGLLPVPPEXWNKSMXEKPTDGREVXCHASAWDXYNGKDXRXKQCTTVNLEDXVVXXHEXGHXQXFMQXKDLPXXXREGXNPGXHEXXGDXXXXSXSTPKHXHSLNXLSSEGGSDEHDINXXXKXXXDKXXFXPXSXXXDQXRWRVFDGSITKENYNQEXWSXRLKYQGXXPPVPRTQGDXDPGXKFHXPSSVPYIRYXXSFXXQXQXXEXXXQAAGHTGPLXKXDXYQSKEXGQRXATXXKLGXSRPWPEXXQLXTGQPNMSXSXXLSXXKPXLDWXRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 301 - protein, 882 aa, Homo sapiens
  SITE (163)..(163): Xaa at position 163 is Cys, Ala, Val, Gly, Ser, or Thr
  SITE (178)..(178): Xaa at position 178 is Ile, Ala, Val, Leu, or Gly
  SITE (188)..(188): Xaa at position 188 is Val, Ala, Gly, Leu, or Ile
  SITE (204)..(204): Xaa at position 204 is Val, Ala, Gly, Leu, or Ile
  SITE (205)..(205): Xaa at position 205 is Phe, Tyr, Met, His, Ile, Leu, Val Ala, or Gly
  SITE (214)..(214): Xaa at position 214 is Leu, Ala, Val, Gly, or Ile
  SITE (216)..(216): Xaa at position 216 is Val, Ala, Gly, Leu, or Ile
  SITE (220)..(220): Xaa at position 220 is Leu, Ala, Val, Gly, or Ile
  SITE (228)..(228): Xaa at position 228 is Tyr, Phe, Met, His, Ile, Leu, Val Ala, or Gly
  SITE (230)..(230): Xaa at position 230 is Leu, Ala, Val, Gly, or Ile
  SITE (234)..(234): Xaa at position 234 is Ala, Gly, or Pro
  SITE (246)..(246): Xaa at position 246 is Met, Ile, Leu, Val, Ala, or Gly
  SITE (248)..(248): Xaa at position 248 is Ile, Ala, Val, Leu, or Gly
  SITE (250)..(250): Xaa at position 250 is Ile, Ala, Val, Leu, or Gly
  SITE (252)..(252): Xaa at position 252 is Val, Ala, Gly, Leu, or Ile
  SITE (262)..(262): Xaa at position 262 is Phe, Tyr, Met, His, Ile, Leu, Val Ala, or Gly
  SITE (271)..(271): Xaa at position 271 is Val, Ala, Gly, Leu, or Ile
  SITE (284)..(284): Xaa at position 284 is Val, Ala, Gly, Leu, or Ile
  SITE (301)..(301): Xaa at position 301 is Ala, Gly, or Pro
  SITE (316)..(316): Xaa at position 316 is Met, Ile, Leu, Val, Ala, or Gly
  SITE (326)..(326): Xaa at position 326 is Ile, Ala, Val, Leu, or Gly
  SITE (328)..(328): Xaa at position 328 is Val, Ala, Gly, Leu, or Ile
  SITE (341)..(341): Xaa at position 341 is Tyr, Phe, Met, His, Ile, Leu, Val Ala, or Gly
  SITE (343)..(343): Xaa at position 343 is Leu, Ala, Val, Gly, or Ile
  SITE (344)..(344): Xaa at position 344 is Val, Ala, Gly, Leu, or Ile
  SITE (345)..(345): Xaa at position 345 is Val, Ala, Gly, Leu, or Ile
  SITE (347)..(347): Xaa at position 347 is Ala, Gly, or Pro
  SITE (348)..(348): Xaa at position 348 is Ala, Gly, or Pro
  SITE (359)..(359): Xaa at position 359 is Ala, Gly, or Pro
  SITE (361)..(361): Xaa at position 361 is Ala, Gly, or Pro
  SITE (363)..(363): Xaa at position 363 is Ile, Ala, Val, Leu, or Gly
  SITE (365)..(365): Xaa at position 365 is Val, Ala, Gly, Leu, or Ile
  SITE (396)..(396): Xaa at position 396 is Leu, Ala, Val, Gly, or Ile
  SITE (436)..(436): Xaa at position 436 is Leu, Ala, Val, Gly, or Ile
  SITE (442)..(442): Xaa at position 442 is Leu, Ala, Val, Gly, or Ile
  SITE (452)..(452): Xaa at position 452 is Leu, Ala, Val, Gly, or Ile
  SITE (454)..(454): Xaa at position 454 is Val, Ala, Gly, Leu, or Ile
  SITE (456)..(456): Xaa at position 456 is Val, Ala, Gly, Leu, or Ile
  SITE (471)..(471): Xaa at position 471 is Ala, Gly, or Pro
  SITE (473)..(473): Xaa at position 473 is Val, Ala, Gly, Leu, or Ile
  SITE (475)..(475): Xaa at position 475 is Val, Ala, Gly, Leu, or Ile
  SITE (508)..(508): Xaa at position 508 is Tyr, Phe, Met, His, Ile, Leu, Val Ala, or Gly
  SITE (542)..(542): Xaa at position 542 is Ile, Ala, Val, Leu, or Gly
  SITE (548)..(548): Xaa at position 548 is Leu, Ala, Val, Gly, or Ile
  SITE (561)..(561): Xaa at position 561 is Tyr, Phe, Met, His, Ile, Leu, Val Ala, or Gly
  SITE (563)..(563): Xaa at position 563 is Ala, Gly, or Pro
  SITE (565)..(565): Xaa at position 565 is Ile, Ala, Val, Leu, or Gly
  SITE (567)..(567): Xaa at position 567 is Ala, Gly, or Pro
  SITE (581)..(581): Xaa at position 581 is Leu, Ala, Val, Gly, or Ile
  SITE (583)..(583): Xaa at position 583 is Leu, Ala, Val, Gly, or Ile
  SITE (600)..(600): Xaa at position 600 is Ile, Ala, Val, Leu, or Gly
  SITE (612)..(612): Xaa at position 612 is Ile, Ala, Val, Leu, or Gly
  SITE (650)..(650): Xaa at position 650 is Ile, Ala, Val, Leu, or Gly
  SITE (652)..(652): Xaa at position 652 is Leu, Ala, Val, Gly, or Ile
  SITE (665)..(665): Xaa at position 665 is Ile, Ala, Val, Leu, or Gly
  SITE (667)..(667): Xaa at position 667 is Leu, Ala, Val, Gly, or Ile
  SITE (669)..(669): Xaa at position 669 is Leu, Ala, Val, Gly, or Ile
  SITE (670)..(670): Xaa at position 670 is Met, Ile, Leu, Val, Ala, or Gly
  SITE (681)..(681): Xaa at position 681 is Leu, Ala, Val, Gly, or Ile
  SITE (683)..(683): Xaa at position 683 is Val, Ala, Gly, Leu, or Ile
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISXPENEKGPFPKNLVQXKSNKDKEGKXFYSITGQGADTPPVGXXIIERETGWXKXTEPXDRERIATXTXFSHXVSSNGNAVEDPXEXLXTXTDQNDNKPEXTQEVFKGSXMEGALPGTSVMEXTATDADDDVNTYNAAIXYTILSQDPELPDKNXFTINRNTGVXSXVTTGLDRESFPTXTXXXQXXDLQGEGLSTTXTXVXTXTDTNDNPPIFNPTTYKGQVPENEANVVITTXKVTDADAPNTPAWEAVYTILNDDGGQFVVTTNPVNNDGIXKTAKGXDFEAKQQYIXHXAXTNVVPFEVSLTTSTXTXTXDVLDVNEAPIFVPPEKRVEVSEDFGVGQEITSXTAQEPDTFMEQKITYRIWRDTANWLEINPDTGAXSTRAEXDREDFEHVKNSTXTXLXIXTDNGSPVATGTGTXLXILSDVNDNAPIPEPRTXFFCERNPKPQVXNIIDADLPPNTSPFTAELTHGASANWTIQYNDPTQESXIXKPKMALEVGDYKXNXKXXDNQNKDQVTTXEXSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 302 - protein, 493 aa, Homo sapiens
  SITE (18)..(18): Xaa at position 18 is Val, Ala, Gly, Leu, or Ile
  SITE (22)..(22): Xaa at position 22 is Leu, Ala, Val, Gly, or Ile
  SITE (23)..(23): Xaa at position 23 is Phe, Tyr, Met, His, Ile, Leu, Val Ala, or Gly
  SITE (30)..(30): Xaa at position 30 is Leu, Ala, Val, Gly, or Ile
  SITE (31)..(31): Xaa at position 31 is Cys, Ala, Val, Gly, Ser, or Thr
  SITE (34)..(34): Xaa at position 34 is Leu, Ala, Val, Gly, or Ile
  SITE (45)..(45): Xaa at position 45 is Ile, Ala, Val, Leu, or Gly
  SITE (46)..(46): Xaa at position 46 is Val, Ala, Gly, Leu, or Ile
  SITE (47)..(47): Xaa at position 47 is Val, Ala, Gly, Leu, or Ile
  SITE (71)..(71): Xaa at position 71 is Phe, Tyr, Met, His, Ile, Leu, Val Ala, or Gly
  SITE (72)..(72): Xaa at position 72 is His, Phe, Tyr, Lys, Arg, Gly, Ser Thr, Ala, Val, Leu, Ile, Asn, Met, or Gln
  SITE (73)..(73): Xaa at position 73 is Trp, Tyr, Phe, Met, His, Ile, Leu Val, Ala, or Gly
  SITE (74)..(74): Xaa at position 74 is Ala, Gly, or Pro
  SITE (75)..(75): Xaa at position 75 is Phe, Tyr, Met, His, Ile, Leu, Val Ala, or Gly
  SITE (77)..(77): Xaa at position 77 is Val, Ala, Gly, Leu, or Ile
  SITE (82)..(82): Xaa at position 82 is Cys, Ala, Val, Gly, Ser, or Thr
  SITE (85)..(85): Xaa at position 85 is Val, Ala, Gly, Leu, or Ile
  SITE (86)..(86): Xaa at position 86 is Ile, Ala, Val, Leu, or Gly
  SITE (88)..(88): Xaa at position 88 is Val, Ala, Gly, Leu, or Ile
  SITE (95)..(95): Xaa at position 95 is Leu, Ala, Val, Gly, or Ile
  SITE (96)..(96): Xaa at position 96 is Phe, Tyr, Met, His, Ile, Leu, Val Ala, or Gly
  SITE (97)..(97): Xaa at position 97 is Val, Ala, Gly, Leu, or Ile
  SITE (136)..(136): Xaa at position 136 is Leu, Ala, Val, Gly, or Ile
  SITE (144)..(144): Xaa at position 144 is Leu, Ala, Val, Gly, or Ile
  SITE (145)..(145): Xaa at position 145 is Leu, Ala, Val, Gly, or Ile
  SITE (176)..(176): Xaa at position 176 is Leu, Ala, Val, Gly, or Ile
  SITE (180)..(180): Xaa at position 180 is Ile, Ala, Val, Leu, or Gly
  SITE (185)..(185): Xaa at position 185 is Val, Ala, Gly, Leu, or Ile
  SITE (194)..(194): Xaa at position 194 is Val, Ala, Gly, Leu, or Ile
  SITE (195)..(195): Xaa at position 195 is Leu, Ala, Val, Gly, or Ile
  SITE (205)..(205): Xaa at position 205 is Ala, Gly, or Pro
  SITE (206)..(206): Xaa at position 206 is His, Phe, Tyr, Lys, Arg, Gly, Ser Thr, Ala, Val, Leu, Ile, Asn, Met, or Gln
  SITE (209)..(209): Xaa at position 209 is Val, Ala, Gly, Leu, or Ile
  SITE (210)..(210): Xaa at position 210 is Met, Ile, Leu, Val, Ala, or Gly
  SITE (222)..(222): Xaa at position 222 is Leu, Ala, Val, Gly, or Ile
  SITE (226)..(226): Xaa at position 226 is Phe, Tyr, Met, His, Ile, Leu, Val Ala, or Gly
  SITE (243)..(243): Xaa at position 243 is Cys, Ala, Val, Gly, Ser, or Thr
  SITE (245)..(245): Xaa at position 245 is Cys, Ala, Val, Gly, Ser, or Thr
  SITE (267)..(267): Xaa at position 267 is Ile, Ala, Val, Leu, or Gly
  SITE (272)..(272): Xaa at position 272 is Met, Ile, Leu, Val, Ala, or Gly
  SITE (273)..(273): Xaa at position 273 is Cys, Ala, Val, Gly, Ser, or Thr
  SITE (275)..(275): Xaa at position 275 is Phe, Tyr, Met, His, Ile, Leu, Val Ala, or Gly
  SITE (277)..(277): Xaa at position 277 is Met, Ile, Leu, Val, Ala, or Gly
  SITE (281)..(281): Xaa at position 281 is Tyr, Phe, Met, His, Ile, Leu, Val Ala, or Gly
  SITE (284)..(284): Xaa at position 284 is Phe, Tyr, Met, His, Ile, Leu, Val Ala, or Gly
  SITE (285)..(285): Xaa at position 285 is Ala, Gly, or Pro
  SITE (288)..(288): Xaa at position 288 is Ile, Ala, Val, Leu, or Gly
  SITE (292)..(292): Xaa at position 292 is Phe, Tyr, Met, His, Ile, Leu, Val Ala, or Gly
  SITE (305)..(305): Xaa at position 305 is Val, Ala, Gly, Leu, or Ile
  SITE (306)..(306): Xaa at position 306 is Tyr, Phe, Met, His, Ile, Leu, Val Ala, or Gly
  SITE (308)..(308): Xaa at position 308 is Ala, Gly, or Pro
  SITE (309)..(309): Xaa at position 309 is Val, Ala, Gly, Leu, or Ile
  SITE (316)..(316): Xaa at position 316 is Val, Ala, Gly, Leu, or Ile
  SITE (326)..(326): Xaa at position 326 is Trp, Tyr, Phe, Met, His, Ile, Leu Val, Ala, or Gly
  SITE (330)..(330): Xaa at position 330 is His, Phe, Tyr, Lys, Arg, Gly, Ser Thr, Ala, Val, Leu, Ile, Asn, Met, or Gln
  SITE (333)..(333): Xaa at position 333 is Ala, Gly, or Pro
  SITE (338)..(338): Xaa at position 338 is Leu, Ala, Val, Gly, or Ile
  SITE (341)..(341): Xaa at position 341 is Leu, Ala, Val, Gly, or Ile
  SITE (346)..(346): Xaa at position 346 is Ile, Ala, Val, Leu, or Gly
  SITE (354)..(354): Xaa at position 354 is Met, Ile, Leu, Val, Ala, or Gly
  SITE (359)..(359): Xaa at position 359 is Leu, Ala, Val, Gly, or Ile
  SITE (363)..(363): Xaa at position 363 is Phe, Tyr, Met, His, Ile, Leu, Val Ala, or Gly
  SITE (364)..(364): Xaa at position 364 is Met, Ile, Leu, Val, Ala, or Gly
  SITE (368)..(368): Xaa at position 368 is Leu, Ala, Val, Gly, or Ile
  SITE (372)..(372): Xaa at position 372 is Leu, Ala, Val, Gly, or Ile
  SITE (394)..(394): Xaa at position 394 is Leu, Ala, Val, Gly, or Ile
  SITE (397)..(397): Xaa at position 397 is Leu, Ala, Val, Gly, or Ile
  SITE (403)..(403): Xaa at position 403 is Leu, Ala, Val, Gly, or Ile
  SITE (407)..(407): Xaa at position 407 is Met, Ile, Leu, Val, Ala, or Gly
  SITE (408)..(408): Xaa at position 408 is Val, Ala, Gly, Leu, or Ile
  SITE (409)..(409): Xaa at position 409 is Leu, Ala, Val, Gly, or Ile
  SITE (411)..(411): Xaa at position 411 is Val, Ala, Gly, Leu, or Ile
  SITE (415)..(415): Xaa at position 415 is Ile, Ala, Val, Leu, or Gly
  SITE (416)..(416): Xaa at position 416 is Tyr, Phe, Met, His, Ile, Leu, Val Ala, or Gly
  SITE (422)..(422): Xaa at position 422 is Leu, Ala, Val, Gly, or Ile
  SITE (425)..(425): Xaa at position 425 is Ala, Gly, or Pro
  SITE (443)..(443): Xaa at position 443 is Phe, Tyr, Met, His, Ile, Leu, Val Ala, or Gly
  SITE (449)..(449): Xaa at position 449 is Val, Ala, Gly, Leu, or Ile
  SITE (451)..(451): Xaa at position 451 is Ile, Ala, Val, Leu, or Gly
  SITE (455)..(455): Xaa at position 455 is Val, Ala, Gly, Leu, or Ile
  SITE (475)..(475): Xaa at position 475 is Ile, Ala, Val, Leu, or Gly
MAAATGPSFWLGNETLKXPLAXXALNRQRXXERXRKNPAVQAGSXXXLQGGEETQRYCTDTGVLFRQESFXXXXXGXTEPGXYGXXDXDTGKSTXXXPRLPASHATWMGKIHSKEHFKEKYAVDDVQYVDEIASVXTSQKPSVXXTLRGVNTDSGSVCREASFDGISKFEVNNTIXHPEXVECRXFKTDMELEXXRYTNKISSEXXREXXKAVKVGMKEYEXESLXEHYCYSRGGMRHSSYTXIXGSGENSAVLHYGHAGAPNDRTXQNGDXXLXDXGGEXYCXXSDXTCSXPANGKFTADQKAXXEXXLRSSRAXMGAMKPGVWXPDMXRLXDRIHXEEXAHMGXLSGSVDAXVQAHXGAVXXPHGXGHFXGIDVHDVGGYPEGVERIDEPGXRSXRTARHXQPGXXXTXEPGXXFIDHLXDEXLADPARASFLNREVLQRXRGFGGXRXEEDXVVTDSGIELLTCVPRTVEEXEACMAGCDKAFTPFSGPK

SEQ ID NO: 303 - protein, 566 aa, Influenza A virus
  strain A/Gull/Maryland/704/1977 H13N6
  SITE (21)..(21): Xaa at position 21 is Ile, Ala, Val, Leu, or Gly
  SITE (22)..(22): Xaa at position 22 is Cys, Ala, Val, Gly, Ser, or Thr
  SITE (23)..(23): Xaa at position 23 is Val, Ala, Gly, Leu, or Ile
  SITE (34)..(34): Xaa at position 34 is Val, Ala, Gly, Leu, or Ile
  SITE (44)..(44): Xaa at position 44 is Val, Ala, Gly, Leu, or Ile
  SITE (51)..(51): Xaa at position 51 is Ile, Ala, Val, Leu, or Gly
  SITE (59)..(59): Xaa at position 59 is Tyr, Phe, Met, His, Ile, Leu, Val Ala, or Gly
  SITE (60)..(60): Xaa at position 60 is Cys, Ala, Val, Gly, Ser, or Thr
  SITE (70)..(70): Xaa at position 70 is Leu, Ala, Val, Gly, or Ile
  SITE (75)..(75): Xaa at position 75 is Phe, Tyr, Met, His, Ile, Leu, Val Ala, or Gly
  SITE (79)..(79): Xaa at position 79 is Ile, Ala, Val, Leu, or Gly
  SITE (80)..(80): Xaa at position 80 is Val, Ala, Gly, Leu, or Ile
  SITE (96)..(96): Xaa at position 96 is Tyr, Phe, Met, His, Ile, Leu, Val Ala, or Gly
  SITE (97)..(97): Xaa at position 97 is Leu, Ala, Val, Gly, or Ile
  SITE (119)..(119): Xaa at position 119 is Leu, Ala, Val, Gly, or Ile
  SITE (122)..(122): Xaa at position 122 is Leu, Ala, Val, Gly, or Ile
  SITE (123)..(123): Xaa at position 123 is Phe, Tyr, Met, His, Ile, Leu, Val Ala, or Gly
  SITE (126)..(126): Xaa at position 126 is Ile, Ala, Val, Leu, or Gly
  SITE (129)..(129): Xaa at position 129 is Phe, Tyr, Met, His, Ile, Leu, Val Ala, or Gly
  SITE (135)..(135): Xaa at position 135 is Ile, Ala, Val, Leu, or Gly
  SITE (151)..(151): Xaa at position 151 is Cys, Ala, Val, Gly, Ser, or Thr
  SITE (167)..(167): Xaa at position 167 is Phe, Tyr, Met, His, Ile, Leu, Val Ala, or Gly
  SITE (177)..(177): Xaa at position 177 is Ile, Ala, Val, Leu, or Gly
  SITE (189)..(189): Xaa at position 189 is Val, Ala, Gly, Leu, or Ile
  SITE (190)..(190): Xaa at position 190 is Leu, Ala, Val, Gly, or Ile
  SITE (191)..(191): Xaa at position 191 is Val, Ala, Gly, Leu, or Ile
  SITE (192)..(192): Xaa at position 192 is Leu, Ala, Val, Gly, or Ile
  SITE (195)..(195): Xaa at position 195 is Ile, Ala, Val, Leu, or Gly
  SITE (208)..(208): Xaa at position 208 is Tyr, Phe, Met, His, Ile, Leu, Val Ala, or Gly
  SITE (217)..(217): Xaa at position 217 is Val, Ala, Gly, Leu, or Ile
  SITE (243)..(243): Xaa at position 243 is Met, Ile, Leu, Val, Ala, or Gly
  SITE (245)..(245): Xaa at position 245 is Ile, Ala, Val, Leu, or Gly
  SITE (250)..(250): Xaa at position 250 is Ile, Ala, Val, Leu, or Gly
  SITE (256)..(256): Xaa at position 256 is Ile, Ala, Val, Leu, or Gly
  SITE (258)..(258): Xaa at position 258 is Phe, Tyr, Met, His, Ile, Leu, Val Ala, or Gly
  SITE (264)..(264): Xaa at position 264 is Phe, Tyr, Met, His, Ile, Leu, Val Ala, or Gly
  SITE (265)..(265): Xaa at position 265 is Leu, Ala, Val, Gly, or Ile
  SITE (266)..(266): Xaa at position 266 is Ala, Gly, or Pro
  SITE (271)..(271): Xaa at position 271 is Tyr, Phe, Met, His, Ile, Leu, Val Ala, or Gly
  SITE (273)..(273): Xaa at position 273 is Ile, Ala, Val, Leu, or Gly
  SITE (282)..(282): Xaa at position 282 is Phe, Tyr, Met, His, Ile, Leu, Val Ala, or Gly
  SITE (295)..(295): Xaa at position 295 is Cys, Ala, Val, Gly, Ser, or Thr
  SITE (302)..(302): Xaa at position 302 is Ile, Ala, Val, Leu, or Gly
  SITE (328)..(328): Xaa at position 328 is Leu, Ala, Val, Gly, or Ile
  SITE (348)..(348): Xaa at position 348 is Ala, Gly, or Pro
  SITE (365)..(365): Xaa at position 365 is Tyr, Phe, Met, His, Ile, Leu, Val Ala, or Gly
  SITE (387)..(387): Xaa at position 387 is Ala, Gly, or Pro
  SITE (461)..(461): Xaa at position 461 is Leu, Ala, Val, Gly, or Ile
  SITE (469)..(469): Xaa at position 469 is Leu, Ala, Val, Gly, or Ile
  SITE (485)..(485): Xaa at position 485 is His, Phe, Tyr, Lys, Arg, Gly, Ser Thr, Ala, Val, Leu, Ile, Asn, Met, or Gln
  SITE (487)..(487): Xaa at position 487 is Cys, Ala, Val, Gly, Ser, or Thr
  SITE (491)..(491): Xaa at position 491 is Cys, Ala, Val, Gly, Ser, or Thr
MALNVIATLTLISVCVHADRXXXGYLSTNSSERXDTLLENGVPXTSSIDLXETNHTGTXXSLNGVSPVHXGDCSXEGWXXGNPACTSNFGIREWSXXIEDPAAPHGLCYPGELNNNGEXRHXXSGXRSXSRTELXPPTSWGEVLDGTTSAXRDNTGTNSFYRNLVWXIKKNNRYPVXSKTYNNTTGRDXXXXWGXHHPVSVDETKTLXVNSDPYTLXSTKSWSEKYKLETGVRPGYNGQRSWXKXYWSLXHPGEMXTXESNGGXXXPRYGXIXEEYGKGRIXQSRIRMSRCNTKXQTSVGGXNTNRTFQNIDKNALGDCPKYIKSGQXKLATGLRNVPAISNRGLFGXIAGFIEGGWPGLINGWXGFQHQNEQGTGIAADKESTQKXIDQITTKINNIIDKMNGNYDSIRGEFNQVEKRINMLADRIDDAVTDIWSYNAKLLVLLENDKTLDMHDANVKNXHEQVRREXKDNAIDEGNGCFELLXKXNDSXMETIRNGTYDHTEYAEESKLKRQEIDGIKLKSEDNVYKALSIYSCIASSVVLVGLILSFIMWACSSGNCRFNVCI

SEQ ID NO: 304 - protein, 206 aa, Homo sapiens
  SITE (37)..(37): Xaa at position 37 is Val, Ala, Gly, Leu, or Ile
  SITE (39)..(39): Xaa at position 39 is Cys, Ala, Val, Gly, Ser, or Thr
  SITE (60)..(60): Xaa at position 60 is Leu, Ala, Val, Gly, or Ile
  SITE (62)..(62): Xaa at position 62 is Leu, Ala, Val, Gly, or Ile
  SITE (67)..(67): Xaa at position 67 is Leu, Ala, Val, Gly, or Ile
  SITE (69)..(69): Xaa at position 69 is Ala, Gly, or Pro
  SITE (70)..(70): Xaa at position 70 is Leu, Ala, Val, Gly, or Ile
  SITE (91)..(91): Xaa at position 91 is Trp, Tyr, Phe, Met, His, Ile, Leu Val, Ala, or Gly
  SITE (93)..(93): Xaa at position 93 is Cys, Ala, Val, Gly, Ser, or Thr
  SITE (97)..(97): Xaa at position 97 is Leu, Ala, Val, Gly, or Ile
  SITE (100)..(100): Xaa at position 100 is Leu, Ala, Val, Gly, or Ile
  SITE (104)..(104): Xaa at position 104 is Leu, Ala, Val, Gly, or Ile
  SITE (116)..(116): Xaa at position 116 is Leu, Ala, Val, Gly, or Ile
  SITE (118)..(118): Xaa at position 118 is Cys, Ala, Val, Gly, Ser, or Thr
  SITE (128)..(128): Xaa at position 128 is Leu, Ala, Val, Gly, or Ile
  SITE (129)..(129): Xaa at position 129 is Leu, Ala, Val, Gly, or Ile
  SITE (137)..(137): Xaa at position 137 is Leu, Ala, Val, Gly, or Ile
MGSGPRGALSLLLLLLAPPSRPAAGCPAPCSCAGTLXDXGRRGLTWASLPTAFPVDTTEXVXTGNNXTXXPPGLLDALPALRTAHLGANPXRXDCRXVPXRAWXAGRPERAPYRDXRXVAPPALRGRXXPYLAEDEXRAACAPGPLCWGALAAQLALLGLGLLHALLLVLLLCRLRRLRARARARAAARLSLTDPLVAERAGTDES

SEQ ID NO: 305 - protein, 99 aa, Homo sapiens
  SITE (34)..(34): Xaa at position 34 is Cys, Ala, Val, Gly, Ser, or Thr
  SITE (35)..(35): Xaa at position 35 is Cys, Ala, Val, Gly, Ser, or Thr
  SITE (59)..(59): Xaa at position 59 is Cys, Ala, Val, Gly, Ser, or Thr
  SITE (63)..(63): Xaa at position 63 is Ala, Gly, or Pro
  SITE (64)..(64): Xaa at position 64 is Val, Ala, Gly, Leu, or Ile
  SITE (65)..(65): Xaa at position 65 is Ile, Ala, Val, Leu, or Gly
  SITE (66)..(66): Xaa at position 66 is Phe, Tyr, Met, His, Ile, Leu, Val Ala, or Gly
  SITE (74)..(74): Xaa at position 74 is Ile, Ala, Val, Leu, or Gly
  SITE (76)..(76): Xaa at position 76 is Ala, Gly, or Pro
  SITE (83)..(83): Xaa at position 83 is Val, Ala, Gly, Leu, or Ile
MKVSAALLCLLLIAATFIPQGLAQPDAINAPVTXXYNFTNRKISVQRLASYRRITSSKXPKEXXXXKTIVAKEXCXDPKQKWXQDSMDHLDKQTQTPKT

SEQ ID NO: 306 - protein, 1480 aa, Homo sapiens
  SITE (1240)..(1240): Xaa at position 1240 is Val, Ala, Gly, Leu, or Ile
  SITE (1242)..(1242): Xaa at position 1242 is Leu, Ala, Val, Gly, or Ile
  SITE (1253)..(1253): Xaa at position 1253 is Leu, Ala, Val, Gly, or Ile
  SITE (1257)..(1257): Xaa at position 1257 is Phe, Tyr, Met, His, Ile, Leu Val, Ala, or Gly
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRXGXLGRTGSGKSTXLSAXLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 307 - protein, 1032 aa, Homo sapiens
  SITE (44)..(44): Xaa at position 44 is Tyr, Phe, Met, His, Ile, Leu, Val Ala, or Gly
  SITE (52)..(52): Xaa at position 52 is Phe, Tyr, Met, His, Ile, Leu, Val Ala, or Gly
  SITE (59)..(59): Xaa at position 59 is His, Phe, Tyr, Lys, Arg, Gly, Ser Thr, Ala, Val, Leu, Ile, Asn, Met, or Gln
  SITE (67)..(67): Xaa at position 67 is Leu, Ala, Val, Gly, or Ile
  SITE (69)..(69): Xaa at position 69 is Val, Ala, Gly, Leu, or Ile
  SITE (71)..(71): Xaa at position 71 is Ala, Gly, or Pro
  SITE (74)..(74): Xaa at position 74 is Ala, Gly, or Pro
  SITE (87)..(87): Xaa at position 87 is Ala, Gly, or Pro
  SITE (91)..(91): Xaa at position 91 is Cys, Ala, Val, Gly, Ser, or Thr
  SITE (106)..(106): Xaa at position 106 is Leu, Ala, Val, Gly, or Ile
  SITE (142)..(142): Xaa at position 142 is Val, Ala, Gly, Leu, or Ile
  SITE (144)..(144): Xaa at position 144 is Cys, Ala, Val, Gly, Ser, or Thr
  SITE (160)..(160): Xaa at position 160 is Leu, Ala, Val, Gly, or Ile
  SITE (165)..(165): Xaa at position 165 is Cys, Ala, Val, Gly, Ser, or Thr
  SITE (196)..(196): Xaa at position 196 is Ala, Gly, or Pro
  SITE (198)..(198): Xaa at position 198 is Cys, Ala, Val, Gly, Ser, or Thr
  SITE (200)..(200): Xaa at position 200 is Ala, Gly, or Pro
  SITE (212)..(212): Xaa at position 212 is Val, Ala, Gly, Leu, or Ile
  SITE (213)..(213): Xaa at position 213 is Met, Ile, Leu, Val, Ala, or Gly
  SITE (215)..(215): Xaa at position 215 is Ala, Gly, or Pro
  SITE (225)..(225): Xaa at position 225 is Leu, Ala, Val, Gly, or Ile
  SITE (227)..(227): Xaa at position 227 is Val, Ala, Gly, Leu, or Ile
  SITE (245)..(245): Xaa at position 245 is Val, Ala, Gly, Leu, or Ile
  SITE (251)..(251): Xaa at position 251 is Leu, Ala, Val, Gly, or Ile
  SITE (260)..(260): Xaa at position 260 is Phe, Tyr, Met, His, Ile, Leu, Val Ala, or Gly
  SITE (268)..(268): Xaa at position 268 is Val, Ala, Gly, Leu, or Ile
  SITE (269)..(269): Xaa at position 269 is Val, Ala, Gly, Leu, or Ile
  SITE (272)..(272): Xaa at position 272 is Ala, Gly, or Pro
  SITE (275)..(275): Xaa at position 275 is His, Phe, Tyr, Lys, Arg, Gly, Ser Thr, Ala, Val, Leu, Ile, Asn, Met, or Gln
  SITE (281)..(281): Xaa at position 281 is Ala, Gly, or Pro
  SITE (282)..(282): Xaa at position 282 is Tyr, Phe, Met, His, Ile, Leu, Val Ala, or Gly
  SITE (283)..(283): Xaa at position 283 is Ile, Ala, Val, Leu, or Gly
  SITE (284)..(284): Xaa at position 284 is Phe, Tyr, Met, His, Ile, Leu, Val Ala, or Gly
  SITE (291)..(291): Xaa at position 291 is Leu, Ala, Val, Gly, or Ile
  SITE (306)..(306): Xaa at position 306 is Phe, Tyr, Met, His, Ile, Leu, Val Ala, or Gly
  SITE (313)..(313): Xaa at position 313 is Val, Ala, Gly, Leu, or Ile
  SITE (315)..(315): Xaa at position 315 is Leu, Ala, Val, Gly, or Ile
  SITE (323)..(323): Xaa at position 323 is Leu, Ala, Val, Gly, or Ile
  SITE (324)..(324): Xaa at position 324 is Leu, Ala, Val, Gly, or Ile
  SITE (325)..(325): Xaa at position 325 is Val, Ala, Gly, Leu, or Ile
  SITE (327)..(327): Xaa at position 327 is Ala, Gly, or Pro
  SITE (339)..(339): Xaa at position 339 is Val, Ala, Gly, Leu, or Ile
  SITE (341)..(341): Xaa at position 341 is Val, Ala, Gly, Leu, or Ile
  SITE (349)..(349): Xaa at position 349 is Ala, Gly, or Pro
  SITE (366)..(366): Xaa at position 366 is Ala, Gly, or Pro
  SITE (368)..(368): Xaa at position 368 is Phe, Tyr, Met, His, Ile, Leu, Val Ala, or Gly
  SITE (375)..(375): Xaa at position 375 is Leu, Ala, Val, Gly, or Ile
  SITE (378)..(378): Xaa at position 378 is Ile, Ala, Val, Leu, or Gly
  SITE (386)..(386): Xaa at position 386 is Val, Ala, Gly, Leu, or Ile
  SITE (387)..(387): Xaa at position 387 is Ala, Gly, or Pro
  SITE (388)..(388): Xaa at position 388 is Ile, Ala, Val, Leu, or Gly
  SITE (390)..(390): Xaa at position 390 is Ala, Gly, or Pro
  SITE (399)..(399): Xaa at position 399 is Ala, Gly, or Pro
  SITE (400)..(400): Xaa at position 400 is Ile, Ala, Val, Leu, or Gly
  SITE (401)..(401): Xaa at position 401 is Tyr, Phe, Met, His, Ile, Leu, Val Ala, or Gly
  SITE (403)..(403): Xaa at position 403 is Tyr, Phe, Met, His, Ile, Leu, Val Ala, or Gly
  SITE (418)..(418): Xaa at position 418 is Ile, Ala, Val, Leu, or Gly
  SITE (430)..(430): Xaa at position 430 is Phe, Tyr, Met, His, Ile, Leu, Val Ala, or Gly
  SITE (445)..(445): Xaa at position 445 is Tyr, Phe, Met, His, Ile, Leu, Val Ala, or Gly
  SITE (449)..(449): Xaa at position 449 is Ala, Gly, or Pro
  SITE (450)..(450): Xaa at position 450 is Val, Ala, Gly, Leu, or Ile
  SITE (452)..(452): Xaa at position 452 is Ala, Gly, or Pro
  SITE (458)..(458): Xaa at position 458 is Ala, Gly, or Pro
  SITE (459)..(459): Xaa at position 459 is Val, Ala, Gly, Leu, or Ile
  SITE (460)..(460): Xaa at position 460 is Leu, Ala, Val, Gly, or Ile
  SITE (461)..(461): Xaa at position 461 is Leu, Ala, Val, Gly, or Ile
  SITE (466)..(466): Xaa at position 466 is Val, Ala, Gly, Leu, or Ile
  SITE (502)..(502): Xaa at position 502 is Phe, Tyr, Met, His, Ile, Leu, Val Ala, or Gly
  SITE (519)..(519): Xaa at position 519 is Met, Ile, Leu, Val, Ala, or Gly
  SITE (521)..(521): Xaa at position 521 is Leu, Ala, Val, Gly, or Ile
  SITE (535)..(535): Xaa at position 535 is Phe, Tyr, Met, His, Ile, Leu, Val Ala, or Gly
  SITE (550)..(550): Xaa at position 550 is Val, Ala, Gly, Leu, or Ile
  SITE (562)..(562): Xaa at position 562 is Ala, Gly, or Pro
  SITE (579)..(579): Xaa at position 579 is Ala, Gly, or Pro
MAWEARREPGPRRAAVRETVMLLLCLGVPTGRPYNVDTESALLXQGPHNTLXGYSVVLXSHGANRWXLXGXPTXNWLANASVINPGXIYRXRIGKNPGQTCEQLQXGSPNGEPCGKTCLEERDNQWLGVTLSRQPGENGSIXTXGHRWKNIFYIKNENKXPTGGXYGVPPDLRTELSKRIAPCYQDYVKKFGENFXSXQXGISSFYTKDLIXXGXPGSSYWTGSXFXYNITTNKYKAFLDKQNQXKFGSYXGYSVGAGHXRSQHTTEXXGGXPQXEQIGKXXXXSIDEKEXNILHEMKGKKLGSYXGASVCAXDXNADGFSDXXXGXPMQSTIREEGRXFXYINSGSGXVMNAMETNLVGSDKYAXRXGESIVNXGDXDNDGFEDXXXGXPQEDDLQGXXXIXNGRADGISSTFSQRXEGLQISKSLSMXGQSISGQIDADNNGXVDVXXGXFRSDSXXXXRTRPXVIVDASLSHPESVNRTKFDCVENGWPSVCIDLTLCXSYKGKEVPGYIVLFYNXSXDVNRKAESPPRFYXSSNGTSDVITGSIQXSSREANCRTHQXFMRKDVRDILTPIQIEXAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 308 - protein, 1013 aa, Homo sapiens
  SITE (34)..(34): Xaa at position 34 is His, Phe, Tyr, Lys, Arg, Gly, Ser Thr, Ala, Val, Leu, Ile, Asn, Met, or Gln
  SITE (36)..(36): Xaa at position 36 is Met, Ile, Leu, Val, Ala, or Gly
  SITE (41)..(41): Xaa at position 41 is Val, Ala, Gly, Leu, or Ile
  SITE (58)..(58): Xaa at position 58 is Ala, Gly, or Pro
  SITE (94)..(94): Xaa at position 94 is Leu, Ala, Val, Gly, or Ile
  SITE (98)..(98): Xaa at position 98 is Ala, Gly, or Pro
  SITE (101)..(101): Xaa at position 101 is Cys, Ala, Val, Gly, Ser, or Thr
  SITE (125)..(125): Xaa at position 125 is Val, Ala, Gly, Leu, or Ile
  SITE (130)..(130): Xaa at position 130 is Val, Ala, Gly, Leu, or Ile
  SITE (161)..(161): Xaa at position 161 is Val, Ala, Gly, Leu, or Ile
  SITE (162)..(162): Xaa at position 162 is Ile, Ala, Val, Leu, or Gly
  SITE (175)..(175): Xaa at position 175 is Val, Ala, Gly, Leu, or Ile
  SITE (176)..(176): Xaa at position 176 is Val, Ala, Gly, Leu, or Ile
  SITE (180)..(180): Xaa at position 180 is Leu, Ala, Val, Gly, or Ile
  SITE (181)..(181): Xaa at position 181 is Val, Ala, Gly, Leu, or Ile
  SITE (191)..(191): Xaa at position 191 is Ala, Gly, or Pro
  SITE (193)..(193): Xaa at position 193 is Leu, Ala, Val, Gly, or Ile
  SITE (195)..(195): Xaa at position 195 is Ile, Ala, Val, Leu, or Gly
  SITE (201)..(201): Xaa at position 201 is Cys, Ala, Val, Gly, Ser, or Thr
  SITE (203)..(203): Xaa at position 203 is Val, Ala, Gly, Leu, or Ile
  SITE (234)..(234): Xaa at position 234 is Phe, Tyr, Met, His, Ile, Leu, Val Ala, or Gly
  SITE (239)..(239): Xaa at position 239 is Cys, Ala, Val, Gly, Ser, or Thr
  SITE (244)..(244): Xaa at position 244 is Ala, Gly, or Pro
  SITE (247)..(247): Xaa at position 247 is Val, Ala, Gly, Leu, or Ile
  SITE (248)..(248): Xaa at position 248 is Val, Ala, Gly, Leu, or Ile
  SITE (264)..(264): Xaa at position 264 is Ala, Gly, or Pro
  SITE (278)..(278): Xaa at position 278 is Ile, Ala, Val, Leu, or Gly
  SITE (289)..(289): Xaa at position 289 is Ala, Gly, or Pro
  SITE (310)..(310): Xaa at position 310 is Ala, Gly, or Pro
  SITE (312)..(312): Xaa at position 312 is Ile, Ala, Val, Leu, or Gly
  SITE (313)..(313): Xaa at position 313 is Phe, Tyr, Met, His, Ile, Leu, Val Ala, or Gly
  SITE (317)..(317): Xaa at position 317 is Ile, Ala, Val, Leu, or Gly
  SITE (326)..(326): Xaa at position 326 is Leu, Ala, Val, Gly, or Ile
  SITE (332)..(332): Xaa at position 332 is Val, Ala, Gly, Leu, or Ile
  SITE (338)..(338): Xaa at position 338 is Ala, Gly, or Pro
  SITE (346)..(346): Xaa at position 346 is Cys, Ala, Val, Gly, Ser, or Thr
  SITE (354)..(354): Xaa at position 354 is Val, Ala, Gly, Leu, or Ile
  SITE (364)..(364): Xaa at position 364 is Cys, Ala, Val, Gly, Ser, or Thr
  SITE (371)..(371): Xaa at position 371 is Leu, Ala, Val, Gly, or Ile
  SITE (376)..(376): Xaa at position 376 is Met, Ile, Leu, Val, Ala, or Gly
  SITE (379)..(379): Xaa at position 379 is Ala, Gly, or Pro
  SITE (381)..(381): Xaa at position 381 is Met, Ile, Leu, Val, Ala, or Gly
  SITE (408)..(408): Xaa at position 408 is Trp, Tyr, Phe, Met, His, Ile, Leu Val, Ala, or Gly
  SITE (410)..(410): Xaa at position 410 is Ala, Gly, or Pro
  SITE (411)..(411): Xaa at position 411 is Leu, Ala, Val, Gly, or Ile
  SITE (414)..(414): Xaa at position 414 is Ile, Ala, Val, Leu, or Gly
  SITE (415)..(415): Xaa at position 415 is Ala, Gly, or Pro
  SITE (417)..(417): Xaa at position 417 is Leu, Ala, Val, Gly, or Ile
  SITE (418)..(418): Xaa at position 418 is Cys, Ala, Val, Gly, Ser, or Thr
  SITE (421)..(421): Xaa at position 421 is Ala, Gly, or Pro
  SITE (432)..(432): Xaa at position 432 is Val, Ala, Gly, Leu, or Ile
  SITE (445)..(445): Xaa at position 445 is Ala, Gly, or Pro
  SITE (446)..(446): Xaa at position 446 is Leu, Ala, Val, Gly, or Ile
  SITE (457)..(457): Xaa at position 457 is Val, Ala, Gly, Leu, or Ile
  SITE (480)..(480): Xaa at position 480 is Leu, Ala, Val, Gly, or Ile
  SITE (482)..(482): Xaa at position 482 is Ile, Ala, Val, Leu, or Gly
  SITE (483)..(483): Xaa at position 483 is His, Phe, Tyr, Lys, Arg, Gly, Ser Thr, Ala, Val, Leu, Ile, Asn, Met, or Gln
  SITE (493)..(493): Xaa at position 493 is Tyr, Phe, Met, His, Ile, Leu, Val Ala, or Gly
  SITE (494)..(494): Xaa at position 494 is Leu, Ala, Val, Gly, or Ile
  SITE (495)..(495): Xaa at position 495 is Leu, Ala, Val, Gly, or Ile
  SITE (496)..(496): Xaa at position 496 is Val, Ala, Gly, Leu, or Ile
  SITE (497)..(497): Xaa at position 497 is Met, Ile, Leu, Val, Ala, or Gly
  SITE (504)..(504): Xaa at position 504 is Ile, Ala, Val, Leu, or Gly
  SITE (512)..(512): Xaa at position 512 is Leu, Ala, Val, Gly, or Ile
  SITE (532)..(532): Xaa at position 532 is Tyr, Phe, Met, His, Ile, Leu, Val Ala, or Gly
  SITE (535)..(535): Xaa at position 535 is Leu, Ala, Val, Gly, or Ile
  SITE (545)..(545): Xaa at position 545 is Phe, Tyr, Met, His, Ile, Leu, Val Ala, or Gly
  SITE (546)..(546): Xaa at position 546 is Cys, Ala, Val, Gly, Ser, or Thr
  SITE (547)..(547): Xaa at position 547 is His, Phe, Tyr, Lys, Arg, Gly, Ser Thr, Ala, Val, Leu, Ile, Asn, Met, or Gln
  SITE (550)..(550): Xaa at position 550 is Leu, Ala, Val, Gly, or Ile
  SITE (573)..(573): Xaa at position 573 is Leu, Ala, Val, Gly, or Ile
  SITE (574)..(574): Xaa at position 574 is Cys, Ala, Val, Gly, Ser, or Thr
  SITE (575)..(575): Xaa at position 575 is Phe, Tyr, Met, His, Ile, Leu, Val Ala, or Gly
  SITE (576)..(576): Xaa at position 576 is Val, Ala, Gly, Leu, or Ile
  SITE (578)..(578): Xaa at position 578 is Leu, Ala, Val, Gly, or Ile
  SITE (581)..(581): Xaa at position 581 is Met, Ile, Leu, Val, Ala, or Gly
  SITE (587)..(587): Xaa at position 587 is Ala, Gly, or Pro
  SITE (589)..(589): Xaa at position 589 is Val, Ala, Gly, Leu, or Ile
  SITE (592)..(592): Xaa at position 592 is Ala, Gly, or Pro
  SITE (593)..(593): Xaa at position 593 is Val, Ala, Gly, Leu, or Ile
  SITE (596)..(596): Xaa at position 596 is Cys, Ala, Val, Gly, Ser, or Thr
  SITE (599)..(599): Xaa at position 599 is Ala, Gly, or Pro
  SITE (601)..(601): Xaa at position 601 is Ile, Ala, Val, Leu, or Gly
  SITE (604)..(604): Xaa at position 604 is Ile, Ala, Val, Leu, or Gly
  SITE (605)..(605): Xaa at position 605 is Met, Ile, Leu, Val, Ala, or Gly
  SITE (614)..(614): Xaa at position 614 is Ala, Gly, or Pro
  SITE (616)..(616): Xaa at position 616 is Ala, Gly, or Pro
  SITE (618)..(618): Xaa at position 618 is Ala, Gly, or Pro
  SITE (623)..(623): Xaa at position 623 is Ile, Ala, Val, Leu, or Gly
  SITE (624)..(624): Xaa at position 624 is Ile, Ala, Val, Leu, or Gly
  SITE (635)..(635): Xaa at position 635 is Ala, Gly, or Pro
  SITE (636)..(636): Xaa at position 636 is Ala, Gly, or Pro
  SITE (650)..(650): Xaa at position 650 is Ala, Gly, or Pro
  SITE (652)..(652): Xaa at position 652 is Ala, Gly, or Pro
  SITE (678)..(678): Xaa at position 678 is Ile, Ala, Val, Leu, or Gly
  SITE (679)..(679): Xaa at position 679 is Val, Ala, Gly, Leu, or Ile
  SITE (680)..(680): Xaa at position 680 is Phe, Tyr, Met, His, Ile, Leu, Val Ala, or Gly
  SITE (681)..(681): Xaa at position 681 is Ala, Gly, or Pro
  SITE (691)..(691): Xaa at position 691 is Ile, Ala, Val, Leu, or Gly
  SITE (692)..(692): Xaa at position 692 is Val, Ala, Gly, Leu, or Ile
  SITE (695)..(695): Xaa at position 695 is Cys, Ala, Val, Gly, Ser, or Thr
  SITE (702)..(702): Xaa at position 702 is Val, Ala, Gly, Leu, or Ile
  SITE (709)..(709): Xaa at position 709 is Val, Ala, Gly, Leu, or Ile
  SITE (714)..(714): Xaa at position 714 is Ala, Gly, or Pro
  SITE (715)..(715): Xaa at position 715 is Leu, Ala, Val, Gly, or Ile
  SITE (718)..(718): Xaa at position 718 is Ala, Gly, or Pro
  SITE (720)..(720): Xaa at position 720 is Ile, Ala, Val, Leu, or Gly
  SITE (722)..(722): Xaa at position 722 is Val, Ala, Gly, Leu, or Ile
  SITE (723)..(723): Xaa at position 723 is Ala, Gly, or Pro
  SITE (724)..(724): Xaa at position 724 is Met, Ile, Leu, Val, Ala, or Gly
  SITE (739)..(739): Xaa at position 739 is Ile, Ala, Val, Leu, or Gly
  SITE (740)..(740): Xaa at position 740 is Leu, Ala, Val, Gly, or Ile
  SITE (745)..(745): Xaa at position 745 is Phe, Tyr, Met, His, Ile, Leu, Val Ala, or Gly
  SITE (752)..(752): Xaa at position 752 is Val, Ala, Gly, Leu, or Ile
  SITE (757)..(757): Xaa at position 757 is Leu, Ala, Val, Gly, or Ile
  SITE (758)..(758): Xaa at position 758 is Ile, Ala, Val, Leu, or Gly
  SITE (768)..(768): Xaa at position 768 is Tyr, Phe, Met, His, Ile, Leu, Val Ala, or Gly
  SITE (770)..(770): Xaa at position 770 is Leu, Ala, Val, Gly, or Ile
  SITE (783)..(783): Xaa at position 783 is Phe, Tyr, Met, His, Ile, Leu, Val Ala, or Gly
  SITE (792)..(792): Xaa at position 792 is Leu, Ala, Val, Gly, or Ile
  SITE (800)..(800): Xaa at position 800 is Ile, Ala, Val, Leu, or Gly
  SITE (809)..(809): Xaa at position 809 is Ala, Gly, or Pro
  SITE (812)..(812): Xaa at position 812 is Leu, Ala, Val, Gly, or Ile
  SITE (834)..(834): Xaa at position 834 is Leu, Ala, Val, Gly, or Ile
  SITE (835)..(835): Xaa at position 835 is Val, Ala, Gly, Leu, or Ile
  SITE (839)..(839): Xaa at position 839 is Leu, Ala, Val, Gly, or Ile
  SITE (843)..(843): Xaa at position 843 is Ala, Gly, or Pro
  SITE (847)..(847): Xaa at position 847 is Ile, Ala, Val, Leu, or Gly
  SITE (859)..(859): Xaa at position 859 is Tyr, Phe, Met, His, Ile, Leu, Val Ala, or Gly
  SITE (862)..(862): Xaa at position 862 is Ile, Ala, Val, Leu, or Gly
  SITE (863)..(863): Xaa at position 863 is Leu, Ala, Val, Gly, or Ile
  SITE (868)..(868): Xaa at position 868 is Phe, Tyr, Met, His, Ile, Leu, Val Ala, or Gly
  SITE (873)..(873): Xaa at position 873 is Leu, Ala, Val, Gly, or Ile
  SITE (880)..(880): Xaa at position 880 is Trp, Tyr, Phe, Met, His, Ile, Leu Val, Ala, or Gly
  SITE (908)..(908): Xaa at position 908 is Cys, Ala, Val, Gly, Ser, or Thr
  SITE (911)..(911): Xaa at position 911 is Ala, Gly, or Pro
  SITE (912)..(912): Xaa at position 912 is Phe, Tyr, Met, His, Ile, Leu, Val Ala, or Gly
  SITE (913)..(913): Xaa at position 913 is Phe, Tyr, Met, His, Ile, Leu, Val Ala, or Gly
  SITE (914)..(914): Xaa at position 914 is Val, Ala, Gly, Leu, or Ile
  SITE (916)..(916): Xaa at position 916 is Ile, Ala, Val, Leu, or Gly
  SITE (917)..(917): Xaa at position 917 is Val, Ala, Gly, Leu, or Ile
  SITE (918)..(918): Xaa at position 918 is Val, Ala, Gly, Leu, or Ile
  SITE (919)..(919): Xaa at position 919 is Val, Ala, Gly, Leu, or Ile
  SITE (924)..(924): Xaa at position 924 is Leu, Ala, Val, Gly, or Ile
  SITE (926)..(926): Xaa at position 926 is Ile, Ala, Val, Leu, or Gly
  SITE (927)..(927): Xaa at position 927 is Cys, Ala, Val, Gly, Ser, or Thr
  SITE (944)..(944): Xaa at position 944 is Leu, Ala, Val, Gly, or Ile
  SITE (948)..(948): Xaa at position 948 is Leu, Ala, Val, Gly, or Ile
  SITE (955)..(955): Xaa at position 955 is Ala, Gly, or Pro
  SITE (968)..(968): Xaa at position 968 is Leu, Ala, Val, Gly, or Ile
  SITE (970)..(970): Xaa at position 970 is Met, Ile, Leu, Val, Ala, or Gly
  SITE (981)..(981): Xaa at position 981 is Ala, Gly, or Pro
  SITE (988)..(988): Xaa at position 988 is Ile, Ala, Val, Leu, or Gly
  SITE (999)..(999): Xaa at position 999 is Leu, Ala, Val, Gly, or Ile
  SITE (1013)..(1013): Xaa at position 1013 is Tyr, Phe, Met, His, Ile, Leu Val, Ala, or Gly
MGDKKDDKDSPKKNKGKERRDLDDLKKEVAMTEXKXSVEEXCRKYNTDCVQGLTHSKXQEILARDGPNALTPPPTTPEWVKFCRQLFGGFSILXWIGXILXFLAYGIQAGTEDDPSGDNLYLGIXLAAVXIITGCFSYYQEAKSSKIMESFKNMVPQQALXXREGEKMQVNAEEXXVGDXXEIKGGDRVPXDXRXISAHGXKXDNSSLTGESEPQTRSPDCTHDNPLETRNITXFSTNXVEGTXRGXXVATGDRTVMGRIATLXSGLEVGKTPIAIEXEHFIQLITGVXVFLGVSFFILSLILGYTWLEXVXXLIGXIVANVPEGXLATVTXCLTLTXKRMARKNXLVKNLEAXETLGSTSTIXSDKTGTXTQNRXTVXHXWFDNQIHEADTTEDQSGTSFDKSSHTXVXXSHXXGXXNRXVFKGGQDNIPXLKRDVAGDASESXXLKCIELSSGSXKLMRERNKKVAEIPFNSTNKYQXSXXETEDPNDNRXXXXXKGAPERXLDRCSTIXLQGKEQPLDEEMKEAFQNAXLEXGGLGERVLGXXXYYXPEEQFPKGFAFDCDDVNFTTDNXXXXGXMSXIDPPRXAXPDXXGKXRSXGXKVXXVTGDHPITXKXIXKGVGXXSEGNETVEDIXXRLNIPVSQVNPRDXKXCVIHGTDLKDFTSEQIDEILQNHTEXXXXRTSPQQKLIXXEGXQRQGAIXAVTGDGXNDSPXXKKXDXGXXXGIAGSDVSKQAADMXXLDDNXASIVTGXEEGRXXFDNLKKSIAXTXTSNIPEITPFLLXIMANIPLPXGTITILCXDLGTDMVPXISXAYEAAESDIMKRQPRNPRTDKXXNERXISMXYGQXGMIQALGGFFSXFVXXAENGXLPGNXVGIRLNXDDRTVNDLEDSYGQQWTYEQRKVVEFTXHTXXXXSXXXXQWADXIXXKTRRNSVFQQGMKNKIXIFGXFEETALXAFLSYCPGMDVAXRXYPLKPSWWFCXFPYSFLXFVYDEIRKLIXRRNPGGWVEKETYX

SEQ ID NO: 309 - protein, 330 aa, Homo sapiens
  SITE (31)..(31): Xaa at position 31 is Leu, Ala, Val, Gly, or Ile
  SITE (33)..(33): Xaa at position 33 is Tyr, Phe, Met, His, Ile, Leu, Val Ala, or Gly
  SITE (35)..(35): Xaa at position 35 is Ile, Ala, Val, Leu, or Gly
  SITE (36)..(36): Xaa at position 36 is Phe, Tyr, Met, His, Ile, Leu, Val Ala, or Gly
  SITE (37)..(37): Xaa at position 37 is Val, Ala, Gly, Leu, or Ile
  SITE (50)..(50): Xaa at position 50 is Leu, Ala, Val, Gly, or Ile
  SITE (53)..(53): Xaa at position 53 is Val, Ala, Gly, Leu, or Ile
  SITE (56)..(56): Xaa at position 56 is Tyr, Phe, Met, His, Ile, Leu, Val Ala, or Gly
  SITE (61)..(61): Xaa at position 61 is Leu, Ala, Val, Gly, or Ile
  SITE (65)..(65): Xaa at position 65 is Leu, Ala, Val, Gly, or Ile
  SITE (76)..(76): Xaa at position 76 is Val, Ala, Gly, Leu, or Ile
  SITE (77)..(77): Xaa at position 77 is Leu, Ala, Val, Gly, or Ile
  SITE (78)..(78): Xaa at position 78 is Ile, Ala, Val, Leu, or Gly
  SITE (79)..(79): Xaa at position 79 is Phe, Tyr, Met, His, Ile, Leu, Val Ala, or Gly
  SITE (81)..(81): Xaa at position 81 is Val, Ala, Gly, Leu, or Ile
  SITE (94)..(94): Xaa at position 94 is Ala, Gly, or Pro
  SITE (101)..(101): Xaa at position 101 is Ala, Gly, or Pro
  SITE (104)..(104): Xaa at position 104 is Ala, Gly, or Pro
  SITE (105)..(105): Xaa at position 105 is Ile, Ala, Val, Leu, or Gly
  SITE (108)..(108): Xaa at position 108 is Leu, Ala, Val, Gly, or Ile
  SITE (115)..(115): Xaa at position 115 is Leu, Ala, Val, Gly, or Ile
  SITE (117)..(117): Xaa at position 117 is Val, Ala, Gly, Leu, or Ile
  SITE (119)..(119): Xaa at position 119 is Cys, Ala, Val, Gly, Ser, or Thr
  SITE (121)..(121): Xaa at position 121 is Val, Ala, Gly, Leu, or Ile
  SITE (122)..(122): Xaa at position 122 is Cys, Ala, Val, Gly, Ser, or Thr
  SITE (123)..(123): Xaa at position 123 is Leu, Ala, Val, Gly, or Ile
  SITE (129)..(129): Xaa at position 129 is His, Phe, Tyr, Lys, Arg, Gly, Ser Thr, Ala, Val, Leu, Ile, Asn, Met, or Gln
  SITE (132)..(132): Xaa at position 132 is Cys, Ala, Val, Gly, Ser, or Thr
  SITE (134)..(134): Xaa at position 134 is Leu, Ala, Val, Gly, or Ile
  SITE (150)..(150): Xaa at position 150 is Leu, Ala, Val, Gly, or Ile
  SITE (151)..(151): Xaa at position 151 is Ala, Gly, or Pro
  SITE (153)..(153): Xaa at position 153 is Val, Ala, Gly, Leu, or Ile
  SITE (154)..(154): Xaa at position 154 is Ala, Gly, or Pro
  SITE (157)..(157): Xaa at position 157 is Tyr, Phe, Met, His, Ile, Leu, Val Ala, or Gly
  SITE (162)..(162): Xaa at position 162 is Cys, Ala, Val, Gly, Ser, or Thr
  SITE (164)..(164): Xaa at position 164 is Val, Ala, Gly, Leu, or Ile
  SITE (165)..(165): Xaa at position 165 is Val, Ala, Gly, Leu, or Ile
  SITE (166)..(166): Xaa at position 166 is Ala, Gly, or Pro
  SITE (170)..(170): Xaa at position 170 is Met, Ile, Leu, Val, Ala, or Gly
  SITE (171)..(171): Xaa at position 171 is Met, Ile, Leu, Val, Ala, or Gly
  SITE (175)..(175): Xaa at position 175 is Val, Ala, Gly, Leu, or Ile
  SITE (178)..(178): Xaa at position 178 is Ile, Ala, Val, Leu, or Gly
  SITE (182)..(182): Xaa at position 182 is Leu, Ala, Val, Gly, or Ile
  SITE (193)..(193): Xaa at position 193 is Val, Ala, Gly, Leu, or Ile
  SITE (194)..(194): Xaa at position 194 is Met, Ile, Leu, Val, Ala, or Gly
  SITE (196)..(196): Xaa at position 196 is Tyr, Phe, Met, His, Ile, Leu, Val Ala, or Gly
  SITE (198)..(198): Xaa at position 198 is Ala, Gly, or Pro
  SITE (200)..(200): Xaa at position 200 is Phe, Tyr, Met, His, Ile, Leu, Val Ala, or Gly
  SITE (211)..(211): Xaa at position 211 is Ala, Gly, or Pro
  SITE (212)..(212): Xaa at position 212 is Ala, Gly, or Pro
  SITE (234)..(234): Xaa at position 234 is Ala, Gly, or Pro
  SITE (238)..(238): Xaa at position 238 is Val, Ala, Gly, Leu, or Ile
  SITE (249)..(249): Xaa at position 249 is Leu, Ala, Val, Gly, or Ile
  SITE (250)..(250): Xaa at position 250 is Met, Ile, Leu, Val, Ala, or Gly
  SITE (251)..(251): Xaa at position 251 is Val, Ala, Gly, Leu, or Ile
  SITE (261)..(261): Xaa at position 261 is Val, Ala, Gly, Leu, or Ile
  SITE (264)..(264): Xaa at position 264 is Val, Ala, Gly, Leu, or Ile
  SITE (268)..(268): Xaa at position 268 is His, Phe, Tyr, Lys, Arg, Gly, Ser Thr, Ala, Val, Leu, Ile, Asn, Met, or Gln
  SITE (273)..(273): Xaa at position 273 is Leu, Ala, Val, Gly, or Ile
  SITE (274)..(274): Xaa at position 274 is Ala, Gly, or Pro
  SITE (275)..(275): Xaa at position 275 is Val, Ala, Gly, Leu, or Ile
  SITE (276)..(276): Xaa at position 276 is Tyr, Phe, Met, His, Ile, Leu, Val Ala, or Gly
  SITE (277)..(277): Xaa at position 277 is His, Phe, Tyr, Lys, Arg, Gly, Ser Thr, Ala, Val, Leu, Ile, Asn, Met, or Gln
  SITE (278)..(278): Xaa at position 278 is Val, Ala, Gly, Leu, or Ile
  SITE (282)..(282): Xaa at position 282 is Phe, Tyr, Met, His, Ile, Leu, Val Ala, or Gly
  SITE (300)..(300): Xaa at position 300 is Val, Ala, Gly, Leu, or Ile
  SITE (303)..(303): Xaa at position 303 is Ala, Gly, or Pro
  SITE (304)..(304): Xaa at position 304 is Met, Ile, Leu, Val, Ala, or Gly
  SITE (307)..(307): Xaa at position 307 is Phe, Tyr, Met, His, Ile, Leu, Val Ala, or Gly
  SITE (310)..(310): Xaa at position 310 is Ala, Gly, or Pro
  SITE (312)..(312): Xaa at position 312 is Ala, Gly, or Pro
  SITE (315)..(315): Xaa at position 315 is Ile, Ala, Val, Leu, or Gly
  SITE (316)..(316): Xaa at position 316 is Ile, Ala, Val, Leu, or Gly
  SITE (318)..(318): Xaa at position 318 is Tyr, Phe, Met, His, Ile, Leu, Val Ala, or Gly
  SITE (319)..(319): Xaa at position 319 is Tyr, Phe, Met, His, Ile, Leu, Val Ala, or Gly
  SITE (323)..(323): Xaa at position 323 is Leu, Ala, Val, Gly, or Ile
  SITE (324)..(324): Xaa at position 324 is Leu, Ala, Val, Gly, or Ile
MQPQSVLHSGYFHPLLRAWQTATTTLNASNXIXPXXXTDVPDDIQPITSXPGXARXGVKRXEEMXRPLVEEGLRCXXXXGXPSRVPKDERGSAXDSEESPXIEXXHLXRKTFPNXLXAXDXXXCPYTSXGHXGXLSENGAFRAEESRQRXXEXXLAXAKAGXQXXXPSDXXDGRXEAXKEAXMAHGLGNRVSXXSXSXKXASCFYGPFRDXXKSSPAFGDRRCYQLPPGARGLXLRAXDRDVREGADMXXXKPGMPYLDIXREXKDKXPDLPXXXXXXSGEXAMLWHGAQAGAFDLKAAXLEXXTAXRRXGXDIXXTXXTPQXXQWLKEE

SEQ ID NO: 310 - protein, 295 aa, Homo sapiens
  SITE (41)..(41): Xaa at position 41 is Ala, Gly, or Pro
  SITE (51)..(51): Xaa at position 51 is Phe, Tyr, Met, His, Ile, Leu, Val Ala, or Gly
  SITE (55)..(55): Xaa at position 55 is Leu, Ala, Val, Gly, or Ile
  SITE (66)..(66): Xaa at position 66 is Tyr, Phe, Met, His, Ile, Leu, Val Ala, or Gly
  SITE (68)..(68): Xaa at position 68 is Val, Ala, Gly, Leu, or Ile
  SITE (70)..(70): Xaa at position 70 is Ile, Ala, Val, Leu, or Gly
  SITE (89)..(89): Xaa at position 89 is Cys, Ala, Val, Gly, Ser, or Thr
  SITE (91)..(91): Xaa at position 91 is Leu, Ala, Val, Gly, or Ile
  SITE (95)..(95): Xaa at position 95 is Ile, Ala, Val, Leu, or Gly
  SITE (105)..(105): Xaa at position 105 is Ala, Gly, or Pro
  SITE (107)..(107): Xaa at position 107 is Val, Ala, Gly, Leu, or Ile
  SITE (155)..(155): Xaa at position 155 is Val, Ala, Gly, Leu, or Ile
  SITE (157)..(157): Xaa at position 157 is Val, Ala, Gly, Leu, or Ile
  SITE (159)..(159): Xaa at position 159 is Val, Ala, Gly, Leu, or Ile
  SITE (175)..(175): Xaa at position 175 is Leu, Ala, Val, Gly, or Ile
  SITE (179)..(179): Xaa at position 179 is Phe, Tyr, Met, His, Ile, Leu, Val Ala, or Gly
  SITE (183)..(183): Xaa at position 183 is Leu, Ala, Val, Gly, or Ile
  SITE (185)..(185): Xaa at position 185 is Tyr, Phe, Met, His, Ile, Leu, Val Ala, or Gly
  SITE (187)..(187): Xaa at position 187 is Leu, Ala, Val, Gly, or Ile
  SITE (188)..(188): Xaa at position 188 is Tyr, Phe, Met, His, Ile, Leu, Val Ala, or Gly
  SITE (189)..(189): Xaa at position 189 is Tyr, Phe, Met, His, Ile, Leu, Val Ala, or Gly
  SITE (207)..(207): Xaa at position 207 is Phe, Tyr, Met, His, Ile, Leu, Val Ala, or Gly
  SITE (209)..(209): Xaa at position 209 is Ile, Ala, Val, Leu, or Gly
  SITE (211)..(211): Xaa at position 211 is Val, Ala, Gly, Leu, or Ile
  SITE (219)..(219): Xaa at position 219 is Phe, Tyr, Met, His, Ile, Leu, Val Ala, or Gly
  SITE (221)..(221): Xaa at position 221 is Val, Ala, Gly, Leu, or Ile
  SITE (223)..(223): Xaa at position 223 is Ala, Gly, or Pro
  SITE (224)..(224): Xaa at position 224 is Val, Ala, Gly, Leu, or Ile
  SITE (225)..(225): Xaa at position 225 is Ile, Ala, Val, Leu, or Gly
METPAWPRVPRPETAVARTLLLGWVFAQVAGASGTTNTVAXYNLTWKSTNXKTIXEWEPKPVNQVXTXQXSTKSGDWKSKCFYTTDTEXDXTDEXVKDVKQTYLXRXFSYPAGNVESTGSAGEPLYENSPEFTPYLETNLGQPTIQSFEQVGTKXNXTXEDERTLVRRNNTFLSXRDVXGKDXIXTXXXWKSSSSGKKTAKTNTNEXLXDXDKGENYCXSXQXXXPSRTVNRKSTDSPVECMGQEKGEFREIFYIIGAVVFVVIILVIILAISLHKCRKAGVGQSWKENSPLNVS

SEQ ID NO: 311 - protein, 358 aa, Homo sapiens
  SITE (26)..(26): Xaa at position 26 is Leu, Ala, Val, Gly, or Ile
  SITE (28)..(28): Xaa at position 28 is Tyr, Phe, Met, His, Ile, Leu, Val Ala, or Gly
  SITE (30)..(30): Xaa at position 30 is His, Phe, Tyr, Lys, Arg, Gly, Ser Thr, Ala, Val, Leu, Ile, Asn, Met, or Gln
  SITE (43)..(43): Xaa at position 43 is Phe, Tyr, Met, His, Ile, Leu, Val Ala, or Gly
  SITE (49)..(49): Xaa at position 49 is Val, Ala, Gly, Leu, or Ile
  SITE (54)..(54): Xaa at position 54 is Phe, Tyr, Met, His, Ile, Leu, Val Ala, or Gly
  SITE (55)..(55): Xaa at position 55 is Val, Ala, Gly, Leu, or Ile
  SITE (57)..(57): Xaa at position 57 is Phe, Tyr, Met, His, Ile, Leu, Val Ala, or Gly
  SITE (66)..(66): Xaa at position 66 is Met, Ile, Leu, Val, Ala, or Gly
  SITE (70)..(70): Xaa at position 70 is Ala, Gly, or Pro
  SITE (72)..(72): Xaa at position 72 is Trp, Tyr, Phe, Met, His, Ile, Leu Val, Ala, or Gly
  SITE (73)..(73): Xaa at position 73 is Met, Ile, Leu, Val, Ala, or Gly
  SITE (80)..(80): Xaa at position 80 is Tyr, Phe, Met, His, Ile, Leu, Val Ala, or Gly
  SITE (88)..(88): Xaa at position 88 is Ala, Gly, or Pro
  SITE (92)..(92): Xaa at position 92 is Ala, Gly, or Pro
  SITE (95)..(95): Xaa at position 95 is Phe, Tyr, Met, His, Ile, Leu, Val Ala, or Gly
  SITE (99)..(99): Xaa at position 99 is Leu, Ala, Val, Gly, or Ile
  SITE (102)..(102): Xaa at position 102 is Leu, Ala, Val, Gly, or Ile
  SITE (116)..(116): Xaa at position 116 is Leu, Ala, Val, Gly, or Ile
  SITE (118)..(118): Xaa at position 118 is Trp, Tyr, Phe, Met, His, Ile, Leu Val, Ala, or Gly
  SITE (119)..(119): Xaa at position 119 is Met, Ile, Leu, Val, Ala, or Gly
  SITE (122)..(122): Xaa at position 122 is Cys, Ala, Val, Gly, Ser, or Thr
  SITE (124)..(124): Xaa at position 124 is Leu, Ala, Val, Gly, or Ile
  SITE (137)..(137): Xaa at position 137 is Phe, Tyr, Met, His, Ile, Leu, Val Ala, or Gly
  SITE (139)..(139): Xaa at position 139 is Tyr, Phe, Met, His, Ile, Leu, Val Ala, or Gly
  SITE (144)..(144): Xaa at position 144 is Tyr, Phe, Met, His, Ile, Leu, Val Ala, or Gly
  SITE (145)..(145): Xaa at position 145 is Leu, Ala, Val, Gly, or Ile
  SITE (147)..(147): Xaa at position 147 is Leu, Ala, Val, Gly, or Ile
  SITE (151)..(151): Xaa at position 151 is Leu, Ala, Val, Gly, or Ile
  SITE (154)..(154): Xaa at position 154 is Trp, Tyr, Phe, Met, His, Ile, Leu Val, Ala, or Gly
  SITE (160)..(160): Xaa at position 160 is Ala, Gly, or Pro
  SITE (161)..(161): Xaa at position 161 is Ala, Gly, or Pro
  SITE (174)..(174): Xaa at position 174 is Ala, Gly, or Pro
  SITE (181)..(181): Xaa at position 181 is Leu, Ala, Val, Gly, or Ile
  SITE (185)..(185): Xaa at position 185 is Cys, Ala, Val, Gly, Ser, or Thr
  SITE (186)..(186): Xaa at position 186 is Val, Ala, Gly, Leu, or Ile
  SITE (189)..(189): Xaa at position 189 is Leu, Ala, Val, Gly, or Ile
  SITE (192)..(192): Xaa at position 192 is Tyr, Phe, Met, His, Ile, Leu, Val Ala, or Gly
  SITE (193)..(193): Xaa at position 193 is Leu, Ala, Val, Gly, or Ile
  SITE (200)..(200): Xaa at position 200 is Leu, Ala, Val, Gly, or Ile
  SITE (210)..(210): Xaa at position 210 is Val, Ala, Gly, Leu, or Ile
  SITE (220)..(220): Xaa at position 220 is Ala, Gly, or Pro
  SITE (222)..(222): Xaa at position 222 is Leu, Ala, Val, Gly, or Ile
  SITE (224)..(224): Xaa at position 224 is Cys, Ala, Val, Gly, Ser, or Thr
  SITE (226)..(226): Xaa at position 226 is Ala, Gly, or Pro
  SITE (229)..(229): Xaa at position 229 is Phe, Tyr, Met, His, Ile, Leu, Val Ala, or Gly
  SITE (230)..(230): Xaa at position 230 is Tyr, Phe, Met, His, Ile, Leu, Val Ala, or Gly
  SITE (236)..(236): Xaa at position 236 is Leu, Ala, Val, Gly, or Ile
  SITE (238)..(238): Xaa at position 238 is Trp, Tyr, Phe, Met, His, Ile, Leu Val, Ala, or Gly
  SITE (245)..(245): Xaa at position 245 is His, Phe, Tyr, Lys, Arg, Gly, Ser Thr, Ala, Val, Leu, Ile, Asn, Met, or Gln
  SITE (266)..(266): Xaa at position 266 is Ala, Gly, or Pro
  SITE (267)..(267): Xaa at position 267 is Ala, Gly, or Pro
  SITE (268)..(268): Xaa at position 268 is Val, Ala, Gly, Leu, or Ile
  SITE (269)..(269): Xaa at position 269 is Val, Ala, Gly, Leu, or Ile
  SITE (270)..(270): Xaa at position 270 is Val, Ala, Gly, Leu, or Ile
  SITE (278)..(278): Xaa at position 278 is Tyr, Phe, Met, His, Ile, Leu, Val Ala, or Gly
  SITE (280)..(280): Xaa at position 280 is Cys, Ala, Val, Gly, Ser, or Thr
  SITE (282)..(282): Xaa at position 282 is Val, Ala, Gly, Leu, or Ile
  SITE (284)..(284): Xaa at position 284 is His, Phe, Tyr, Lys, Arg, Gly, Ser Thr, Ala, Val, Leu, Ile, Asn, Met, or Gln
MVDGTLLLLLSEALALTQTWAGSHSXKXFXTSVSRPGRGEPRXISVGYXDDTQXXRXDNDAASPRXVPRXPXXEQEGSEXWDRETRSXRDTXQIXRVNXRTXRGYYNQSEAGSHTXQXXHGXEXGPDRRFLRGYEQXAXDGKDXXTXNEDXRSXTAVDTXXQISEQKSNDASEXEHQRAYXEDTXXEWXHKXXEKGKETXLHLEPPKTHXTHHPISDHEXTXRXWXLGXXPAEITXTXQQDGEGXTQDTELVETRPAGDGTFQKWXXXXXPSGEEQRXTXHXQXEGLPEPVTLRWKPASQPTIPIVGIIAGLVLLGSVVSGAVVAAVIWRKKSSGGKGGSYSKAEWSDSAQGSESHSL

SEQ ID NO: 312 - protein, 273 aa, Homo sapiens
  SITE (33)..(33): Xaa at position 33 is Phe, Tyr, Met, His, Ile, Leu, Val Ala, or Gly
  SITE (34)..(34): Xaa at position 34 is Val, Ala, Gly, Leu, or Ile
  SITE (43)..(43): Xaa at position 43 is Phe, Tyr, Met, His, Ile, Leu, Val Ala, or Gly
  SITE (50)..(50): Xaa at position 50 is Val, Ala, Gly, Leu, or Ile
  SITE (52)..(52): Xaa at position 52 is Phe, Tyr, Met, His, Ile, Leu, Val Ala, or Gly
  SITE (53)..(53): Xaa at position 53 is Val, Ala, Gly, Leu, or Ile
  SITE (56)..(56): Xaa at position 56 is Phe, Tyr, Met, His, Ile, Leu, Val Ala, or Gly
  SITE (60)..(60): Xaa at position 60 is Leu, Ala, Val, Gly, or Ile
  SITE (64)..(64): Xaa at position 64 is Val, Ala, Gly, Leu, or Ile
  SITE (66)..(66): Xaa at position 66 is Phe, Tyr, Met, His, Ile, Leu, Val Ala, or Gly
  SITE (73)..(73): Xaa at position 73 is Phe, Tyr, Met, His, Ile, Leu, Val Ala, or Gly
  SITE (87)..(87): Xaa at position 87 is Trp, Tyr, Phe, Met, His, Ile, Leu Val, Ala, or Gly
  SITE (94)..(94): Xaa at position 94 is Leu, Ala, Val, Gly, or Ile
  SITE (100)..(100): Xaa at position 100 is Ala, Gly, or Pro
  SITE (105)..(105): Xaa at position 105 is Cys, Ala, Val, Gly, Ser, or Thr
  SITE (117)..(117): Xaa at position 117 is Val, Ala, Gly, Leu, or Ile
  SITE (125)..(125): Xaa at position 125 is Val, Ala, Gly, Leu, or Ile
  SITE (135)..(135): Xaa at position 135 is Leu, Ala, Val, Gly, or Ile
  SITE (140)..(140): Xaa at position 140 is Leu, Ala, Val, Gly, or Ile
  SITE (141)..(141): Xaa at position 141 is Leu, Ala, Val, Gly, or Ile
  SITE (142)..(142): Xaa at position 142 is His, Phe, Tyr, Lys, Arg, Gly, Ser Thr, Ala, Val, Leu, Ile, Asn, Met, or Gln
  SITE (143)..(143): Xaa at position 143 is Cys, Ala, Val, Gly, Ser, or Thr
  SITE (145)..(145): Xaa at position 145 is Val, Ala, Gly, Leu, or Ile
  SITE (148)..(148): Xaa at position 148 is Phe, Tyr, Met, His, Ile, Leu, Val Ala, or Gly
  SITE (157)..(157): Xaa at position 157 is Trp, Tyr, Phe, Met, His, Ile, Leu Val, Ala, or Gly
  SITE (168)..(168): Xaa at position 168 is Val, Ala, Gly, Leu, or Ile
  SITE (187)..(187): Xaa at position 187 is Leu, Ala, Val, Gly, or Ile
  SITE (196)..(196): Xaa at position 196 is Val, Ala, Gly, Leu, or Ile
  SITE (197)..(197): Xaa at position 197 is Tyr, Phe, Met, His, Ile, Leu, Val Ala, or Gly
  SITE (199)..(199): Xaa at position 199 is Cys, Ala, Val, Gly, Ser, or Thr
  SITE (201)..(201): Xaa at position 201 is Val, Ala, Gly, Leu, or Ile
  SITE (214)..(214): Xaa at position 214 is Trp, Tyr, Phe, Met, His, Ile, Leu Val, Ala, or Gly
MGSGWVPWVVALLVNLTRLDSSMTQGTDSPEDXXIQAKADCYXTNGTEKXQXXVRXIFNXEEYXRXDSDVGMXVALTKLGQPDAEQXNSRLDLXERSRQXVDGVXRHNYRLGAPFTXGRKVQPEXTVYPERTPLXHQHNXXXXSXTGXYPGDIKIKXFLNGQEERAGXMSTGPIRNGDWTFQTVVMXEMTPELGHXXTXLXDHSSLLSPVSVEXRAQSEYSWRKMLSGIAAFLLGLIFLLVGIVIQLRAQKGYVRTQMSGNEVSRAVLLPQSC

SEQ ID NO: 313 - protein, 333 aa, Homo sapiens
  SITE (23)..(23): Xaa at position 23 is Leu, Ala, Val, Gly, or Ile
  SITE (24)..(24): Xaa at position 24 is Val, Ala, Gly, Leu, or Ile
  SITE (25)..(25): Xaa at position 25 is Ile, Ala, Val, Leu, or Gly
  SITE (41)..(41): Xaa at position 41 is Ile, Ala, Val, Leu, or Gly
  SITE (43)..(43): Xaa at position 43 is Ala, Gly, or Pro
  SITE (44)..(44): Xaa at position 44 is Ala, Gly, or Pro
  SITE (51)..(51): Xaa at position 51 is Val, Ala, Gly, Leu, or Ile
  SITE (53)..(53): Xaa at position 53 is Cys, Ala, Val, Gly, Ser, or Thr
  SITE (54)..(54): Xaa at position 54 is Leu, Ala, Val, Gly, or Ile
  SITE (55)..(55): Xaa at position 55 is Val, Ala, Gly, Leu, or Ile
  SITE (60)..(60): Xaa at position 60 is Cys, Ala, Val, Gly, Ser, or Thr
  SITE (63)..(63): Xaa at position 63 is Val, Ala, Gly, Leu, or Ile
  SITE (64)..(64): Xaa at position 64 is Ala, Gly, or Pro
  SITE (67)..(67): Xaa at position 67 is Leu, Ala, Val, Gly, or Ile
  SITE (68)..(68): Xaa at position 68 is Cys, Ala, Val, Gly, Ser, or Thr
  SITE (70)..(70): Xaa at position 70 is Val, Ala, Gly, Leu, or Ile
  SITE (76)..(76): Xaa at position 76 is Val, Ala, Gly, Leu, or Ile
  SITE (79)..(79): Xaa at position 79 is Ala, Gly, or Pro
  SITE (92)..(92): Xaa at position 92 is Leu, Ala, Val, Gly, or Ile
  SITE (95)..(95): Xaa at position 95 is Leu, Ala, Val, Gly, or Ile
  SITE (96)..(96): Xaa at position 96 is Ile, Ala, Val, Leu, or Gly
  SITE (108)..(108): Xaa at position 108 is Ile, Ala, Val, Leu, or Gly
  SITE (109)..(109): Xaa at position 109 is Cys, Ala, Val, Gly, Ser, or Thr
  SITE (110)..(110): Xaa at position 110 is Ala, Gly, or Pro
  SITE (119)..(119): Xaa at position 119 is Leu, Ala, Val, Gly, or Ile
  SITE (123)..(123): Xaa at position 123 is Val, Ala, Gly, Leu, or Ile
  SITE (124)..(124): Xaa at position 124 is Ala, Gly, or Pro
  SITE (125)..(125): Xaa at position 125 is Ala, Gly, or Pro
  SITE (135)..(135): Xaa at position 135 is Ile, Ala, Val, Leu, or Gly
  SITE (144)..(144): Xaa at position 144 is Phe, Tyr, Met, His, Ile, Leu, Val Ala, or Gly
  SITE (165)..(165): Xaa at position 165 is Val, Ala, Gly, Leu, or Ile
  SITE (166)..(166): Xaa at position 166 is Phe, Tyr, Met, His, Ile, Leu, Val Ala, or Gly
  SITE (168)..(168): Xaa at position 168 is Val, Ala, Gly, Leu, or Ile
  SITE (218)..(218): Xaa at position 218 is Val, Ala, Gly, Leu, or Ile
  SITE (219)..(219): Xaa at position 219 is Val, Ala, Gly, Leu, or Ile
  SITE (225)..(225): Xaa at position 225 is Leu, Ala, Val, Gly, or Ile
  SITE (231)..(231): Xaa at position 231 is Phe, Tyr, Met, His, Ile, Leu, Val Ala, or Gly
  SITE (234)..(234): Xaa at position 234 is Leu, Ala, Val, Gly, or Ile
  SITE (237)..(237): Xaa at position 237 is Leu, Ala, Val, Gly, or Ile
  SITE (238)..(238): Xaa at position 238 is Ala, Gly, or Pro
  SITE (243)..(243): Xaa at position 243 is Ala, Gly, or Pro
  SITE (244)..(244): Xaa at position 244 is Ala, Gly, or Pro
  SITE (247)..(247): Xaa at position 247 is Ala, Gly, or Pro
  SITE (251)..(251): Xaa at position 251 is Ala, Gly, or Pro
  SITE (263)..(263): Xaa at position 263 is Val, Ala, Gly, Leu, or Ile
  SITE (270)..(270): Xaa at position 270 is Val, Ala, Gly, Leu, or Ile
  SITE (275)..(275): Xaa at position 275 is Tyr, Phe, Met, His, Ile, Leu, Val Ala, or Gly
  SITE (276)..(276): Xaa at position 276 is Ile, Ala, Val, Leu, or Gly
  SITE (277)..(277): Xaa at position 277 is Ala, Gly, or Pro
  SITE (278)..(278): Xaa at position 278 is Val, Ala, Gly, Leu, or Ile
  SITE (290)..(290): Xaa at position 290 is Met, Ile, Leu, Val, Ala, or Gly
  SITE (298)..(298): Xaa at position 298 is Ala, Gly, or Pro
  SITE (305)..(305): Xaa at position 305 is Ala, Gly, or Pro
  SITE (307)..(307): Xaa at position 307 is Ile, Ala, Val, Leu, or Gly
  SITE (323)..(323): Xaa at position 323 is Val, Ala, Gly, Leu, or Ile
MFRAAAPGQLRRAASLLRFQSTXXXAEHANDSLAPITLNTXTXXTRLGGEXSXXXAGTKXDKXXQDXXKXAGIAKXLVXQHDVYKGLLPEEXTPXXLATQKQFNYTHXXXGASAFGKNXLPRXXXKLEVAPISDXIAIKSPDTXVRTIYAGNALCTVKCDEKVKXXSXRGTSFDAAATSGGSASSEKASSTSPVEISEWLDQKLTKSDRPELTGAKVXXSGGRGXKSGENXKLXYDXXDQLHXXVGXSRAXVDAGFVPNDMQXGQTGKIXAPELXXXXGISGAIQHLAGXKDSKTIVXINKDPEXPXFQVADYGIVADLFKVXPEMTEILKKK

SEQ ID NO: 314 - protein, 737 aa, Homo sapiens
  SITE (28)..(28): Xaa at position 28 is Val, Ala, Gly, Leu, or Ile
  SITE (80)..(80): Xaa at position 80 is Leu, Ala, Val, Gly, or Ile
  SITE (102)..(102): Xaa at position 102 is Tyr, Phe, Met, His, Ile, Leu, Val Ala, or Gly
  SITE (160)..(160): Xaa at position 160 is Trp, Tyr, Phe, Met, His, Ile, Leu Val, Ala, or Gly
  SITE (165)..(165): Xaa at position 165 is Phe, Tyr, Met, His, Ile, Leu, Val Ala, or Gly
  SITE (166)..(166): Xaa at position 166 is Leu, Ala, Val, Gly, or Ile
  SITE (190)..(190): Xaa at position 190 is Leu, Ala, Val, Gly, or Ile
  SITE (202)..(202): Xaa at position 202 is Phe, Tyr, Met, His, Ile, Leu, Val Ala, or Gly
  SITE (215)..(215): Xaa at position 215 is Ala, Gly, or Pro
  SITE (247)..(247): Xaa at position 247 is Ala, Gly, or Pro
  SITE (287)..(287): Xaa at position 287 is Phe, Tyr, Met, His, Ile, Leu, Val Ala, or Gly
  SITE (291)..(291): Xaa at position 291 is His, Phe, Tyr, Lys, Arg, Gly, Ser Thr, Ala, Val, Leu, Ile, Asn, Met, or Gln
  SITE (293)..(293): Xaa at position 293 is Phe, Tyr, Met, His, Ile, Leu, Val Ala, or Gly
  SITE (307)..(307): Xaa at position 307 is Phe, Tyr, Met, His, Ile, Leu, Val Ala, or Gly
  SITE (345)..(345): Xaa at position 345 is Ala, Gly, or Pro
  SITE (456)..(456): Xaa at position 456 is Ile, Ala, Val, Leu, or Gly
  SITE (473)..(473): Xaa at position 473 is Val, Ala, Gly, Leu, or Ile
  SITE (477)..(477): Xaa at position 477 is Phe, Tyr, Met, His, Ile, Leu, Val Ala, or Gly
  SITE (482)..(482): Xaa at position 482 is Leu, Ala, Val, Gly, or Ile
  SITE (500)..(500): Xaa at position 500 is Cys, Ala, Val, Gly, Ser, or Thr
  SITE (504)..(504): Xaa at position 504 is Val, Ala, Gly, Leu, or Ile
  SITE (592)..(592): Xaa at position 592 is Leu, Ala, Val, Gly, or Ile
MPLNRTLSMSSLPGLEDWEDEFDLENAXLFEVAWEVANKVGGIYTVLQTKAKVTGDEWGDNYFLVGPYTEQGVRTQVELXEAPTPALKRTLDSMNSKGCKVXFGRWLIEGGPLVVLLDVGASAWALERWKGELWDTCNIGVPWYDREANDAVLFGFLTTXFLGEXXAQSEEKPHVVAHFHEWLAGVGLCXCRARRLPVATIXTTHATLLGRYLCXGAVDFYNNLENFNVDKEAGERQIYHRYCMERXAAHCAHVFTTVSQITAIEAQHLLKRKPDIVTPNGLNVKKXSAMXEXQNLHAQSKARIQEXVRGHFYGHLDFNLDKTLYFFIAGRYEFSNKGADVFLEXLARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPXLTTIRRIGLFNSSADRXKVIXHPEFXSSTSPLLPVDYEEFVRGXHLGXFPSYYEPWGYTPAECTVMGIPSISTNLSGFGCFMEEHIADPSAYGIYILDRRFRSLDDSCSQLTSFLYSFCQQSRRQRIIQRNRTERXSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 315 - protein, 238 aa, Homo sapiens
  SITE (107)..(107): Xaa at position 107 is Cys, Ala, Val, Gly, Ser, or Thr
  SITE (169)..(169): Xaa at position 169 is Cys, Ala, Val, Gly, Ser, or Thr
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKEXVYYCHLDIIWINTPEQTVPYGLSNYRGSFRGKRSAGPLPGNLQLSHRPHLRCACVGRYDKAXLHFCTQTLDVSSNSRTAEKTDKEEEGKVEVKDQQSKQALDLHHPKLMPGSGLALAPSTCPRCLFQEGAP

SEQ ID NO: 316 - protein, 115 aa, Homo sapiens
  SITE (2)..(2): Xaa at position 2 is Pro, Met, Leu, Ile, Val, Ala or Gly
  SITE (4)..(4): Xaa at position 4 is Phe, Tyr, Met, His, Ile, Leu, Val Ala, or Gly
  SITE (6)..(6): Xaa at position 6 is Val, Ala, Gly, Leu, or Ile
  SITE (19)..(19): Xaa at position 19 is Phe, Tyr, Met, His, Ile, Leu, Val Ala, or Gly
  SITE (23)..(23): Xaa at position 23 is Leu, Ala, Val, Gly, or Ile
  SITE (27)..(27): Xaa at position 27 is Leu, Ala, Val, Gly, or Ile
  SITE (57)..(57): Xaa at position 57 is Cys, Ala, Val, Gly, Ser, or Thr
  SITE (58)..(58): Xaa at position 58 is Ala, Gly, or Pro
  SITE (62)..(62): Xaa at position 62 is Leu, Ala, Val, Gly, or Ile
  SITE (76)..(76): Xaa at position 76 is Tyr, Phe, Met, His, Ile, Leu, Val Ala, or Gly
  SITE (79)..(79): Xaa at position 79 is Leu, Ala, Val, Gly, or Ile
  SITE (80)..(80): Xaa at position 80 is Leu, Ala, Val, Gly, or Ile
  SITE (83)..(83): Xaa at position 83 is Leu, Ala, Val, Gly, or Ile
  SITE (84)..(84): Xaa at position 84 is Leu, Ala, Val, Gly, or Ile
  SITE (88)..(88): Xaa at position 88 is Leu, Ala, Val, Gly, or Ile
  SITE (90)..(90): Xaa at position 90 is Ile, Ala, Val, Leu, or Gly
MXMXIXNTNVPRASVPDGXLSEXTQQXAQATGKPPQYIAVHVVPDQLMAFGGSSEPXXLCSXHSIGKIGGAQNRSXSKXXCGXXAERXRXSPDRVYINYYDMNAANVGWNNSTFA

SEQ ID NO: 317 - protein, 255 aa, Homo sapiens
  SITE (34)..(34): Xaa at position 34 is Ala, Gly, or Pro
  SITE (51)..(51): Xaa at position 51 is Cys, Ala, Val, Gly, Ser, or Thr
  SITE (54)..(54): Xaa at position 54 is Trp, Tyr, Phe, Met, His, Ile, Leu Val, Ala, or Gly
  SITE (58)..(58): Xaa at position 58 is Ala, Gly, or Pro
  SITE (59)..(59): Xaa at position 59 is Cys, Ala, Val, Gly, Ser, or Thr
  SITE (60)..(60): Xaa at position 60 is Cys, Ala, Val, Gly, Ser, or Thr
  SITE (86)..(86): Xaa at position 86 is Met, Ile, Leu, Val, Ala, or Gly
  SITE (90)..(90): Xaa at position 90 is Cys, Ala, Val, Gly, Ser, or Thr
  SITE (94)..(94): Xaa at position 94 is Phe, Tyr, Met, His, Ile, Leu, Val Ala, or Gly
  SITE (99)..(99): Xaa at position 99 is Cys, Ala, Val, Gly, Ser, or Thr
  SITE (100)..(100): Xaa at position 100 is Leu, Ala, Val, Gly, or Ile
  SITE (103)..(103): Xaa at position 103 is Cys, Ala, Val, Gly, Ser, or Thr
  SITE (126)..(126): Xaa at position 126 is Val, Ala, Gly, Leu, or Ile
  SITE (128)..(128): Xaa at position 128 is Leu, Ala, Val, Gly, or Ile
  SITE (129)..(129): Xaa at position 129 is Cys, Ala, Val, Gly, Ser, or Thr
  SITE (133)..(133): Xaa at position 133 is Cys, Ala, Val, Gly, Ser, or Thr
  SITE (136)..(136): Xaa at position 136 is Trp, Tyr, Phe, Met, His, Ile, Leu Val, Ala, or Gly
  SITE (140)..(140): Xaa at position 140 is Cys, Ala, Val, Gly, Ser, or Thr
  SITE (176)..(176): Xaa at position 176 is Phe, Tyr, Met, His, Ile, Leu, Val Ala, or Gly
  SITE (182)..(182): Xaa at position 182 is Leu, Ala, Val, Gly, or Ile
  SITE (183)..(183): Xaa at position 183 is Cys, Ala, Val, Gly, Ser, or Thr
  SITE (186)..(186): Xaa at position 186 is Leu, Ala, Val, Gly, or Ile
  SITE (203)..(203): Xaa at position 203 is Cys, Ala, Val, Gly, Ser, or Thr
  SITE (204)..(204): Xaa at position 204 is Ile, Ala, Val, Leu, or Gly
  SITE (206)..(206): Xaa at position 206 is Met, Ile, Leu, Val, Ala, or Gly
  SITE (219)..(219): Xaa at position 219 is Val, Ala, Gly, Leu, or Ile
  SITE (220)..(220): Xaa at position 220 is Ala, Gly, or Pro
MVWKWMPLLLLLVCVATMCSAQDRTDLLNVCMDXKHHKTKPGPEDKLHDQXSPXKKNXXXTASTSQELHKDTSRLYNFNWDHCGKXEPAXKRHXIQDTXXYEXSPNLGPWIQQVNQSWRKERFLDXPXXKEDXQRXWEDXHTSHTCKSNWHRGWDWTSGVNKCPAGALCRTFESYXPTPAAXXEGXWSHSYKVSNYSRGSGRXXQXWFDSAQGNPNEEXXRFYAAAMHVNAGEMLHGTGGLLLSLALMLQLWLLG

SEQ ID NO: 318 - protein, 728 aa, Homo sapiens
  SITE (39)..(39): Xaa at position 39 is Ile, Ala, Val, Leu, or Gly
  SITE (42)..(42): Xaa at position 42 is Phe, Tyr, Met, His, Ile, Leu, Val Ala, or Gly
  SITE (50)..(50): Xaa at position 50 is Leu, Ala, Val, Gly, or Ile
  SITE (70)..(70): Xaa at position 70 is Cys, Ala, Val, Gly, Ser, or Thr
  SITE (71)..(71): Xaa at position 71 is Ala, Gly, or Pro
  SITE (74)..(74): Xaa at position 74 is Cys, Ala, Val, Gly, Ser, or Thr
  SITE (80)..(80): Xaa at position 80 is Leu, Ala, Val, Gly, or Ile
  SITE (84)..(84): Xaa at position 84 is Cys, Ala, Val, Gly, Ser, or Thr
  SITE (86)..(86): Xaa at position 86 is Ala, Gly, or Pro
  SITE (87)..(87): Xaa at position 87 is Phe, Tyr, Met, His, Ile, Leu, Val Ala, or Gly
  SITE (88)..(88): Xaa at position 88 is Val, Ala, Gly, Leu, or Ile
  SITE (96)..(96): Xaa at position 96 is Cys, Ala, Val, Gly, Ser, or Thr
  SITE (98)..(98): Xaa at position 98 is Trp, Tyr, Phe, Met, His, Ile, Leu Val, Ala, or Gly
  SITE (99)..(99): Xaa at position 99 is Phe, Tyr, Met, His, Ile, Leu, Val Ala, or Gly
  SITE (101)..(101): Xaa at position 101 is Phe, Tyr, Met, His, Ile, Leu, Val Ala, or Gly
  SITE (112)..(112): Xaa at position 112 is Phe, Tyr, Met, His, Ile, Leu, Val Ala, or Gly
  SITE (118)..(118): Xaa at position 118 is Leu, Ala, Val, Gly, or Ile
  SITE (136)..(136): Xaa at position 136 is Tyr, Phe, Met, His, Ile, Leu, Val Ala, or Gly
  SITE (149)..(149): Xaa at position 149 is Cys, Ala, Val, Gly, Ser, or Thr
  SITE (152)..(152): Xaa at position 152 is Trp, Tyr, Phe, Met, His, Ile, Leu Val, Ala, or Gly
  SITE (172)..(172): Xaa at position 172 is Leu, Ala, Val, Gly, or Ile
  SITE (177)..(177): Xaa at position 177 is Cys, Ala, Val, Gly, Ser, or Thr
  SITE (189)..(189): Xaa at position 189 is Cys, Ala, Val, Gly, Ser, or Thr
  SITE (190)..(190): Xaa at position 190 is Phe, Tyr, Met, His, Ile, Leu, Val Ala, or Gly
  SITE (206)..(206): Xaa at position 206 is Cys, Ala, Val, Gly, Ser, or Thr
  SITE (219)..(219): Xaa at position 219 is Tyr, Phe, Met, His, Ile, Leu, Val Ala, or Gly
  SITE (232)..(232): Xaa at position 232 is Cys, Ala, Val, Gly, Ser, or Thr
  SITE (235)..(235): Xaa at position 235 is Trp, Tyr, Phe, Met, His, Ile, Leu Val, Ala, or Gly
  SITE (260)..(260): Xaa at position 260 is Cys, Ala, Val, Gly, Ser, or Thr
  SITE (270)..(270): Xaa at position 270 is Trp, Tyr, Phe, Met, His, Ile, Leu Val, Ala, or Gly
  SITE (271)..(271): Xaa at position 271 is Cys, Ala, Val, Gly, Ser, or Thr
  SITE (272)..(272): Xaa at position 272 is Tyr, Phe, Met, His, Ile, Leu, Val Ala, or Gly
  SITE (283)..(283): Xaa at position 283 is Cys, Ala, Val, Gly, Ser, or Thr
  SITE (285)..(285): Xaa at position 285 is Ile, Ala, Val, Leu, or Gly
  SITE (288)..(288): Xaa at position 288 is Cys, Ala, Val, Gly, Ser, or Thr
  SITE (313)..(313): Xaa at position 313 is Tyr, Phe, Met, His, Ile, Leu, Val Ala, or Gly
  SITE (329)..(329): Xaa at position 329 is Trp, Tyr, Phe, Met, His, Ile, Leu Val, Ala, or Gly
  SITE (354)..(354): Xaa at position 354 is Cys, Ala, Val, Gly, Ser, or Thr
  SITE (364)..(364): Xaa at position 364 is Trp, Tyr, Phe, Met, His, Ile, Leu Val, Ala, or Gly
  SITE (365)..(365): Xaa at position 365 is Cys, Ala, Val, Gly, Ser, or Thr
  SITE (366)..(366): Xaa at position 366 is Phe, Tyr, Met, His, Ile, Leu, Val Ala, or Gly
  SITE (377)..(377): Xaa at position 377 is Cys, Ala, Val, Gly, Ser, or Thr
  SITE (380)..(380): Xaa at position 380 is Ile, Ala, Val, Leu, or Gly
  SITE (383)..(383): Xaa at position 383 is Cys, Ala, Val, Gly, Ser, or Thr
  SITE (495)..(495): Xaa at position 495 is Val, Ala, Gly, Leu, or Ile
  SITE (508)..(508): Xaa at position 508 is Met, Ile, Leu, Val, Ala, or Gly
  SITE (509)..(509): Xaa at position 509 is Val, Ala, Gly, Leu, or Ile
  SITE (511)..(511): Xaa at position 511 is Leu, Ala, Val, Gly, or Ile
  SITE (519)..(519): Xaa at position 519 is Cys, Ala, Val, Gly, Ser, or Thr
  SITE (523)..(523): Xaa at position 523 is Leu, Ala, Val, Gly, or Ile
  SITE (529)..(529): Xaa at position 529 is Val, Ala, Gly, Leu, or Ile
  SITE (530)..(530): Xaa at position 530 is Leu, Ala, Val, Gly, or Ile
  SITE (532)..(532): Xaa at position 532 is Ala, Gly, or Pro
  SITE (535)..(535): Xaa at position 535 is Cys, Ala, Val, Gly, Ser, or Thr
  SITE (544)..(544): Xaa at position 544 is Tyr, Phe, Met, His, Ile, Leu, Val Ala, or Gly
  SITE (546)..(546): Xaa at position 546 is Ala, Gly, or Pro
  SITE (548)..(548): Xaa at position 548 is Leu, Ala, Val, Gly, or Ile
  SITE (550)..(550): Xaa at position 550 is Ile, Ala, Val, Leu, or Gly
  SITE (579)..(579): Xaa at position 579 is Leu, Ala, Val, Gly, or Ile
  SITE (580)..(580): Xaa at position 580 is Val, Ala, Gly, Leu, or Ile
  SITE (581)..(581): Xaa at position 581 is Leu, Ala, Val, Gly, or Ile
  SITE (582)..(582): Xaa at position 582 is Met, Ile, Leu, Val, Ala, or Gly
  SITE (584)..(584): Xaa at position 584 is Leu, Ala, Val, Gly, or Ile
  SITE (594)..(594): Xaa at position 594 is Val, Ala, Gly, Leu, or Ile
  SITE (597)..(597): Xaa at position 597 is Ile, Ala, Val, Leu, or Gly
  SITE (612)..(612): Xaa at position 612 is Cys, Ala, Val, Gly, Ser, or Thr
  SITE (614)..(614): Xaa at position 614 is Val, Ala, Gly, Leu, or Ile
  SITE (629)..(629): Xaa at position 629 is Leu, Ala, Val, Gly, or Ile
  SITE (632)..(632): Xaa at position 632 is Ala, Gly, or Pro
  SITE (634)..(634): Xaa at position 634 is Leu, Ala, Val, Gly, or Ile
  SITE (642)..(642): Xaa at position 642 is Cys, Ala, Val, Gly, Ser, or Thr
  SITE (657)..(657): Xaa at position 657 is Ile, Ala, Val, Leu, or Gly
  SITE (658)..(658): Xaa at position 658 is Cys, Ala, Val, Gly, Ser, or Thr
  SITE (659)..(659): Xaa at position 659 is Ala, Gly, or Pro
  SITE (669)..(669): Xaa at position 669 is Cys, Ala, Val, Gly, Ser, or Thr
  SITE (677)..(677): Xaa at position 677 is Leu, Ala, Val, Gly, or Ile
  SITE (679)..(679): Xaa at position 679 is Cys, Ala, Val, Gly, Ser, or Thr
  SITE (687)..(687): Xaa at position 687 is Val, Ala, Gly, Leu, or Ile
  SITE (690)..(690): Xaa at position 690 is Val, Ala, Gly, Leu, or Ile
  SITE (691)..(691): Xaa at position 691 is Ile, Ala, Val, Leu, or Gly
  SITE (706)..(706): Xaa at position 706 is Phe, Tyr, Met, His, Ile, Leu, Val Ala, or Gly
  SITE (709)..(709): Xaa at position 709 is Val, Ala, Gly, Leu, or Ile
  SITE (713)..(713): Xaa at position 713 is Ala, Gly, or Pro
  SITE (716)..(716): Xaa at position 716 is Ile, Ala, Val, Leu, or Gly
MWVTKLLPALLLQHVLLHLLLLPIAIPYAEGQRKRRNTXHEXKKSAKTTXIKIDPALKIKTKKVNTADQXXNRXTRNKGXPFTXKXXXFDKARKQXLXXPXNSMSSGVKKEXGHEFDXYENKDYIRNCIIGKGRSXKGTVSITKSGIKXQPXSSMIPHEHSFLPSSYRGKDXQENYXRNPRGEEGGPWXXTSNPEVRYEVCDIPQXSEVECMTCNGESXRGLMDHTESGKIXQRXDHQTPHRHKFLPERYPDKGFDDNYXRNPDGQPRPXXXTLDPHTRWEYXAXKTXADNTMNDTDVPLETTECIQGQGEGXRGTVNTIWNGIPCQRXDSQYPHEHDMTPENFKCKDLRENYXRNPDGSESPXXXTTDPNIRVGYXSQXPNXDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRXVNGIPTRTNIGWXXSXRYRNKHIXGGSXIKESWXXTXRQXFPSRDLKDXEXWXGXHDVHGRGDEKCKQVLNVSQLVYGPEGSDXXXXKXARPAVLDDFXSTXDLPNYGCTIPEKTSXSXYGWGYTGLINYDGLXRVXHXYIMGNEKXSQHHRGKVTLNESEXXXGAEKIGSGPXEGDYGGPXVXEQHKMRMXLGXXVPGRGCAIPNRPGIXVRXAYYXKWXHKIILTYKVPQS

SEQ ID NO: 319 - protein, 555 aa, Homo sapiens
  SITE (61)..(61): Xaa at position 61 is Val, Ala, Gly, Leu, or Ile
  SITE (249)..(249): Xaa at position 249 is Leu, Ala, Val, Gly, or Ile
  SITE (442)..(442): Xaa at position 442 is Phe, Tyr, Met, His, Ile, Leu, Val Ala, or Gly
MAARLLLLGILLLLLPLPVPAPCHTAARSECKRSHKFVPGAWLAGEGVDVTSLRRSGSFPXDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGXTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLXFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 320 - protein, 443 aa, Homo sapiens
  SITE (78)..(78): Xaa at position 78 is Val, Ala, Gly, Leu, or Ile
  SITE (189)..(189): Xaa at position 189 is Phe, Tyr, Met, His, Ile, Leu, Val Ala, or Gly
MDPLNLSWYDDDLERQNWSRPFNGSDGKADRPHYNYYATLLTLLIAVIVFGNVLVCMAVSREKALQTTTNYLIVSLAXADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAXVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 321 - protein, 509 aa, Homo sapiens
  SITE (24)..(24): Xaa at position 24 is Leu, Ala, Val, Gly, or Ile
  SITE (27)..(27): Xaa at position 27 is Ala, Gly, or Pro
  SITE (31)..(31): Xaa at position 31 is Ala, Gly, or Pro
  SITE (40)..(40): Xaa at position 40 is Tyr, Phe, Met, His, Ile, Leu, Val Ala, or Gly
  SITE (44)..(44): Xaa at position 44 is Val, Ala, Gly, Leu, or Ile
  SITE (45)..(45): Xaa at position 45 is Ile, Ala, Val, Leu, or Gly
  SITE (52)..(52): Xaa at position 52 is Ile, Ala, Val, Leu, or Gly
  SITE (56)..(56): Xaa at position 56 is Tyr, Phe, Met, His, Ile, Leu, Val Ala, or Gly
  SITE (81)..(81): Xaa at position 81 is Trp, Tyr, Phe, Met, His, Ile, Leu Val, Ala, or Gly
  SITE (85)..(85): Xaa at position 85 is Val, Ala, Gly, Leu, or Ile
  SITE (86)..(86): Xaa at position 86 is Ala, Gly, or Pro
  SITE (88)..(88): Xaa at position 88 is Phe, Tyr, Met, His, Ile, Leu, Val Ala, or Gly
  SITE (99)..(99): Xaa at position 99 is Ile, Ala, Val, Leu, or Gly
  SITE (112)..(112): Xaa at position 112 is Met, Ile, Leu, Val, Ala, or Gly
  SITE (119)..(119): Xaa at position 119 is Ala, Gly, or Pro
  SITE (126)..(126): Xaa at position 126 is Met, Ile, Leu, Val, Ala, or Gly
  SITE (129)..(129): Xaa at position 129 is Ala, Gly, or Pro
  SITE (138)..(138): Xaa at position 138 is Leu, Ala, Val, Gly, or Ile
  SITE (145)..(145): Xaa at position 145 is Ile, Ala, Val, Leu, or Gly
  SITE (148)..(148): Xaa at position 148 is Tyr, Phe, Met, His, Ile, Leu, Val Ala, or Gly
  SITE (155)..(155): Xaa at position 155 is Leu, Ala, Val, Gly, or Ile
  SITE (156)..(156): Xaa at position 156 is Val, Ala, Gly, Leu, or Ile
  SITE (158)..(158): Xaa at position 158 is Met, Ile, Leu, Val, Ala, or Gly
  SITE (159)..(159): Xaa at position 159 is Tyr, Phe, Met, His, Ile, Leu, Val Ala, or Gly
  SITE (160)..(160): Xaa at position 160 is Val, Ala, Gly, Leu, or Ile
  SITE (163)..(163): Xaa at position 163 is Ile, Ala, Val, Leu, or Gly
  SITE (187)..(187): Xaa at position 187 is Ala, Gly, or Pro
  SITE (202)..(202): Xaa at position 202 is Trp, Tyr, Phe, Met, His, Ile, Leu Val, Ala, or Gly
  SITE (205)..(205): Xaa at position 205 is Leu, Ala, Val, Gly, or Ile
  SITE (206)..(206): Xaa at position 206 is Leu, Ala, Val, Gly, or Ile
  SITE (210)..(210): Xaa at position 210 is Val, Ala, Gly, Leu, or Ile
  SITE (213)..(213): Xaa at position 213 is Ala, Gly, or Pro
  SITE (218)..(218): Xaa at position 218 is Val, Ala, Gly, Leu, or Ile
  SITE (220)..(220): Xaa at position 220 is Leu, Ala, Val, Gly, or Ile
  SITE (230)..(230): Xaa at position 230 is Leu, Ala, Val, Gly, or Ile
  SITE (240)..(240): Xaa at position 240 is Ala, Gly, or Pro
  SITE (244)..(244): Xaa at position 244 is Leu, Ala, Val, Gly, or Ile
  SITE (247)..(247): Xaa at position 247 is Leu, Ala, Val, Gly, or Ile
  SITE (260)..(260): Xaa at position 260 is Leu, Ala, Val, Gly, or Ile
  SITE (278)..(278): Xaa at position 278 is Leu, Ala, Val, Gly, or Ile
  SITE (288)..(288): Xaa at position 288 is Leu, Ala, Val, Gly, or Ile
  SITE (290)..(290): Xaa at position 290 is Ile, Ala, Val, Leu, or Gly
  SITE (291)..(291): Xaa at position 291 is Ala, Gly, or Pro
  SITE (294)..(294): Xaa at position 294 is Leu, Ala, Val, Gly, or Ile
  SITE (305)..(305): Xaa at position 305 is Ala, Gly, or Pro
  SITE (306)..(306): Xaa at position 306 is Val, Ala, Gly, Leu, or Ile
  SITE (309)..(309): Xaa at position 309 is Tyr, Phe, Met, His, Ile, Leu, Val Ala, or Gly
  SITE (313)..(313): Xaa at position 313 is Ile, Ala, Val, Leu, or Gly
  SITE (314)..(314): Xaa at position 314 is Phe, Tyr, Met, His, Ile, Leu, Val Ala, or Gly
  SITE (344)..(344): Xaa at position 344 is Val, Ala, Gly, Leu, or Ile
  SITE (353)..(353): Xaa at position 353 is His, Phe, Tyr, Lys, Arg, Gly, Ser Thr, Ala, Val, Leu, Ile, Asn, Met, or Gln
  SITE (357)..(357): Xaa at position 357 is Leu, Ala, Val, Gly, or Ile
  SITE (360)..(360): Xaa at position 360 is Met, Ile, Leu, Val, Ala, or Gly
  SITE (363)..(363): Xaa at position 363 is Cys, Ala, Val, Gly, Ser, or Thr
  SITE (364)..(364): Xaa at position 364 is Ala, Gly, or Pro
  SITE (367)..(367): Xaa at position 367 is Met, Ile, Leu, Val, Ala, or Gly
  SITE (370)..(370): Xaa at position 370 is Ala, Gly, or Pro
  SITE (387)..(387): Xaa at position 387 is Ala, Gly, or Pro
  SITE (388)..(388): Xaa at position 388 is Ile, Ala, Val, Leu, or Gly
  SITE (391)..(391): Xaa at position 391 is Phe, Tyr, Met, His, Ile, Leu, Val Ala, or Gly
  SITE (392)..(392): Xaa at position 392 is Val, Ala, Gly, Leu, or Ile
  SITE (402)..(402): Xaa at position 402 is Ile, Ala, Val, Leu, or Gly
  SITE (406)..(406): Xaa at position 406 is Ile, Ala, Val, Leu, or Gly
  SITE (407)..(407): Xaa at position 407 is Val, Ala, Gly, Leu, or Ile
  SITE (408)..(408): Xaa at position 408 is Ala, Gly, or Pro
  SITE (411)..(411): Xaa at position 411 is Phe, Tyr, Met, His, Ile, Leu, Val Ala, or Gly
  SITE (419)..(419): Xaa at position 419 is Ala, Gly, or Pro
  SITE (423)..(423): Xaa at position 423 is Ala, Gly, or Pro
  SITE (449)..(449): Xaa at position 449 is Val, Ala, Gly, Leu, or Ile
  SITE (450)..(450): Xaa at position 450 is Phe, Tyr, Met, His, Ile, Leu, Val Ala, or Gly
  SITE (457)..(457): Xaa at position 457 is Leu, Ala, Val, Gly, or Ile
  SITE (479)..(479): Xaa at position 479 is Ile, Ala, Val, Leu, or Gly
MPSGFQQIGSEDGEPPQQRVTGTXVLXVFSXVLGSLQFGXNIGXXNAPQKVXEQSXNETWLGRQGPEGPSSIPPGTLTTLXALSXXIXSVGGMISSFLXGIISQWLGRKRAXLVNNVLXVLGGSLXGLXNAAASYEMXILGRFLXGAXSGLTSGXXPXXXGEXAPTHLRGALGTLNQLAIVIGILIXQVLGLESLLGTASLXPLXXGLTXLPXLLQLXLXPFCPESPRYXYIIQNLEGPXRKSXKRXTGWADVSGVLAEXKDEKRKLERERPLSLLQXLGSRTHRQPXIXXVVXQLSQQLSGINXXFYXSTSXXETAGVGQPAYATIGAGVVNTVFTLVSVLLXERAGRRTLXLLGXAGXCGXXILXTVXLLLLERVPAMSYVSIVXXFGXXAFFEIGPGPXPWFXXXELXSQGPRPAXMAVXGFSNWTSNFIIGMGFQYVAEAMGPYXXLLFAVLXLGFFIFTFLRVPETRGRTFDQXSAAFHRTPSLLEQEVKPSTELEYLGPDEND

SEQ ID NO: 322 - protein, 177 aa, Homo sapiens
  SITE (93)..(93): Xaa at position 93 is Leu, Ala, Val, Gly, or Ile
MPAWGALFLLWATAEATKDCPSPCTCRALETMGLWVDCRGHGLTALPALPARTRHLLLANNSLQSVPPGAFDHLPQLQTLDVTQNPWHCDCSXTYLRLWLEDRTPEALLQVRCASPSLAAHGPLGRLTGYQLGSCGWQLQASWVRPGVLWDVALVAVAALGLALLAGLLCATTEALD

SEQ ID NO: 323 - protein, 569 aa, Homo sapiens
  SITE (39)..(39): Xaa at position 39 is Ile, Ala, Val, Leu, or Gly
  SITE (57)..(57): Xaa at position 57 is Trp, Tyr, Phe, Met, His, Ile, Leu Val, Ala, or Gly
  SITE (75)..(75): Xaa at position 75 is His, Phe, Tyr, Lys, Arg, Gly, Ser Thr, Ala, Val, Leu, Ile, Asn, Met, or Gln
  SITE (81)..(81): Xaa at position 81 is Leu, Ala, Val, Gly, or Ile
  SITE (83)..(83): Xaa at position 83 is Phe, Tyr, Met, His, Ile, Leu, Val Ala, or Gly
  SITE (86)..(86): Xaa at position 86 is Ala, Gly, or Pro
  SITE (96)..(96): Xaa at position 96 is Cys, Ala, Val, Gly, Ser, or Thr
  SITE (97)..(97): Xaa at position 97 is Val, Ala, Gly, Leu, or Ile
  SITE (98)..(98): Xaa at position 98 is Val, Ala, Gly, Leu, or Ile
  SITE (104)..(104): Xaa at position 104 is Cys, Ala, Val, Gly, Ser, or Thr
  SITE (107)..(107): Xaa at position 107 is Ile, Ala, Val, Leu, or Gly
  SITE (111)..(111): Xaa at position 111 is Ala, Gly, or Pro
  SITE (140)..(140): Xaa at position 140 is Leu, Ala, Val, Gly, or Ile
  SITE (142)..(142): Xaa at position 142 is Cys, Ala, Val, Gly, Ser, or Thr
  SITE (145)..(145): Xaa at position 145 is Met, Ile, Leu, Val, Ala, or Gly
  SITE (148)..(148): Xaa at position 148 is Phe, Tyr, Met, His, Ile, Leu, Val Ala, or Gly
  SITE (160)..(160): Xaa at position 160 is Trp, Tyr, Phe, Met, His, Ile, Leu Val, Ala, or Gly
  SITE (181)..(181): Xaa at position 181 is Leu, Ala, Val, Gly, or Ile
  SITE (183)..(183): Xaa at position 183 is Val, Ala, Gly, Leu, or Ile
  SITE (194)..(194): Xaa at position 194 is Tyr, Phe, Met, His, Ile, Leu, Val Ala, or Gly
  SITE (196)..(196): Xaa at position 196 is Cys, Ala, Val, Gly, Ser, or Thr
  SITE (198)..(198): Xaa at position 198 is Ala, Gly, or Pro
  SITE (209)..(209): Xaa at position 209 is Ile, Ala, Val, Leu, or Gly
  SITE (213)..(213): Xaa at position 213 is Ile, Ala, Val, Leu, or Gly
  SITE (215)..(215): Xaa at position 215 is Phe, Tyr, Met, His, Ile, Leu, Val Ala, or Gly
  SITE (238)..(238): Xaa at position 238 is Val, Ala, Gly, Leu, or Ile
  SITE (246)..(246): Xaa at position 246 is Leu, Ala, Val, Gly, or Ile
  SITE (248)..(248): Xaa at position 248 is Cys, Ala, Val, Gly, Ser, or Thr
  SITE (250)..(250): Xaa at position 250 is Val, Ala, Gly, Leu, or Ile
  SITE (260)..(260): Xaa at position 260 is Trp, Tyr, Phe, Met, His, Ile, Leu Val, Ala, or Gly
  SITE (296)..(296): Xaa at position 296 is Leu, Ala, Val, Gly, or Ile
  SITE (298)..(298): Xaa at position 298 is Ile, Ala, Val, Leu, or Gly
  SITE (301)..(301): Xaa at position 301 is Ile, Ala, Val, Leu, or Gly
  SITE (305)..(305): Xaa at position 305 is Phe, Tyr, Met, His, Ile, Leu, Val Ala, or Gly
  SITE (310)..(310): Xaa at position 310 is Phe, Tyr, Met, His, Ile, Leu, Val Ala, or Gly
  SITE (312)..(312): Xaa at position 312 is Cys, Ala, Val, Gly, Ser, or Thr
  SITE (313)..(313): Xaa at position 313 is Phe, Tyr, Met, His, Ile, Leu, Val Ala, or Gly
  SITE (314)..(314): Xaa at position 314 is Ala, Gly, or Pro
  SITE (327)..(327): Xaa at position 327 is Leu, Ala, Val, Gly, or Ile
MKVLLRLICFIALLISSLEADKCKEREEKIILVSSANEXDVRPCPLNPNEHKGTITXYKDDSKTPVSTEQASRIXQHKEKXWXVPXKVEDSGHYYXXXRNSSYXLRXKISXKFVENEPNLCYNAQAIFKQKLPVAGDGGXVXPYXEFXKNENNELPKLQXYKDCKPLLLDNIHFSGVKDRXIXMNVAEKHRGNXTXHXSYTYLGKQYPXTRVXEXITLEENKPTRPVIVSPANETMEXDLGSQIQXIXNXTGQLSDIAYXKWNGSVIDEDDPVLGEDYYSVENPANKRRSTLITVXNXSEXESRXYKHPXTXXXKNTHGIDAAYIQXIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 324 - protein, 707 aa, Homo sapiens
  SITE (45)..(45): Xaa at position 45 is Ala, Gly, or Pro
  SITE (49)..(49): Xaa at position 49 is Leu, Ala, Val, Gly, or Ile
  SITE (74)..(74): Xaa at position 74 is Leu, Ala, Val, Gly, or Ile
  SITE (78)..(78): Xaa at position 78 is Leu, Ala, Val, Gly, or Ile
  SITE (99)..(99): Xaa at position 99 is Cys, Ala, Val, Gly, Ser, or Thr
  SITE (121)..(121): Xaa at position 121 is Ile, Ala, Val, Leu, or Gly
  SITE (137)..(137): Xaa at position 137 is Ile, Ala, Val, Leu, or Gly
  SITE (140)..(140): Xaa at position 140 is Ala, Gly, or Pro
  SITE (141)..(141): Xaa at position 141 is Phe, Tyr, Met, His, Ile, Leu, Val Ala, or Gly
  SITE (144)..(144): Xaa at position 144 is Ala, Gly, or Pro
  SITE (145)..(145): Xaa at position 145 is Phe, Tyr, Met, His, Ile, Leu, Val Ala, or Gly
  SITE (148)..(148): Xaa at position 148 is Trp, Tyr, Phe, Met, His, Ile, Leu Val, Ala, or Gly
  SITE (154)..(154): Xaa at position 154 is Leu, Ala, Val, Gly, or Ile
  SITE (164)..(164): Xaa at position 164 is Ala, Gly, or Pro
  SITE (166)..(166): Xaa at position 166 is Ile, Ala, Val, Leu, or Gly
  SITE (168)..(168): Xaa at position 168 is Ile, Ala, Val, Leu, or Gly
  SITE (187)..(187): Xaa at position 187 is Leu, Ala, Val, Gly, or Ile
  SITE (189)..(189): Xaa at position 189 is Ala, Gly, or Pro
  SITE (190)..(190): Xaa at position 190 is His, Phe, Tyr, Lys, Arg, Gly, Ser Thr, Ala, Val, Leu, Ile, Asn, Met, or Gln
  SITE (191)..(191): Xaa at position 191 is Ala, Gly, or Pro
  SITE (192)..(192): Xaa at position 192 is Phe, Tyr, Met, His, Ile, Leu, Val Ala, or Gly
  SITE (202)..(202): Xaa at position 202 is Ala, Gly, or Pro
  SITE (204)..(204): Xaa at position 204 is Phe, Tyr, Met, His, Ile, Leu, Val Ala, or Gly
  SITE (210)..(210): Xaa at position 210 is Trp, Tyr, Phe, Met, His, Ile, Leu Val, Ala, or Gly
  SITE (218)..(218): Xaa at position 218 is Val, Ala, Gly, Leu, or Ile
  SITE (219)..(219): Xaa at position 219 is Pro, Met, Leu, Ile, Val, Ala or Gly
  SITE (222)..(222): Xaa at position 222 is Phe, Tyr, Met, His, Ile, Leu, Val Ala, or Gly
  SITE (225)..(225): Xaa at position 225 is Ala, Gly, or Pro
  SITE (230)..(230): Xaa at position 230 is Cys, Ala, Val, Gly, Ser, or Thr
  SITE (234)..(234): Xaa at position 234 is Phe, Tyr, Met, His, Ile, Leu, Val Ala, or Gly
  SITE (238)..(238): Xaa at position 238 is Gly, Ala, or Pro
  SITE (244)..(244): Xaa at position 244 is Cys, Ala, Val, Gly, Ser, or Thr
  SITE (255)..(255): Xaa at position 255 is Trp, Tyr, Phe, Met, His, Ile, Leu Val, Ala, or Gly
  SITE (256)..(256): Xaa at position 256 is Cys, Ala, Val, Gly, Ser, or Thr
  SITE (271)..(271): Xaa at position 271 is Cys, Ala, Val, Gly, Ser, or Thr
  SITE (283)..(283): Xaa at position 283 is Ala, Gly, or Pro
  SITE (288)..(288): Xaa at position 288 is Cys, Ala, Val, Gly, Ser, or Thr
  SITE (292)..(292): Xaa at position 292 is Phe, Tyr, Met, His, Ile, Leu, Val Ala, or Gly
  SITE (302)..(302): Xaa at position 302 is Cys, Ala, Val, Gly, Ser, or Thr
  SITE (313)..(313): Xaa at position 313 is Trp, Tyr, Phe, Met, His, Ile, Leu Val, Ala, or Gly
  SITE (314)..(314): Xaa at position 314 is Cys, Ala, Val, Gly, Ser, or Thr
  SITE (315)..(315): Xaa at position 315 is Ala, Gly, or Pro
  SITE (329)..(329): Xaa at position 329 is Cys, Ala, Val, Gly, Ser, or Thr
  SITE (347)..(347): Xaa at position 347 is Cys, Ala, Val, Gly, Ser, or Thr
  SITE (351)..(351): Xaa at position 351 is Phe, Tyr, Met, His, Ile, Leu, Val Ala, or Gly
  SITE (353)..(353): Xaa at position 353 is Phe, Tyr, Met, His, Ile, Leu, Val Ala, or Gly
  SITE (372)..(372): Xaa at position 372 is Trp, Tyr, Phe, Met, His, Ile, Leu Val, Ala, or Gly
  SITE (373)..(373): Xaa at position 373 is Cys, Ala, Val, Gly, Ser, or Thr
  SITE (374)..(374): Xaa at position 374 is Ala, Gly, or Pro
  SITE (379)..(379): Xaa at position 379 is Phe, Tyr, Met, His, Ile, Leu, Val Ala, or Gly
  SITE (385)..(385): Xaa at position 385 is Trp, Tyr, Phe, Met, His, Ile, Leu Val, Ala, or Gly
  SITE (388)..(388): Xaa at position 388 is Cys, Ala, Val, Gly, Ser, or Thr
  SITE (395)..(395): Xaa at position 395 is Leu, Ala, Val, Gly, or Ile
  SITE (396)..(396): Xaa at position 396 is Phe, Tyr, Met, His, Ile, Leu, Val Ala, or Gly
  SITE (398)..(398): Xaa at position 398 is Val, Ala, Gly, Leu, or Ile
  SITE (399)..(399): Xaa at position 399 is Ala, Gly, or Pro
  SITE (400)..(400): Xaa at position 400 is Ala, Gly, or Pro
  SITE (403)..(403): Xaa at position 403 is Phe, Tyr, Met, His, Ile, Leu, Val Ala, or Gly
  SITE (405)..(405): Xaa at position 405 is His, Phe, Tyr, Lys, Arg, Gly, Ser Thr, Ala, Val, Leu, Ile, Asn, Met, or Gln
  SITE (406)..(406): Xaa at position 406 is Ala, Gly, or Pro
  SITE (407)..(407): Xaa at position 407 is Leu, Ala, Val, Gly, or Ile
  SITE (409)..(409): Xaa at position 409 is Leu, Ala, Val, Gly, or Ile
  SITE (417)..(417): Xaa at position 417 is Ala, Gly, or Pro
  SITE (418)..(418): Xaa at position 418 is Leu, Ala, Val, Gly, or Ile
  SITE (419)..(419): Xaa at position 419 is Met, Ile, Leu, Val, Ala, or Gly
  SITE (420)..(420): Xaa at position 420 is Tyr, Phe, Met, His, Ile, Leu, Val Ala, or Gly
  SITE (425)..(425): Xaa at position 425 is Phe, Tyr, Met, His, Ile, Leu, Val Ala, or Gly
  SITE (431)..(431): Xaa at position 431 is Leu, Ala, Val, Gly, or Ile
  SITE (439)..(439): Xaa at position 439 is Ile, Ala, Val, Leu, or Gly
  SITE (515)..(515): Xaa at position 515 is Ala, Gly, or Pro
  SITE (523)..(523): Xaa at position 523 is Ala, Gly, or Pro
  SITE (531)..(531): Xaa at position 531 is Leu, Ala, Val, Gly, or Ile
  SITE (533)..(533): Xaa at position 533 is Leu, Ala, Val, Gly, or Ile
  SITE (534)..(534): Xaa at position 534 is Phe, Tyr, Met, His, Ile, Leu, Val Ala, or Gly
  SITE (556)..(556): Xaa at position 556 is Ile, Ala, Val, Leu, or Gly
  SITE (580)..(580): Xaa at position 580 is Phe, Tyr, Met, His, Ile, Leu, Val Ala, or Gly
  SITE (581)..(581): Xaa at position 581 is Phe, Tyr, Met, His, Ile, Leu, Val Ala, or Gly
  SITE (582)..(582): Xaa at position 582 is Phe, Tyr, Met, His, Ile, Leu, Val Ala, or Gly
  SITE (587)..(587): Xaa at position 587 is Val, Ala, Gly, Leu, or Ile
  SITE (604)..(604): Xaa at position 604 is Leu, Ala, Val, Gly, or Ile
  SITE (613)..(613): Xaa at position 613 is Val, Ala, Gly, Leu, or Ile
  SITE (626)..(626): Xaa at position 626 is Leu, Ala, Val, Gly, or Ile
  SITE (627)..(627): Xaa at position 627 is Phe, Tyr, Met, His, Ile, Leu, Val Ala, or Gly
  SITE (635)..(635): Xaa at position 635 is Phe, Tyr, Met, His, Ile, Leu, Val Ala, or Gly
  SITE (673)..(673): Xaa at position 673 is Phe, Tyr, Met, His, Ile, Leu, Val Ala, or Gly
  SITE (674)..(674): Xaa at position 674 is Cys, Ala, Val, Gly, Ser, or Thr
  SITE (679)..(679): Xaa at position 679 is Tyr, Phe, Met, His, Ile, Leu, Val Ala, or Gly
  SITE (702)..(702): Xaa at position 702 is Leu, Ala, Val, Gly, or Ile
MSLWQPLVLVLLVLGCCFAAPRQRQSTLVLFPGDLRTNLTDRQLXEEYXYRYGYTRVAEMRGESKSLGPALLLXQKQXSLPETGELDSATLKAMRTPRXGVPDLGRFQTFEGDLKWHHHNXTYWIQNYSEDLPRAVXDDXXARXXALXSAVTPXTFTRVYSRDXDXVXQFGVAEHGDGYPFDGKDGXLXXXXPPGPGIQGDXHXDDDELXSLGKGVVXXTRXGNXDGAAXHFPXIFEXRSYSAXTTDGRSDGLPXXSTTANYDTDDRFGFXPSERLYTQDGNXDGKPXQFPXIFQGQSYSAXTTDGRSDGYRXXXTTANYDRDKLFGFXPTRADSTVMGGNSAGELXVFPXTXLGKEYSTCTSEGRGDGRLXXXTTSNXDSDKKXGFXPDQGYSXXLXXXHEXGXXXGXDHSSVPEXXXXPMYRXTEGPPXHKDDVNGXRHLYGPRPEPEPRPPTTTTPQPTAPPTVCPTGPPTVHPSERPTAGPTGPPSAGPTGPPTAGPSTATTVPLSPVDDXCNVNIFDXIAEIGNQXYXXKDGKYWRFSEGRGSRPQGPFLXADKWPALPRKLDSVFEERLSKKLXXXSGRQXWVYTGASVLGPRRLDKXGLGADVAQXTGALRSGRGKMLXXSGRRLWRXDVKAQMVDPRSASEVDRMFPGVPLDTHDVFQYREKAYXXQDRFXWRVSSRSELNQVDQVGYVTYDIXQCPED

SEQ ID NO: 325 - protein, 551 aa, Homo sapiens
  SITE (36)..(36): Xaa at position 36 is Cys, Ala, Val, Gly, Ser, or Thr
  SITE (38)..(38): Xaa at position 38 is Tyr, Phe, Met, His, Ile, Leu, Val Ala, or Gly
  SITE (42)..(42): Xaa at position 42 is Ala, Gly, or Pro
  SITE (44)..(44): Xaa at position 44 is Ile, Ala, Val, Leu, or Gly
  SITE (46)..(46): Xaa at position 46 is Cys, Ala, Val, Gly, Ser, or Thr
  SITE (48)..(48): Xaa at position 48 is Trp, Tyr, Phe, Met, His, Ile, Leu Val, Ala, or Gly
  SITE (61)..(61): Xaa at position 61 is Val, Ala, Gly, Leu, or Ile
  SITE (63)..(63): Xaa at position 63 is Ala, Gly, or Pro
  SITE (88)..(88): Xaa at position 88 is Leu, Ala, Val, Gly, or Ile
  SITE (98)..(98): Xaa at position 98 is Leu, Ala, Val, Gly, or Ile
  SITE (101)..(101): Xaa at position 101 is Val, Ala, Gly, Leu, or Ile
  SITE (104)..(104): Xaa at position 104 is Val, Ala, Gly, Leu, or Ile
  SITE (106)..(106): Xaa at position 106 is Leu, Ala, Val, Gly, or Ile
  SITE (108)..(108): Xaa at position 108 is Val, Ala, Gly, Leu, or Ile
  SITE (124)..(124): Xaa at position 124 is Phe, Tyr, Met, His, Ile, Leu, Val Ala, or Gly
  SITE (127)..(127): Xaa at position 127 is Phe, Tyr, Met, His, Ile, Leu, Val Ala, or Gly
  SITE (130)..(130): Xaa at position 130 is Leu, Ala, Val, Gly, or Ile
  SITE (132)..(132): Xaa at position 132 is Leu, Ala, Val, Gly, or Ile
  SITE (148)..(148): Xaa at position 148 is Cys, Ala, Val, Gly, Ser, or Thr
  SITE (150)..(150): Xaa at position 150 is Ile, Ala, Val, Leu, or Gly
  SITE (167)..(167): Xaa at position 167 is Phe, Tyr, Met, His, Ile, Leu, Val Ala, or Gly
  SITE (169)..(169): Xaa at position 169 is Ala, Gly, or Pro
  SITE (206)..(206): Xaa at position 206 is Phe, Tyr, Met, His, Ile, Leu, Val Ala, or Gly
  SITE (208)..(208): Xaa at position 208 is Val, Ala, Gly, Leu, or Ile
  SITE (210)..(210): Xaa at position 210 is Val, Ala, Gly, Leu, or Ile
MAAPALSWRLPLLILLLPLATSWASAAVNGTSQFTXFXNSRXNXSXVXSQDGALQDTSCQXHXWPDRRRWNQTCELLPVSQASWACNXILGAPDSQKXTTXDIXTXRXLCREGVRWRVMAIQDXKPXENXRXMAPISLQVVHVETHRXNXSWEISQASHYFERHLEXEXRTLSPGHTWEEAPLLTLKQKQEWICLETLTPDTQYEXQXRXKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 326 - protein, 456 aa, Homo sapiens
  SITE (416)..(416): Xaa at position 416 is Val, Ala, Gly, Leu, or Ile
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSXSKIDRLSRIAFPLLFGIFNLVYWATYLNREPQLKAPTPHQ

SEQ ID NO: 327 - protein, 441 aa, Homo sapiens
  SITE (323)..(323): Xaa at position 323 is Ala, Gly, or Pro
  SITE (327)..(327): Xaa at position 327 is Ala, Gly, or Pro
  SITE (340)..(340): Xaa at position 340 is Phe, Tyr, Met, His, Ile, Leu, Val Ala, or Gly
  SITE (341)..(341): Xaa at position 341 is Leu, Ala, Val, Gly, or Ile
  SITE (342)..(342): Xaa at position 342 is Leu, Ala, Val, Gly, or Ile
  SITE (345)..(345): Xaa at position 345 is Leu, Ala, Val, Gly, or Ile
  SITE (350)..(350): Xaa at position 350 is Cys, Ala, Val, Gly, Ser, or Thr
  SITE (354)..(354): Xaa at position 354 is Ile, Ala, Val, Leu, or Gly
  SITE (363)..(363): Xaa at position 363 is Phe, Tyr, Met, His, Ile, Leu, Val Ala, or Gly
  SITE (365)..(365): Xaa at position 365 is Leu, Ala, Val, Gly, or Ile
  SITE (371)..(371): Xaa at position 371 is Val, Ala, Gly, Leu, or Ile
  SITE (372)..(372): Xaa at position 372 is Ala, Gly, or Pro
  SITE (389)..(389): Xaa at position 389 is Leu, Ala, Val, Gly, or Ile
  SITE (393)..(393): Xaa at position 393 is Leu, Ala, Val, Gly, or Ile
  SITE (401)..(401): Xaa at position 401 is Ile, Ala, Val, Leu, or Gly
  SITE (402)..(402): Xaa at position 402 is Ile, Ala, Val, Leu, or Gly
  SITE (411)..(411): Xaa at position 411 is Val, Ala, Gly, Leu, or Ile
  SITE (414)..(414): Xaa at position 414 is Phe, Tyr, Met, His, Ile, Leu, Val Ala, or Gly
  SITE (418)..(418): Xaa at position 418 is Leu, Ala, Val, Gly, or Ile
  SITE (429)..(429): Xaa at position 429 is Leu, Ala, Val, Gly, or Ile
  SITE (433)..(433): Xaa at position 433 is Leu, Ala, Val, Gly, or Ile
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPXAALXGYTGSGPIQLWQXXXELXTDKSXQSFXSWTGDGWEXKXSDPDEXXRRWGKRKNKPKMNYEKXSRGXRYYYDKNXXHKTAGKRYXYRXVCDXQSLLGYTPEEXHAMXDVKPDADE

SEQ ID NO: 328 - protein, 745 aa, Homo sapiens
  SITE (140)..(140): Xaa at position 140 is Ala, Gly, or Pro
  SITE (162)..(162): Xaa at position 162 is Ala, Gly, or Pro
  SITE (163)..(163): Xaa at position 163 is Ala, Gly, or Pro
  SITE (166)..(166): Xaa at position 166 is Val, Ala, Gly, Leu, or Ile
  SITE (174)..(174): Xaa at position 174 is Ala, Gly, or Pro
  SITE (179)..(179): Xaa at position 179 is Leu, Ala, Val, Gly, or Ile
  SITE (185)..(185): Xaa at position 185 is Leu, Ala, Val, Gly, or Ile
  SITE (186)..(186): Xaa at position 186 is Val, Ala, Gly, Leu, or Ile
  SITE (188)..(188): Xaa at position 188 is Ala, Gly, or Pro
  SITE (189)..(189): Xaa at position 189 is Val, Ala, Gly, Leu, or Ile
  SITE (190)..(190): Xaa at position 190 is Val, Ala, Gly, Leu, or Ile
  SITE (193)..(193): Xaa at position 193 is Met, Ile, Leu, Val, Ala, or Gly
  SITE (209)..(209): Xaa at position 209 is Leu, Ala, Val, Gly, or Ile
  SITE (212)..(212): Xaa at position 212 is Leu, Ala, Val, Gly, or Ile
  SITE (219)..(219): Xaa at position 219 is Leu, Ala, Val, Gly, or Ile
  SITE (222)..(222): Xaa at position 222 is Ile, Ala, Val, Leu, or Gly
  SITE (228)..(228): Xaa at position 228 is Ile, Ala, Val, Leu, or Gly
  SITE (230)..(230): Xaa at position 230 is Ala, Gly, or Pro
  SITE (231)..(231): Xaa at position 231 is Leu, Ala, Val, Gly, or Ile
  SITE (232)..(232): Xaa at position 232 is Val, Ala, Gly, Leu, or Ile
  SITE (242)..(242): Xaa at position 242 is Val, Ala, Gly, Leu, or Ile
  SITE (246)..(246): Xaa at position 246 is Ala, Gly, or Pro
  SITE (247)..(247): Xaa at position 247 is Ile, Ala, Val, Leu, or Gly
  SITE (250)..(250): Xaa at position 250 is Leu, Ala, Val, Gly, or Ile
  SITE (253)..(253): Xaa at position 253 is Leu, Ala, Val, Gly, or Ile
  SITE (260)..(260): Xaa at position 260 is Ala, Gly, or Pro
  SITE (264)..(264): Xaa at position 264 is Val, Ala, Gly, Leu, or Ile
  SITE (270)..(270): Xaa at position 270 is Leu, Ala, Val, Gly, or Ile
  SITE (273)..(273): Xaa at position 273 is Met, Ile, Leu, Val, Ala, or Gly
  SITE (284)..(284): Xaa at position 284 is Phe, Tyr, Met, His, Ile, Leu, Val Ala, or Gly
  SITE (285)..(285): Xaa at position 285 is Leu, Ala, Val, Gly, or Ile
  SITE (286)..(286): Xaa at position 286 is Ala, Gly, or Pro
  SITE (291)..(291): Xaa at position 291 is Cys, Ala, Val, Gly, Ser, or Thr
  SITE (292)..(292): Xaa at position 292 is Leu, Ala, Val, Gly, or Ile
  SITE (295)..(295): Xaa at position 295 is Leu, Ala, Val, Gly, or Ile
  SITE (296)..(296): Xaa at position 296 is Ala, Gly, or Pro
  SITE (306)..(306): Xaa at position 306 is Ile, Ala, Val, Leu, or Gly
  SITE (308)..(308): Xaa at position 308 is Ala, Gly, or Pro
  SITE (315)..(315): Xaa at position 315 is Leu, Ala, Val, Gly, or Ile
  SITE (316)..(316): Xaa at position 316 is Val, Ala, Gly, Leu, or Ile
  SITE (318)..(318): Xaa at position 318 is Ile, Ala, Val, Leu, or Gly
  SITE (319)..(319): Xaa at position 319 is Met, Ile, Leu, Val, Ala, or Gly
  SITE (327)..(327): Xaa at position 327 is Leu, Ala, Val, Gly, or Ile
  SITE (334)..(334): Xaa at position 334 is Val, Ala, Gly, Leu, or Ile
  SITE (335)..(335): Xaa at position 335 is Leu, Ala, Val, Gly, or Ile
  SITE (338)..(338): Xaa at position 338 is Leu, Ala, Val, Gly, or Ile
  SITE (341)..(341): Xaa at position 341 is Cys, Ala, Val, Gly, Ser, or Thr
  SITE (348)..(348): Xaa at position 348 is Ile, Ala, Val, Leu, or Gly
  SITE (349)..(349): Xaa at position 349 is Val, Ala, Gly, Leu, or Ile
  SITE (351)..(351): Xaa at position 351 is Ala, Gly, or Pro
  SITE (354)..(354): Xaa at position 354 is Met, Ile, Leu, Val, Ala, or Gly
  SITE (356)..(356): Xaa at position 356 is Ala, Gly, or Pro
  SITE (357)..(357): Xaa at position 357 is Leu, Ala, Val, Gly, or Ile
  SITE (361)..(361): Xaa at position 361 is Leu, Ala, Val, Gly, or Ile
  SITE (368)..(368): Xaa at position 368 is Leu, Ala, Val, Gly, or Ile
  SITE (369)..(369): Xaa at position 369 is Val, Ala, Gly, Leu, or Ile
  SITE (372)..(372): Xaa at position 372 is Cys, Ala, Val, Gly, Ser, or Thr
  SITE (373)..(373): Xaa at position 373 is Leu, Ala, Val, Gly, or Ile
  SITE (376)..(376): Xaa at position 376 is Leu, Ala, Val, Gly, or Ile
  SITE (379)..(379): Xaa at position 379 is Leu, Ala, Val, Gly, or Ile
  SITE (382)..(382): Xaa at position 382 is Val, Ala, Gly, Leu, or Ile
  SITE (383)..(383): Xaa at position 383 is Ala, Gly, or Pro
  SITE (389)..(389): Xaa at position 389 is Leu, Ala, Val, Gly, or Ile
  SITE (392)..(392): Xaa at position 392 is Val, Ala, Gly, Leu, or Ile
  SITE (393)..(393): Xaa at position 393 is Leu, Ala, Val, Gly, or Ile
  SITE (396)..(396): Xaa at position 396 is Leu, Ala, Val, Gly, or Ile
  SITE (397)..(397): Xaa at position 397 is Val, Ala, Gly, Leu, or Ile
  SITE (400)..(400): Xaa at position 400 is Leu, Ala, Val, Gly, or Ile
  SITE (408)..(408): Xaa at position 408 is Leu, Ala, Val, Gly, or Ile
  SITE (410)..(410): Xaa at position 410 is Cys, Ala, Val, Gly, Ser, or Thr
  SITE (411)..(411): Xaa at position 411 is Ala, Gly, or Pro
  SITE (415)..(415): Xaa at position 415 is Leu, Ala, Val, Gly, or Ile
  SITE (418)..(418): Xaa at position 418 is Leu, Ala, Val, Gly, or Ile
  SITE (429)..(429): Xaa at position 429 is Val, Ala, Gly, Leu, or Ile
  SITE (435)..(435): Xaa at position 435 is Val, Ala, Gly, Leu, or Ile
  SITE (438)..(438): Xaa at position 438 is Leu, Ala, Val, Gly, or Ile
  SITE (439)..(439): Xaa at position 439 is Ile, Ala, Val, Leu, or Gly
  SITE (441)..(441): Xaa at position 441 is Ala, Gly, or Pro
  SITE (445)..(445): Xaa at position 445 is Ala, Gly, or Pro
  SITE (451)..(451): Xaa at position 451 is Ile, Ala, Val, Leu, or Gly
  SITE (455)..(455): Xaa at position 455 is Ala, Gly, or Pro
  SITE (456)..(456): Xaa at position 456 is Val, Ala, Gly, Leu, or Ile
  SITE (458)..(458): Xaa at position 458 is Ala, Gly, or Pro
  SITE (459)..(459): Xaa at position 459 is Leu, Ala, Val, Gly, or Ile
  SITE (462)..(462): Xaa at position 462 is Leu, Ala, Val, Gly, or Ile
  SITE (472)..(472): Xaa at position 472 is Ala, Gly, or Pro
  SITE (476)..(476): Xaa at position 476 is Val, Ala, Gly, Leu, or Ile
  SITE (485)..(485): Xaa at position 485 is Ile, Ala, Val, Leu, or Gly
  SITE (486)..(486): Xaa at position 486 is Val, Ala, Gly, Leu, or Ile
  SITE (488)..(488): Xaa at position 488 is Leu, Ala, Val, Gly, or Ile
  SITE (489)..(489): Xaa at position 489 is Leu, Ala, Val, Gly, or Ile
  SITE (497)..(497): Xaa at position 497 is Leu, Ala, Val, Gly, or Ile
  SITE (498)..(498): Xaa at position 498 is Val, Ala, Gly, Leu, or Ile
  SITE (500)..(500): Xaa at position 500 is Ala, Gly, or Pro
  SITE (502)..(502): Xaa at position 502 is Ile, Ala, Val, Leu, or Gly
  SITE (504)..(504): Xaa at position 504 is Leu, Ala, Val, Gly, or Ile
  SITE (505)..(505): Xaa at position 505 is Ile, Ala, Val, Leu, or Gly
  SITE (508)..(508): Xaa at position 508 is Leu, Ala, Val, Gly, or Ile
  SITE (509)..(509): Xaa at position 509 is Ala, Gly, or Pro
  SITE (510)..(510): Xaa at position 510 is Leu, Ala, Val, Gly, or Ile
  SITE (513)..(513): Xaa at position 513 is Ala, Gly, or Pro
  SITE (516)..(516): Xaa at position 516 is Ala, Gly, or Pro
  SITE (518)..(518): Xaa at position 518 is Leu, Ala, Val, Gly, or Ile
  SITE (523)..(523): Xaa at position 523 is Val, Ala, Gly, Leu, or Ile
  SITE (524)..(524): Xaa at position 524 is Ile, Ala, Val, Leu, or Gly
  SITE (527)..(527): Xaa at position 527 is Leu, Ala, Val, Gly, or Ile
  SITE (530)..(530): Xaa at position 530 is Leu, Ala, Val, Gly, or Ile
  SITE (531)..(531): Xaa at position 531 is Leu, Ala, Val, Gly, or Ile
  SITE (534)..(534): Xaa at position 534 is Ala, Gly, or Pro
  SITE (556)..(556): Xaa at position 556 is Met, Ile, Leu, Val, Ala, or Gly
  SITE (559)..(559): Xaa at position 559 is Ile, Ala, Val, Leu, or Gly
  SITE (560)..(560): Xaa at position 560 is Val, Ala, Gly, Leu, or Ile
  SITE (563)..(563): Xaa at position 563 is Cys, Ala, Val, Gly, Ser, or Thr
  SITE (566)..(566): Xaa at position 566 is Ala, Gly, or Pro
  SITE (567)..(567): Xaa at position 567 is Leu, Ala, Val, Gly, or Ile
  SITE (570)..(570): Xaa at position 570 is Leu, Ala, Val, Gly, or Ile
  SITE (571)..(571): Xaa at position 571 is Ala, Gly, or Pro
  SITE (580)..(580): Xaa at position 580 is Ile, Ala, Val, Leu, or Gly
  SITE (586)..(586): Xaa at position 586 is Ile, Ala, Val, Leu, or Gly
  SITE (588)..(588): Xaa at position 588 is Leu, Ala, Val, Gly, or Ile
  SITE (589)..(589): Xaa at position 589 is Phe, Tyr, Met, His, Ile, Leu, Val Ala, or Gly
  SITE (590)..(590): Xaa at position 590 is Val, Ala, Gly, Leu, or Ile
  SITE (592)..(592): Xaa at position 592 is Leu, Ala, Val, Gly, or Ile
  SITE (593)..(593): Xaa at position 593 is Leu, Ala, Val, Gly, or Ile
  SITE (600)..(600): Xaa at position 600 is Ile, Ala, Val, Leu, or Gly
  SITE (604)..(604): Xaa at position 604 is Ala, Gly, or Pro
  SITE (605)..(605): Xaa at position 605 is Ala, Gly, or Pro
  SITE (607)..(607): Xaa at position 607 is Val, Ala, Gly, Leu, or Ile
  SITE (608)..(608): Xaa at position 608 is Leu, Ala, Val, Gly, or Ile
  SITE (611)..(611): Xaa at position 611 is Leu, Ala, Val, Gly, or Ile
  SITE (612)..(612): Xaa at position 612 is Ala, Gly, or Pro
  SITE (618)..(618): Xaa at position 618 is Ala, Gly, or Pro
  SITE (620)..(620): Xaa at position 620 is Ala, Gly, or Pro
  SITE (621)..(621): Xaa at position 621 is Ile, Ala, Val, Leu, or Gly
  SITE (623)..(623): Xaa at position 623 is Ala, Gly, or Pro
  SITE (626)..(626): Xaa at position 626 is Ala, Gly, or Pro
  SITE (630)..(630): Xaa at position 630 is Leu, Ala, Val, Gly, or Ile
  SITE (633)..(633): Xaa at position 633 is Leu, Ala, Val, Gly, or Ile
  SITE (634)..(634): Xaa at position 634 is Leu, Ala, Val, Gly, or Ile
  SITE (642)..(642): Xaa at position 642 is Ala, Gly, or Pro
  SITE (645)..(645): Xaa at position 645 is Ala, Gly, or Pro
  SITE (646)..(646): Xaa at position 646 is Ala, Gly, or Pro
  SITE (648)..(648): Xaa at position 648 is Val, Ala, Gly, Leu, or Ile
  SITE (649)..(649): Xaa at position 649 is Leu, Ala, Val, Gly, or Ile
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELXTRALPELTKLLNDEDPVVVTKXXMIXNQLSKKEXSRRAXMGSPQXXAXXXRTXQNTSDLDTARCTTSIXHNXSHHREGXLAXFKSGGXPXXXRMLSSPVESXLFYXXTTXHNXLLYQEGXKMAXRLADGXQKXVPLLNKNNPKXXXITTDXXQLXXYGNQESKLIXLXNGGPQAXXQXXRNYSYEKXLWTTSRXXKVXSVXPSNKPAXXEXGGXQXXGKHXTSNSPRXXQNXXWTXRNXSDXXTKQEGXESXXKIXXNQXSVDDVNVXTXXTGTXSNXTCNNSKNKTLXTQNSGXEAXXHXILRXGDKDDXTEPXXCXXRHXTSRHPEAEMXQNSXRLNYGIPAXXKXXNQPNQWPXXKXTXGXXRNXXXCPXNHXPXQEAAXXPRXVQXXVKXHQDAQRHVAAGTQQPYTDGVRXEEXXEGXTGXXHIXXRDPMNRMEXFRLNTXPXXXQXXYSSVENXQRVXXGXXCEXXQDKEAXDXXDXEGXSAPXMEXXHSRNEGTXTYXXAXXFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 329 - protein, 202 aa, Homo sapiens
  SITE (44)..(44): Xaa at position 44 is Leu, Ala, Val, Gly, or Ile
  SITE (48)..(48): Xaa at position 48 is Ile, Ala, Val, Leu, or Gly
  SITE (52)..(52): Xaa at position 52 is Leu, Ala, Val, Gly, or Ile
  SITE (55)..(55): Xaa at position 55 is Leu, Ala, Val, Gly, or Ile
  SITE (59)..(59): Xaa at position 59 is Ala, Gly, or Pro
  SITE (62)..(62): Xaa at position 62 is Leu, Ala, Val, Gly, or Ile
  SITE (66)..(66): Xaa at position 66 is Tyr, Phe, Met, His, Ile, Leu, Val Ala, or Gly
  SITE (74)..(74): Xaa at position 74 is Phe, Tyr, Met, His, Ile, Leu, Val Ala, or Gly
  SITE (81)..(81): Xaa at position 81 is Leu, Ala, Val, Gly, or Ile
  SITE (82)..(82): Xaa at position 82 is Cys, Ala, Val, Gly, Ser, or Thr
  SITE (102)..(102): Xaa at position 102 is Leu, Ala, Val, Gly, or Ile
  SITE (105)..(105): Xaa at position 105 is Leu, Ala, Val, Gly, or Ile
  SITE (106)..(106): Xaa at position 106 is Tyr, Phe, Met, His, Ile, Leu, Val Ala, or Gly
  SITE (108)..(108): Xaa at position 108 is Ile, Ala, Val, Leu, or Gly
  SITE (109)..(109): Xaa at position 109 is Val, Ala, Gly, Leu, or Ile
  SITE (110)..(110): Xaa at position 110 is Val, Ala, Gly, Leu, or Ile
  SITE (112)..(112): Xaa at position 112 is Leu, Ala, Val, Gly, or Ile
  SITE (116)..(116): Xaa at position 116 is Leu, Ala, Val, Gly, or Ile
  SITE (119)..(119): Xaa at position 119 is Ile, Ala, Val, Leu, or Gly
  SITE (130)..(130): Xaa at position 130 is Ala, Gly, or Pro
  SITE (133)..(133): Xaa at position 133 is Leu, Ala, Val, Gly, or Ile
  SITE (137)..(137): Xaa at position 137 is Leu, Ala, Val, Gly, or Ile
  SITE (144)..(144): Xaa at position 144 is Leu, Ala, Val, Gly, or Ile
  SITE (147)..(147): Xaa at position 147 is Leu, Ala, Val, Gly, or Ile
  SITE (148)..(148): Xaa at position 148 is Leu, Ala, Val, Gly, or Ile
  SITE (151)..(151): Xaa at position 151 is Val, Ala, Gly, Leu, or Ile
  SITE (152)..(152): Xaa at position 152 is Leu, Ala, Val, Gly, or Ile
  SITE (153)..(153): Xaa at position 153 is Cys, Ala, Val, Gly, Ser, or Thr
  SITE (155)..(155): Xaa at position 155 is Leu, Ala, Val, Gly, or Ile
  SITE (156)..(156): Xaa at position 156 is Cys, Ala, Val, Gly, Ser, or Thr
  SITE (164)..(164): Xaa at position 164 is Val, Ala, Gly, Leu, or Ile
  SITE (185)..(185): Xaa at position 185 is Cys, Ala, Val, Gly, Ser, or Thr
  SITE (187)..(187): Xaa at position 187 is Leu, Ala, Val, Gly, or Ile
  SITE (188)..(188): Xaa at position 188 is Leu, Ala, Val, Gly, or Ile
  SITE (191)..(191): Xaa at position 191 is Tyr, Phe, Met, His, Ile, Leu, Val Ala, or Gly
  SITE (195)..(195): Xaa at position 195 is Ile, Ala, Val, Leu, or Gly
  SITE (198)..(198): Xaa at position 198 is Leu, Ala, Val, Gly, or Ile
MKVLAAGVVPLLLVLHWKHGAGSPLPITPVNATCAIRHPCHNNXMNQXRSQXAQXNGSXNAXFILXYTAQGEPXPNNLDKXXGPNVTDFPPFHANGTEKAKXVEXXRXXXYXGTSXGNXTRDQKILNPSXLSXHSKXNATADIXRGXXSNXXXRXXSKYHVGHXDVTYGPDTSGKDVFQKKKLGXQXXGKXKQIXAVXAQAF

SEQ ID NO: 330 - protein, 253 aa, Homo sapiens
  SITE (6)..(6): Xaa at position 6 is Leu, Ala, Val, Gly, or Ile
  SITE (7)..(7): Xaa at position 7 is Val, Ala, Gly, Leu, or Ile
  SITE (8)..(8): Xaa at position 8 is Met, Ile, Leu, Val, Ala, or Gly
  SITE (9)..(9): Xaa at position 9 is Val, Ala, Gly, Leu, or Ile
  SITE (11)..(11): Xaa at position 11 is His, Phe, Tyr, Lys, Arg, Gly, Ser Thr, Ala, Val, Leu, Ile, Asn, Met, or Gln
  SITE (22)..(22): Xaa at position 22 is Phe, Tyr, Met, His, Ile, Leu, Val Ala, or Gly
  SITE (28)..(28): Xaa at position 28 is Ala, Gly, or Pro
  SITE (38)..(38): Xaa at position 38 is Ala, Gly, or Pro
  SITE (42)..(42): Xaa at position 42 is Ala, Gly, or Pro
  SITE (44)..(44): Xaa at position 44 is Ala, Gly, or Pro
  SITE (45)..(45): Xaa at position 45 is Ile, Ala, Val, Leu, or Gly
  SITE (52)..(52): Xaa at position 52 is Phe, Tyr, Met, His, Ile, Leu, Val Ala, or Gly
  SITE (54)..(54): Xaa at position 54 is Ile, Ala, Val, Leu, or Gly
  SITE (55)..(55): Xaa at position 55 is Cys, Ala, Val, Gly, Ser, or Thr
  SITE (56)..(56): Xaa at position 56 is Tyr, Phe, Met, His, Ile, Leu, Val Ala, or Gly
  SITE (60)..(60): Xaa at position 60 is Leu, Ala, Val, Gly, or Ile
  SITE (63)..(63): Xaa at position 63 is Ala, Gly, or Pro
  SITE (67)..(67): Xaa at position 67 is Leu, Ala, Val, Gly, or Ile
  SITE (70)..(70): Xaa at position 70 is Ile, Ala, Val, Leu, or Gly
  SITE (71)..(71): Xaa at position 71 is Leu, Ala, Val, Gly, or Ile
  SITE (87)..(87): Xaa at position 87 is Leu, Ala, Val, Gly, or Ile
  SITE (91)..(91): Xaa at position 91 is His, Phe, Tyr, Lys, Arg, Gly, Ser Thr, Ala, Val, Leu, Ile, Asn, Met, or Gln
  SITE (95)..(95): Xaa at position 95 is Leu, Ala, Val, Gly, or Ile
  SITE (112)..(112): Xaa at position 112 is Val, Ala, Gly, Leu, or Ile
  SITE (126)..(126): Xaa at position 126 is Met, Ile, Leu, Val, Ala, or Gly
  SITE (136)..(136): Xaa at position 136 is Ile, Ala, Val, Leu, or Gly
  SITE (142)..(142): Xaa at position 142 is Tyr, Phe, Met, His, Ile, Leu, Val Ala, or Gly
  SITE (156)..(156): Xaa at position 156 is Leu, Ala, Val, Gly, or Ile
  SITE (160)..(160): Xaa at position 160 is Ile, Ala, Val, Leu, or Gly
  SITE (163)..(163): Xaa at position 163 is Ala, Gly, or Pro
  SITE (167)..(167): Xaa at position 167 is Trp, Tyr, Phe, Met, His, Ile, Leu Val, Ala, or Gly
  SITE (171)..(171): Xaa at position 171 is Ile, Ala, Val, Leu, or Gly
  SITE (175)..(175): Xaa at position 175 is Ile, Ala, Val, Leu, or Gly
  SITE (177)..(177): Xaa at position 177 is Ala, Gly, or Pro
  SITE (181)..(181): Xaa at position 181 is Val, Ala, Gly, Leu, or Ile
  SITE (182)..(182): Xaa at position 182 is Leu, Ala, Val, Gly, or Ile
  SITE (183)..(183): Xaa at position 183 is Ile, Ala, Val, Leu, or Gly
  SITE (184)..(184): Xaa at position 184 is Ala, Gly, or Pro
  SITE (185)..(185): Xaa at position 185 is Ala, Gly, or Pro
  SITE (186)..(186): Xaa at position 186 is His, Phe, Tyr, Lys, Arg, Gly, Ser Thr, Ala, Val, Leu, Ile, Asn, Met, or Gln
  SITE (190)..(190): Xaa at position 190 is Leu, Ala, Val, Gly, or Ile
  SITE (193)..(193): Xaa at position 193 is Ile, Ala, Val, Leu, or Gly
  SITE (194)..(194): Xaa at position 194 is Val, Ala, Gly, Leu, or Ile
  SITE (197)..(197): Xaa at position 197 is Leu, Ala, Val, Gly, or Ile
  SITE (205)..(205): Xaa at position 205 is Ile, Ala, Val, Leu, or Gly
  SITE (210)..(210): Xaa at position 210 is Leu, Ala, Val, Gly, or Ile
  SITE (214)..(214): Xaa at position 214 is Ile, Ala, Val, Leu, or Gly
  SITE (216)..(216): Xaa at position 216 is Ile, Ala, Val, Leu, or Gly
  SITE (217)..(217): Xaa at position 217 is Val, Ala, Gly, Leu, or Ile
  SITE (218)..(218): Xaa at position 218 is Tyr, Phe, Met, His, Ile, Leu, Val Ala, or Gly
  SITE (220)..(220): Xaa at position 220 is Leu, Ala, Val, Gly, or Ile
  SITE (239)..(239): Xaa at position 239 is Val, Ala, Gly, Leu, or Ile
MATHRXXXXRXGESTWNQENRXCGWFDXELSEKGTEEXKRGXKXXKDAKMEXDXXXTSVXKRXIRTXWAXXDGTDQMWLPVVRTWRXNERXYGGXTGLNKAETAAKHGEEQXKIWRRSFDIPPPPXDEKHPYYNSXSKERRXAGLKPGELPTCESXKDTXARXLPFXNEEXVPQXKXGKRXXXXXXGNSXRGXXKHXEGMSDQAXMELNXPTGXPXXXEXNKELKPTKPMQFLGDEETXRKAMEAVAAQGKAK

SEQ ID NO: 331 - protein, 489 aa, Homo sapiens
  SITE (46)..(46): Xaa at position 46 is Val, Ala, Gly, Leu, or Ile
  SITE (48)..(48): Xaa at position 48 is Trp, Tyr, Phe, Met, His, Ile, Leu Val, Ala, or Gly
  SITE (59)..(59): Xaa at position 59 is Phe, Tyr, Met, His, Ile, Leu, Val Ala, or Gly
  SITE (61)..(61): Xaa at position 61 is Val, Ala, Gly, Leu, or Ile
  SITE (63)..(63): Xaa at position 63 is Val, Ala, Gly, Leu, or Ile
  SITE (85)..(85): Xaa at position 85 is Cys, Ala, Val, Gly, Ser, or Thr
  SITE (87)..(87): Xaa at position 87 is Ile, Ala, Val, Leu, or Gly
  SITE (98)..(98): Xaa at position 98 is Leu, Ala, Val, Gly, or Ile
  SITE (100)..(100): Xaa at position 100 is Val, Ala, Gly, Leu, or Ile
  SITE (102)..(102): Xaa at position 102 is Val, Ala, Gly, Leu, or Ile
  SITE (104)..(104): Xaa at position 104 is Ala, Gly, or Pro
  SITE (120)..(120): Xaa at position 120 is Ala, Gly, or Pro
  SITE (141)..(141): Xaa at position 141 is Ile, Ala, Val, Leu, or Gly
  SITE (143)..(143): Xaa at position 143 is Ile, Ala, Val, Leu, or Gly
  SITE (145)..(145): Xaa at position 145 is Ile, Ala, Val, Leu, or Gly
  SITE (172)..(172): Xaa at position 172 is Tyr, Phe, Met, His, Ile, Leu, Val Ala, or Gly
  SITE (174)..(174): Xaa at position 174 is Val, Ala, Gly, Leu, or Ile
  SITE (176)..(176): Xaa at position 176 is Val, Ala, Gly, Leu, or Ile
  SITE (187)..(187): Xaa at position 187 is Ile, Ala, Val, Leu, or Gly
  SITE (200)..(200): Xaa at position 200 is Cys, Ala, Val, Gly, Ser, or Thr
  SITE (214)..(214): Xaa at position 214 is Cys, Ala, Val, Gly, Ser, or Thr
  SITE (215)..(215): Xaa at position 215 is Val, Ala, Gly, Leu, or Ile
  SITE (217)..(217): Xaa at position 217 is Ala, Gly, or Pro
  SITE (238)..(238): Xaa at position 238 is Ile, Ala, Val, Leu, or Gly
MALLFLLPLVMQGVSRAEMGTADLGPSSVPTPTNVTIESYNMNPIXYXEYQIMPQVPVXTXEXKNYGVKNSEWIDACINISHHYXNXSDHVGDPSNSXWXRXKXRVGQKESAYAKSEEFXVCRDGKIGPPKLDIRKEEKQXMXDXFHPSVFVNGDEQEVDYDPETTCYIRVXNXYXRMNGSEIQYKXLTQKEDDCDEIQXQLAIPVSSLNSQYXXSXEGVLHVWGVTTEKSKEVCITXFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 332 - protein, 507 aa, Homo sapiens
  SITE (23)..(23): Xaa at position 23 is Ile, Ala, Val, Leu, or Gly
  SITE (24)..(24): Xaa at position 24 is Val, Ala, Gly, Leu, or Ile
  SITE (25)..(25): Xaa at position 25 is Leu, Ala, Val, Gly, or Ile
  SITE (26)..(26): Xaa at position 26 is Ile, Ala, Val, Leu, or Gly
  SITE (27)..(27): Xaa at position 27 is Phe, Tyr, Met, His, Ile, Leu, Val Ala, or Gly
  SITE (28)..(28): Xaa at position 28 is Ala, Gly, or Pro
  SITE (31)..(31): Xaa at position 31 is Leu, Ala, Val, Gly, or Ile
  SITE (36)..(36): Xaa at position 36 is Leu, Ala, Val, Gly, or Ile
  SITE (49)..(49): Xaa at position 49 is Leu, Ala, Val, Gly, or Ile
  SITE (63)..(63): Xaa at position 63 is Tyr, Phe, Met, His, Ile, Leu, Val Ala, or Gly
  SITE (64)..(64): Xaa at position 64 is Val, Ala, Gly, Leu, or Ile
  SITE (74)..(74): Xaa at position 74 is Ala, Gly, or Pro
  SITE (75)..(75): Xaa at position 75 is Ala, Gly, or Pro
  SITE (76)..(76): Xaa at position 76 is Leu, Ala, Val, Gly, or Ile
  SITE (77)..(77): Xaa at position 77 is Leu, Ala, Val, Gly, or Ile
  SITE (100)..(100): Xaa at position 100 is Leu, Ala, Val, Gly, or Ile
  SITE (107)..(107): Xaa at position 107 is Val, Ala, Gly, Leu, or Ile
  SITE (108)..(108): Xaa at position 108 is Ala, Gly, or Pro
  SITE (111)..(111): Xaa at position 111 is Leu, Ala, Val, Gly, or Ile
  SITE (116)..(116): Xaa at position 116 is Tyr, Phe, Met, His, Ile, Leu, Val Ala, or Gly
  SITE (120)..(120): Xaa at position 120 is Met, Ile, Leu, Val, Ala, or Gly
  SITE (121)..(121): Xaa at position 121 is Ala, Gly, or Pro
  SITE (124)..(124): Xaa at position 124 is Trp, Tyr, Phe, Met, His, Ile, Leu Val, Ala, or Gly
  SITE (126)..(126): Xaa at position 126 is Leu, Ala, Val, Gly, or Ile
  SITE (147)..(147): Xaa at position 147 is Ile, Ala, Val, Leu, or Gly
  SITE (149)..(149): Xaa at position 149 is Tyr, Phe, Met, His, Ile, Leu, Val Ala, or Gly
  SITE (151)..(151): Xaa at position 151 is His, Phe, Tyr, Lys, Arg, Gly, Ser Thr, Ala, Val, Leu, Ile, Asn, Met, or Gln
  SITE (156)..(156): Xaa at position 156 is Cys, Ala, Val, Gly, Ser, or Thr
  SITE (161)..(161): Xaa at position 161 is Cys, Ala, Val, Gly, Ser, or Thr
  SITE (177)..(177): Xaa at position 177 is Val, Ala, Gly, Leu, or Ile
  SITE (179)..(179): Xaa at position 179 is Ile, Ala, Val, Leu, or Gly
  SITE (181)..(181): Xaa at position 181 is Leu, Ala, Val, Gly, or Ile
  SITE (182)..(182): Xaa at position 182 is Leu, Ala, Val, Gly, or Ile
  SITE (189)..(189): Xaa at position 189 is Ala, Gly, or Pro
  SITE (194)..(194): Xaa at position 194 is Leu, Ala, Val, Gly, or Ile
  SITE (197)..(197): Xaa at position 197 is Leu, Ala, Val, Gly, or Ile
  SITE (201)..(201): Xaa at position 201 is Tyr, Phe, Met, His, Ile, Leu, Val Ala, or Gly
  SITE (205)..(205): Xaa at position 205 is Ala, Gly, or Pro
  SITE (208)..(208): Xaa at position 208 is Leu, Ala, Val, Gly, or Ile
  SITE (209)..(209): Xaa at position 209 is Met, Ile, Leu, Val, Ala, or Gly
  SITE (212)..(212): Xaa at position 212 is Ala, Gly, or Pro
  SITE (219)..(219): Xaa at position 219 is Phe, Tyr, Met, His, Ile, Leu, Val Ala, or Gly
  SITE (220)..(220): Xaa at position 220 is Phe, Tyr, Met, His, Ile, Leu, Val Ala, or Gly
  SITE (221)..(221): Xaa at position 221 is Leu, Ala, Val, Gly, or Ile
  SITE (222)..(222): Xaa at position 222 is Tyr, Phe, Met, His, Ile, Leu, Val Ala, or Gly
  SITE (223)..(223): Xaa at position 223 is Tyr, Phe, Met, His, Ile, Leu, Val Ala, or Gly
  SITE (224)..(224): Xaa at position 224 is Ala, Gly, or Pro
  SITE (226)..(226): Xaa at position 226 is His, Phe, Tyr, Lys, Arg, Gly, Ser Thr, Ala, Val, Leu, Ile, Asn, Met, or Gln
  SITE (227)..(227): Xaa at position 227 is His, Phe, Tyr, Lys, Arg, Gly, Ser Thr, Ala, Val, Leu, Ile, Asn, Met, or Gln
  SITE (238)..(238): Xaa at position 238 is Phe, Tyr, Met, His, Ile, Leu, Val Ala, or Gly
  SITE (247)..(247): Xaa at position 247 is Phe, Tyr, Met, His, Ile, Leu, Val Ala, or Gly
  SITE (251)..(251): Xaa at position 251 is Leu, Ala, Val, Gly, or Ile
  SITE (254)..(254): Xaa at position 254 is Leu, Ala, Val, Gly, or Ile
  SITE (257)..(257): Xaa at position 257 is Ala, Gly, or Pro
  SITE (258)..(258): Xaa at position 258 is Val, Ala, Gly, Leu, or Ile
  SITE (261)..(261): Xaa at position 261 is Leu, Ala, Val, Gly, or Ile
  SITE (265)..(265): Xaa at position 265 is Ile, Ala, Val, Leu, or Gly
  SITE (275)..(275): Xaa at position 275 is Leu, Ala, Val, Gly, or Ile
  SITE (276)..(276): Xaa at position 276 is Val, Ala, Gly, Leu, or Ile
  SITE (278)..(278): Xaa at position 278 is Phe, Tyr, Met, His, Ile, Leu, Val Ala, or Gly
  SITE (280)..(280): Xaa at position 280 is Ala, Gly, or Pro
  SITE (310)..(310): Xaa at position 310 is Val, Ala, Gly, Leu, or Ile
  SITE (314)..(314): Xaa at position 314 is Ala, Gly, or Pro
  SITE (315)..(315): Xaa at position 315 is Leu, Ala, Val, Gly, or Ile
  SITE (331)..(331): Xaa at position 331 is Ala, Gly, or Pro
  SITE (337)..(337): Xaa at position 337 is Leu, Ala, Val, Gly, or Ile
  SITE (340)..(340): Xaa at position 340 is Leu, Ala, Val, Gly, or Ile
  SITE (341)..(341): Xaa at position 341 is Ala, Gly, or Pro
  SITE (344)..(344): Xaa at position 344 is Ala, Gly, or Pro
  SITE (358)..(358): Xaa at position 358 is Leu, Ala, Val, Gly, or Ile
  SITE (375)..(375): Xaa at position 375 is Phe, Tyr, Met, His, Ile, Leu, Val Ala, or Gly
  SITE (376)..(376): Xaa at position 376 is Tyr, Phe, Met, His, Ile, Leu, Val Ala, or Gly
  SITE (386)..(386): Xaa at position 386 is Val, Ala, Gly, Leu, or Ile
  SITE (387)..(387): Xaa at position 387 is Phe, Tyr, Met, His, Ile, Leu, Val Ala, or Gly
  SITE (388)..(388): Xaa at position 388 is Ala, Gly, or Pro
  SITE (389)..(389): Xaa at position 389 is Val, Ala, Gly, Leu, or Ile
  SITE (394)..(394): Xaa at position 394 is Tyr, Phe, Met, His, Ile, Leu, Val Ala, or Gly
  SITE (396)..(396): Xaa at position 396 is Ala, Gly, or Pro
  SITE (397)..(397): Xaa at position 397 is His, Phe, Tyr, Lys, Arg, Gly, Ser Thr, Ala, Val, Leu, Ile, Asn, Met, or Gln
  SITE (414)..(414): Xaa at position 414 is Cys, Ala, Val, Gly, Ser, or Thr
  SITE (415)..(415): Xaa at position 415 is His, Phe, Tyr, Lys, Arg, Gly, Ser Thr, Ala, Val, Leu, Ile, Asn, Met, or Gln
  SITE (426)..(426): Xaa at position 426 is Pro, Met, Leu, Ile, Val, Ala or Gly
  SITE (428)..(428): Xaa at position 428 is Leu, Ala, Val, Gly, or Ile
  SITE (459)..(459): Xaa at position 459 is Leu, Ala, Val, Gly, or Ile
  SITE (500)..(500): Xaa at position 500 is Cys, Ala, Val, Gly, Ser, or Thr
MGAPRSLLLALAAGLAVARPPNXXXXXXDDXGYGDXGCYGHPSSTTPNXDQLAAGGLRFTDFXXPVSLCTPSRXXXXTGRLPVRMGMYPGVLVPSSRGGXPLEEVTXXEVXAARGXLTGXXGKXHXGVGPEGAFLPPHQGFHRFLGXPXSXDQGPXQNLTXFPPATPCDGGCDQGLXPXPXXANLSVEXQPPWXPGXEARXMAFXHDXXADXQRQDRPXXXXXXSXXTHYPQFSGQSXAERSGRGPXGDSXMEXDAXXGTXMTAXGDLGLLEETXXIXTXDNGPETMRMSRGGCSGLLRCGKGTTYEGGXREPXXAFWPGHIAPGVTHELXSSLDLXPTXXALXGAPLPNVTLDGFDXSPLLLGTGKSPRQSLFXXPSYPDEVRGXXXXRTGKXKXXFFTQGSAHSDTTADPAXXASSSLTAHEPXLXYDLSKDPGENYNLLGGVAGATPEVLQALKQXQLLKAQLDAAVTFGPSQVARGEDPALQICCHPGCTPRPACXHCPDPHA

SEQ ID NO: 333 - protein, 398 aa, Homo sapiens
  SITE (154)..(154): Xaa at position 154 is Val, Ala, Gly, Leu, or Ile
  SITE (178)..(178): Xaa at position 178 is Val, Ala, Gly, Leu, or Ile
  SITE (179)..(179): Xaa at position 179 is Ala, Gly, or Pro
  SITE (180)..(180): Xaa at position 180 is Ile, Ala, Val, Leu, or Gly
  SITE (181)..(181): Xaa at position 181 is Ile, Ala, Val, Leu, or Gly
  SITE (182)..(182): Xaa at position 182 is Ile, Ala, Val, Leu, or Gly
  SITE (184)..(184): Xaa at position 184 is Phe, Tyr, Met, His, Ile, Leu, Val Ala, or Gly
  SITE (191)..(191): Xaa at position 191 is Leu, Ala, Val, Gly, or Ile
  SITE (194)..(194): Xaa at position 194 is Trp, Tyr, Phe, Met, His, Ile, Leu Val, Ala, or Gly
  SITE (195)..(195): Xaa at position 195 is Leu, Ala, Val, Gly, or Ile
  SITE (198)..(198): Xaa at position 198 is Leu, Ala, Val, Gly, or Ile
  SITE (199)..(199): Xaa at position 199 is His, Phe, Tyr, Lys, Arg, Gly, Ser Thr, Ala, Val, Leu, Ile, Asn, Met, or Gln
  SITE (201)..(201): Xaa at position 201 is Val, Ala, Gly, Leu, or Ile
  SITE (202)..(202): Xaa at position 202 is Leu, Ala, Val, Gly, or Ile
  SITE (207)..(207): Xaa at position 207 is Leu, Ala, Val, Gly, or Ile
  SITE (209)..(209): Xaa at position 209 is Tyr, Phe, Met, His, Ile, Leu, Val Ala, or Gly
  SITE (211)..(211): Xaa at position 211 is Ile, Ala, Val, Leu, or Gly
  SITE (212)..(212): Xaa at position 212 is Tyr, Phe, Met, His, Ile, Leu, Val Ala, or Gly
  SITE (213)..(213): Xaa at position 213 is Val, Ala, Gly, Leu, or Ile
  SITE (214)..(214): Xaa at position 214 is Ile, Ala, Val, Leu, or Gly
  SITE (225)..(225): Xaa at position 225 is Ala, Gly, or Pro
  SITE (227)..(227): Xaa at position 227 is Leu, Ala, Val, Gly, or Ile
  SITE (228)..(228): Xaa at position 228 is Leu, Ala, Val, Gly, or Ile
  SITE (230)..(230): Xaa at position 230 is Val, Ala, Gly, Leu, or Ile
  SITE (235)..(235): Xaa at position 235 is Ala, Gly, or Pro
  SITE (241)..(241): Xaa at position 241 is Tyr, Phe, Met, His, Ile, Leu, Val Ala, or Gly
  SITE (244)..(244): Xaa at position 244 is Phe, Tyr, Met, His, Ile, Leu, Val Ala, or Gly
  SITE (245)..(245): Xaa at position 245 is Val, Ala, Gly, Leu, or Ile
  SITE (246)..(246): Xaa at position 246 is Phe, Tyr, Met, His, Ile, Leu, Val Ala, or Gly
  SITE (251)..(251): Xaa at position 251 is Leu, Ala, Val, Gly, or Ile
  SITE (252)..(252): Xaa at position 252 is Ile, Ala, Val, Leu, or Gly
  SITE (260)..(260): Xaa at position 260 is Tyr, Phe, Met, His, Ile, Leu, Val Ala, or Gly
  SITE (268)..(268): Xaa at position 268 is His, Phe, Tyr, Lys, Arg, Gly, Ser Thr, Ala, Val, Leu, Ile, Asn, Met, or Gln
  SITE (269)..(269): Xaa at position 269 is Ile, Ala, Val, Leu, or Gly
  SITE (272)..(272): Xaa at position 272 is Ala, Gly, or Pro
  SITE (289)..(289): Xaa at position 289 is Val, Ala, Gly, Leu, or Ile
  SITE (291)..(291): Xaa at position 291 is Ala, Gly, or Pro
  SITE (292)..(292): Xaa at position 292 is Leu, Ala, Val, Gly, or Ile
  SITE (297)..(297): Xaa at position 297 is Phe, Tyr, Met, His, Ile, Leu, Val Ala, or Gly
  SITE (300)..(300): Xaa at position 300 is Ile, Ala, Val, Leu, or Gly
  SITE (303)..(303): Xaa at position 303 is Phe, Tyr, Met, His, Ile, Leu, Val Ala, or Gly
  SITE (308)..(308): Xaa at position 308 is Trp, Tyr, Phe, Met, His, Ile, Leu Val, Ala, or Gly
  SITE (310)..(310): Xaa at position 310 is Trp, Tyr, Phe, Met, His, Ile, Leu Val, Ala, or Gly
  SITE (317)..(317): Xaa at position 317 is Ile, Ala, Val, Leu, or Gly
  SITE (321)..(321): Xaa at position 321 is Leu, Ala, Val, Gly, or Ile
  SITE (366)..(366): Xaa at position 366 is Met, Ile, Leu, Val, Ala, or Gly
  SITE (367)..(367): Xaa at position 367 is Leu, Ala, Val, Gly, or Ile
  SITE (376)..(376): Xaa at position 376 is Tyr, Phe, Met, His, Ile, Leu, Val Ala, or Gly
  SITE (386)..(386): Xaa at position 386 is Leu, Ala, Val, Gly, or Ile
  SITE (392)..(392): Xaa at position 392 is Val, Ala, Gly, Leu, or Ile
  SITE (394)..(394): Xaa at position 394 is Ile, Ala, Val, Leu, or Gly
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELXAKQNPNVKMGGRYAPRDCVSPHKXXXXXPXRNRQEHXKYXXYYXXPXXQRQQXDXGXXXXNQAGDTIFNRXKXXNXGFQEXLKDYDXTCXXXSDVDXXPMNDHNAXRCFSQPRXXSVXMDKFGFSLPYVQYFGGXSXXSKQQXLTXNGXPNNYXGXGGEDDDXFNRXVFRGMSISRPNAVVGRCRMIRHSRDKKNEPNPQRFDRIAHTKETXXSDGLNSLTXQVLDVQRYPXYTQITXDXGTPS

SEQ ID NO: 334 - protein, 513 aa, Homo sapiens
  SITE (47)..(47): Xaa at position 47 is Val, Ala, Gly, Leu, or Ile
  SITE (52)..(52): Xaa at position 52 is Val, Ala, Gly, Leu, or Ile
  SITE (53)..(53): Xaa at position 53 is Val, Ala, Gly, Leu, or Ile
  SITE (54)..(54): Xaa at position 54 is Leu, Ala, Val, Gly, or Ile
  SITE (57)..(57): Xaa at position 57 is Val, Ala, Gly, Leu, or Ile
  SITE (66)..(66): Xaa at position 66 is Val, Ala, Gly, Leu, or Ile
  SITE (68)..(68): Xaa at position 68 is Phe, Tyr, Met, His, Ile, Leu, Val Ala, or Gly
  SITE (80)..(80): Xaa at position 80 is Val, Ala, Gly, Leu, or Ile
  SITE (83)..(83): Xaa at position 83 is Val, Ala, Gly, Leu, or Ile
  SITE (88)..(88): Xaa at position 88 is Ala, Gly, or Pro
  SITE (89)..(89): Xaa at position 89 is Ile, Ala, Val, Leu, or Gly
  SITE (90)..(90): Xaa at position 90 is Val, Ala, Gly, Leu, or Ile
  SITE (92)..(92): Xaa at position 92 is Val, Ala, Gly, Leu, or Ile
  SITE (106)..(106): Xaa at position 106 is Cys, Ala, Val, Gly, Ser, or Thr
  SITE (117)..(117): Xaa at position 117 is Val, Ala, Gly, Leu, or Ile
  SITE (121)..(121): Xaa at position 121 is Met, Ile, Leu, Val, Ala, or Gly
  SITE (125)..(125): Xaa at position 125 is Val, Ala, Gly, Leu, or Ile
  SITE (126)..(126): Xaa at position 126 is Phe, Tyr, Met, His, Ile, Leu, Val Ala, or Gly
  SITE (147)..(147): Xaa at position 147 is Ile, Ala, Val, Leu, or Gly
  SITE (163)..(163): Xaa at position 163 is Met, Ile, Leu, Val, Ala, or Gly
  SITE (164)..(164): Xaa at position 164 is Ile, Ala, Val, Leu, or Gly
  SITE (168)..(168): Xaa at position 168 is Ile, Ala, Val, Leu, or Gly
  SITE (171)..(171): Xaa at position 171 is Ile, Ala, Val, Leu, or Gly
  SITE (173)..(173): Xaa at position 173 is Val, Ala, Gly, Leu, or Ile
  SITE (177)..(177): Xaa at position 177 is Ile, Ala, Val, Leu, or Gly
  SITE (178)..(178): Xaa at position 178 is Ala, Gly, or Pro
  SITE (183)..(183): Xaa at position 183 is Ile, Ala, Val, Leu, or Gly
  SITE (185)..(185): Xaa at position 185 is Ile, Ala, Val, Leu, or Gly
  SITE (186)..(186): Xaa at position 186 is Phe, Tyr, Met, His, Ile, Leu, Val Ala, or Gly
  SITE (188)..(188): Xaa at position 188 is Ala, Gly, or Pro
  SITE (196)..(196): Xaa at position 196 is Ile, Ala, Val, Leu, or Gly
  SITE (197)..(197): Xaa at position 197 is Ala, Gly, or Pro
  SITE (198)..(198): Xaa at position 198 is Ala, Gly, or Pro
  SITE (200)..(200): Xaa at position 200 is Ile, Ala, Val, Leu, or Gly
  SITE (201)..(201): Xaa at position 201 is Cys, Ala, Val, Gly, Ser, or Thr
  SITE (204)..(204): Xaa at position 204 is Ala, Gly, or Pro
  SITE (206)..(206): Xaa at position 206 is Leu, Ala, Val, Gly, or Ile
  SITE (207)..(207): Xaa at position 207 is Val, Ala, Gly, Leu, or Ile
  SITE (217)..(217): Xaa at position 217 is His, Phe, Tyr, Lys, Arg, Gly, Ser Thr, Ala, Val, Leu, Ile, Asn, Met, or Gln
  SITE (222)..(222): Xaa at position 222 is Ala, Gly, or Pro
  SITE (223)..(223): Xaa at position 223 is Ile, Ala, Val, Leu, or Gly
  SITE (224)..(224): Xaa at position 224 is Val, Ala, Gly, Leu, or Ile
  SITE (225)..(225): Xaa at position 225 is Phe, Tyr, Met, His, Ile, Leu, Val Ala, or Gly
  SITE (226)..(226): Xaa at position 226 is Ala, Gly, or Pro
  SITE (227)..(227): Xaa at position 227 is Ala, Gly, or Pro
  SITE (228)..(228): Xaa at position 228 is Met, Ile, Leu, Val, Ala, or Gly
  SITE (238)..(238): Xaa at position 238 is Phe, Tyr, Met, His, Ile, Leu, Val Ala, or Gly
  SITE (242)..(242): Xaa at position 242 is Phe, Tyr, Met, His, Ile, Leu, Val Ala, or Gly
  SITE (251)..(251): Xaa at position 251 is Val, Ala, Gly, Leu, or Ile
  SITE (252)..(252): Xaa at position 252 is Cys, Ala, Val, Gly, Ser, or Thr
  SITE (253)..(253): Xaa at position 253 is Leu, Ala, Val, Gly, or Ile
  SITE (254)..(254): Xaa at position 254 is Phe, Tyr, Met, His, Ile, Leu, Val Ala, or Gly
  SITE (255)..(255): Xaa at position 255 is Leu, Ala, Val, Gly, or Ile
  SITE (266)..(266): Xaa at position 266 is Ile, Ala, Val, Leu, or Gly
  SITE (267)..(267): Xaa at position 267 is Ile, Ala, Val, Leu, or Gly
  SITE (271)..(271): Xaa at position 271 is Leu, Ala, Val, Gly, or Ile
  SITE (272)..(272): Xaa at position 272 is Ala, Gly, or Pro
  SITE (273)..(273): Xaa at position 273 is Leu, Ala, Val, Gly, or Ile
  SITE (276)..(276): Xaa at position 276 is Ala, Gly, or Pro
  SITE (278)..(278): Xaa at position 278 is Phe, Tyr, Met, His, Ile, Leu, Val Ala, or Gly
  SITE (279)..(279): Xaa at position 279 is Leu, Ala, Val, Gly, or Ile
  SITE (280)..(280): Xaa at position 280 is Ala, Gly, or Pro
  SITE (287)..(287): Xaa at position 287 is Val, Ala, Gly, Leu, or Ile
  SITE (288)..(288): Xaa at position 288 is Leu, Ala, Val, Gly, or Ile
  SITE (289)..(289): Xaa at position 289 is Val, Ala, Gly, Leu, or Ile
  SITE (290)..(290): Xaa at position 290 is Ile, Ala, Val, Leu, or Gly
  SITE (291)..(291): Xaa at position 291 is Leu, Ala, Val, Gly, or Ile
  SITE (294)..(294): Xaa at position 294 is Met, Ile, Leu, Val, Ala, or Gly
  SITE (297)..(297): Xaa at position 297 is Tyr, Phe, Met, His, Ile, Leu, Val Ala, or Gly
  SITE (298)..(298): Xaa at position 298 is Ala, Gly, or Pro
  SITE (300)..(300): Xaa at position 300 is Ala, Gly, or Pro
  SITE (301)..(301): Xaa at position 301 is Leu, Ala, Val, Gly, or Ile
  SITE (304)..(304): Xaa at position 304 is Val, Ala, Gly, Leu, or Ile
  SITE (306)..(306): Xaa at position 306 is Ala, Gly, or Pro
  SITE (307)..(307): Xaa at position 307 is Ala, Gly, or Pro
  SITE (321)..(321): Xaa at position 321 is Met, Ile, Leu, Val, Ala, or Gly
  SITE (325)..(325): Xaa at position 325 is Leu, Ala, Val, Gly, or Ile
  SITE (328)..(328): Xaa at position 328 is Ile, Ala, Val, Leu, or Gly
  SITE (329)..(329): Xaa at position 329 is Tyr, Phe, Met, His, Ile, Leu, Val Ala, or Gly
  SITE (332)..(332): Xaa at position 332 is Ala, Gly, or Pro
  SITE (335)..(335): Xaa at position 335 is Val, Ala, Gly, Leu, or Ile
  SITE (342)..(342): Xaa at position 342 is Ile, Ala, Val, Leu, or Gly
  SITE (345)..(345): Xaa at position 345 is Ile, Ala, Val, Leu, or Gly
  SITE (347)..(347): Xaa at position 347 is Ile, Ala, Val, Leu, or Gly
  SITE (348)..(348): Xaa at position 348 is Leu, Ala, Val, Gly, or Ile
  SITE (359)..(359): Xaa at position 359 is Ile, Ala, Val, Leu, or Gly
  SITE (365)..(365): Xaa at position 365 is Phe, Tyr, Met, His, Ile, Leu, Val Ala, or Gly
  SITE (371)..(371): Xaa at position 371 is Ile, Ala, Val, Leu, or Gly
  SITE (373)..(373): Xaa at position 373 is Val, Ala, Gly, Leu, or Ile
  SITE (377)..(377): Xaa at position 377 is Leu, Ala, Val, Gly, or Ile
  SITE (386)..(386): Xaa at position 386 is Ile, Ala, Val, Leu, or Gly
  SITE (388)..(388): Xaa at position 388 is Val, Ala, Gly, Leu, or Ile
  SITE (399)..(399): Xaa at position 399 is Ala, Gly, or Pro
  SITE (409)..(409): Xaa at position 409 is His, Phe, Tyr, Lys, Arg, Gly, Ser Thr, Ala, Val, Leu, Ile, Asn, Met, or Gln
  SITE (412)..(412): Xaa at position 412 is Val, Ala, Gly, Leu, or Ile
  SITE (416)..(416): Xaa at position 416 is Leu, Ala, Val, Gly, or Ile
  SITE (419)..(419): Xaa at position 419 is Cys, Ala, Val, Gly, Ser, or Thr
  SITE (420)..(420): Xaa at position 420 is Tyr, Phe, Met, His, Ile, Leu, Val Ala, or Gly
  SITE (426)..(426): Xaa at position 426 is Val, Ala, Gly, Leu, or Ile
  SITE (448)..(448): Xaa at position 448 is Phe, Tyr, Met, His, Ile, Leu, Val Ala, or Gly
  SITE (449)..(449): Xaa at position 449 is Leu, Ala, Val, Gly, or Ile
  SITE (452)..(452): Xaa at position 452 is Phe, Tyr, Met, His, Ile, Leu, Val Ala, or Gly
  SITE (456)..(456): Xaa at position 456 is Phe, Tyr, Met, His, Ile, Leu, Val Ala, or Gly
  SITE (457)..(457): Xaa at position 457 is Ile, Ala, Val, Leu, or Gly
  SITE (467)..(467): Xaa at position 467 is Val, Ala, Gly, Leu, or Ile
  SITE (471)..(471): Xaa at position 471 is Leu, Ala, Val, Gly, or Ile
  SITE (475)..(475): Xaa at position 475 is Trp, Tyr, Phe, Met, His, Ile, Leu Val, Ala, or Gly
  SITE (478)..(478): Xaa at position 478 is Leu, Ala, Val, Gly, or Ile
  SITE (481)..(481): Xaa at position 481 is Phe, Tyr, Met, His, Ile, Leu, Val Ala, or Gly
MAMEIDSRPGGLPGSSCNLGAAREHMQAVTRNYITHPRVTYRTVCSXNGPLXXXDRXKFAQYAEIXHXTLPDGTQRSGQXLEXAGTKXXXQXFEGTSGIDARKTTXEFTGDILRTPXSEDXLGRXXNGSGKPIDKGPVVMAEDFLDXNGQPINPHSRIYPEEXXQTGXSPXDXMNSXXRGQKXPXXSXAGLPHNEXXXQXXRQXGXXKKSKAVLDYXDDNFXXXXXXXGVNMETARFXKSDXEQNGTMGNXXXXXNLANDPTIERXXTPRXXXTTXEXXXYQCEKHXXXXXTDXSSXXEXXREXSXXREEVPGRRGFPGYXYTDXATXXERXGRXEGRGGSXTQXPXXTMPNDDITHPXPDLTGXITEGQXYXDRQXHNRQIYPPXNXLPSLSRLMKSXIGEGMTRKDXGDXSNQXYAXXAIGKDXQAMKAVVGEEALTSEDLLYLEXXQKXEKNXXNQGPYENRSXFESXDLGXKLXRIXPKEMLKRIPQAVIDEFYSREGALQDLAPDTAL

SEQ ID NO: 335 - protein, 257 aa, Homo sapiens
  SITE (37)..(37): Xaa at position 37 is Cys, Ala, Val, Gly, Ser, or Thr
  SITE (53)..(53): Xaa at position 53 is Leu, Ala, Val, Gly, or Ile
  SITE (57)..(57): Xaa at position 57 is Cys, Ala, Val, Gly, Ser, or Thr
  SITE (60)..(60): Xaa at position 60 is Trp, Tyr, Phe, Met, His, Ile, Leu Val, Ala, or Gly
  SITE (64)..(64): Xaa at position 64 is Ala, Gly, or Pro
  SITE (65)..(65): Xaa at position 65 is Cys, Ala, Val, Gly, Ser, or Thr
  SITE (66)..(66): Xaa at position 66 is Cys, Ala, Val, Gly, Ser, or Thr
  SITE (86)..(86): Xaa at position 86 is Trp, Tyr, Phe, Met, His, Ile, Leu Val, Ala, or Gly
  SITE (92)..(92): Xaa at position 92 is Met, Ile, Leu, Val, Ala, or Gly
  SITE (96)..(96): Xaa at position 96 is Cys, Ala, Val, Gly, Ser, or Thr
  SITE (100)..(100): Xaa at position 100 is Phe, Tyr, Met, His, Ile, Leu, Val Ala, or Gly
  SITE (105)..(105): Xaa at position 105 is Cys, Ala, Val, Gly, Ser, or Thr
  SITE (106)..(106): Xaa at position 106 is Leu, Ala, Val, Gly, or Ile
  SITE (109)..(109): Xaa at position 109 is Cys, Ala, Val, Gly, Ser, or Thr
  SITE (132)..(132): Xaa at position 132 is Val, Ala, Gly, Leu, or Ile
  SITE (134)..(134): Xaa at position 134 is Leu, Ala, Val, Gly, or Ile
  SITE (135)..(135): Xaa at position 135 is Cys, Ala, Val, Gly, Ser, or Thr
  SITE (139)..(139): Xaa at position 139 is Cys, Ala, Val, Gly, Ser, or Thr
  SITE (142)..(142): Xaa at position 142 is Trp, Tyr, Phe, Met, His, Ile, Leu Val, Ala, or Gly
  SITE (146)..(146): Xaa at position 146 is Cys, Ala, Val, Gly, Ser, or Thr
  SITE (152)..(152): Xaa at position 152 is Cys, Ala, Val, Gly, Ser, or Thr
  SITE (156)..(156): Xaa at position 156 is Trp, Tyr, Phe, Met, His, Ile, Leu Val, Ala, or Gly
  SITE (178)..(178): Xaa at position 178 is Phe, Tyr, Met, His, Ile, Leu, Val Ala, or Gly
  SITE (182)..(182): Xaa at position 182 is Phe, Tyr, Met, His, Ile, Leu, Val Ala, or Gly
  SITE (188)..(188): Xaa at position 188 is Leu, Ala, Val, Gly, or Ile
  SITE (189)..(189): Xaa at position 189 is Cys, Ala, Val, Gly, Ser, or Thr
  SITE (192)..(192): Xaa at position 192 is Ile, Ala, Val, Leu, or Gly
  SITE (197)..(197): Xaa at position 197 is Tyr, Phe, Met, His, Ile, Leu, Val Ala, or Gly
  SITE (210)..(210): Xaa at position 210 is Ile, Ala, Val, Leu, or Gly
  SITE (212)..(212): Xaa at position 212 is Met, Ile, Leu, Val, Ala, or Gly
  SITE (225)..(225): Xaa at position 225 is Val, Ala, Gly, Leu, or Ile
  SITE (226)..(226): Xaa at position 226 is Ala, Gly, or Pro
  SITE (233)..(233): Xaa at position 233 is Met, Ile, Leu, Val, Ala, or Gly
MAQRMTTQLLLLLVWVAVVGEAQTRIAWARTELLNVXMNAKHHKEKPGPEDKXHEQXRPXRKNXXXSTNTSQEAHKDVSYLYRFNXNHCGEXAPAXKRHXIQDTXXYEXSPNLGPWIQQVDQSWRKERVLNXPXXKEDXEQXWEDXRTSYTXKSNXHKGWNWTSGFNKCAVGAACQPXHFYXPTPTVXXNEXWTHSXKVSNYSRGSGRCXQXWFDPAQGNPNEEXXRFYAAAXSGAGPWAAWPFLLSLALMLLWLLS

SEQ ID NO: 336 - protein, 556 aa, Homo sapiens
  SITE (36)..(36): Xaa at position 36 is Leu, Ala, Val, Gly, or Ile
  SITE (38)..(38): Xaa at position 38 is Cys, Ala, Val, Gly, Ser, or Thr
  SITE (52)..(52): Xaa at position 52 is Trp, Tyr, Phe, Met, His, Ile, Leu Val, Ala, or Gly
  SITE (83)..(83): Xaa at position 83 is Phe, Tyr, Met, His, Ile, Leu, Val Ala, or Gly
  SITE (87)..(87): Xaa at position 87 is Val, Ala, Gly, Leu, or Ile
  SITE (94)..(94): Xaa at position 94 is Phe, Tyr, Met, His, Ile, Leu, Val Ala, or Gly
  SITE (96)..(96): Xaa at position 96 is Leu, Ala, Val, Gly, or Ile
  SITE (97)..(97): Xaa at position 97 is Cys, Ala, Val, Gly, Ser, or Thr
  SITE (113)..(113): Xaa at position 113 is Val, Ala, Gly, Leu, or Ile
  SITE (188)..(188): Xaa at position 188 is Leu, Ala, Val, Gly, or Ile
  SITE (196)..(196): Xaa at position 196 is Leu, Ala, Val, Gly, or Ile
  SITE (198)..(198): Xaa at position 198 is Leu, Ala, Val, Gly, or Ile
  SITE (200)..(200): Xaa at position 200 is Cys, Ala, Val, Gly, Ser, or Thr
  SITE (214)..(214): Xaa at position 214 is Trp, Tyr, Phe, Met, His, Ile, Leu Val, Ala, or Gly
  SITE (225)..(225): Xaa at position 225 is Leu, Ala, Val, Gly, or Ile
  SITE (228)..(228): Xaa at position 228 is Leu, Ala, Val, Gly, or Ile
  SITE (240)..(240): Xaa at position 240 is Trp, Tyr, Phe, Met, His, Ile, Leu Val, Ala, or Gly
  SITE (246)..(246): Xaa at position 246 is Leu, Ala, Val, Gly, or Ile
  SITE (248)..(248): Xaa at position 248 is Leu, Ala, Val, Gly, or Ile
  SITE (281)..(281): Xaa at position 281 is Trp, Tyr, Phe, Met, His, Ile, Leu Val, Ala, or Gly
  SITE (283)..(283): Xaa at position 283 is Trp, Tyr, Phe, Met, His, Ile, Leu Val, Ala, or Gly
  SITE (284)..(284): Xaa at position 284 is Leu, Ala, Val, Gly, or Ile
  SITE (290)..(290): Xaa at position 290 is Trp, Tyr, Phe, Met, His, Ile, Leu Val, Ala, or Gly
MPPPRLLFFLLFLTPMEVRPEEPLVVKVEEGDNAVXQXLKGTSDGPTQQLTXSRESPLKPFLKLSLGLPGLGIHMRPLAIWLXIFNXSQQMGGXYXXQPGPPSEKAWQPGWTXNVEGSGELFRWNVSDLGGLGCGLKNRSSEGPSSPSGKLMSPKLYVWAKDRPEIWEGEPPCLPPRDSLNQSLSQDXTMAPGSTXWXSXGVPPDSVSRGPLSXTHVHPKGPKSXLSXELKDDRPARDMXVMETGXLXPRATAQDAGKYYCHRGNLTMSFHLEITARPVLXHXXLRTGGXKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLGSQSYEDMRGILYAAPQLRSIRGQPGPNHEEDADSYENMDNPDGPDPAWGGGGRMGTWSTR

SEQ ID NO: 337 - protein, 400 aa, Homo sapiens
  SITE (47)..(47): Xaa at position 47 is Leu, Ala, Val, Gly, or Ile
  SITE (60)..(60): Xaa at position 60 is Cys, Ala, Val, Gly, Ser, or Thr
  SITE (62)..(62): Xaa at position 62 is Leu, Ala, Val, Gly, or Ile
  SITE (81)..(81): Xaa at position 81 is Cys, Ala, Val, Gly, Ser, or Thr
  SITE (94)..(94): Xaa at position 94 is Phe, Tyr, Met, His, Ile, Leu, Val Ala, or Gly
  SITE (96)..(96): Xaa at position 96 is Val, Ala, Gly, Leu, or Ile
  SITE (128)..(128): Xaa at position 128 is Ile, Ala, Val, Leu, or Gly
  SITE (134)..(134): Xaa at position 134 is Met, Ile, Leu, Val, Ala, or Gly
  SITE (136)..(136): Xaa at position 136 is Cys, Ala, Val, Gly, Ser, or Thr
  SITE (150)..(150): Xaa at position 150 is Tyr, Phe, Met, His, Ile, Leu, Val Ala, or Gly
  SITE (152)..(152): Xaa at position 152 is Leu, Ala, Val, Gly, or Ile
  SITE (178)..(178): Xaa at position 178 is Cys, Ala, Val, Gly, Ser, or Thr
  SITE (192)..(192): Xaa at position 192 is Phe, Tyr, Met, His, Ile, Leu, Val Ala, or Gly
  SITE (194)..(194): Xaa at position 194 is Val, Ala, Gly, Leu, or Ile
  SITE (233)..(233): Xaa at position 233 is Cys, Ala, Val, Gly, Ser, or Thr
  SITE (237)..(237): Xaa at position 237 is Trp, Tyr, Phe, Met, His, Ile, Leu Val, Ala, or Gly
  SITE (251)..(251): Xaa at position 251 is Phe, Tyr, Met, His, Ile, Leu, Val Ala, or Gly
  SITE (253)..(253): Xaa at position 253 is Tyr, Phe, Met, His, Ile, Leu, Val Ala, or Gly
  SITE (255)..(255): Xaa at position 255 is Leu, Ala, Val, Gly, or Ile
  SITE (257)..(257): Xaa at position 257 is Val, Ala, Gly, Leu, or Ile
  SITE (270)..(270): Xaa at position 270 is Leu, Ala, Val, Gly, or Ile
  SITE (294)..(294): Xaa at position 294 is Val, Ala, Gly, Leu, or Ile
  SITE (296)..(296): Xaa at position 296 is Ile, Ala, Val, Leu, or Gly
  SITE (298)..(298): Xaa at position 298 is Ala, Gly, or Pro
  SITE (299)..(299): Xaa at position 299 is Ala, Gly, or Pro
MLLLVTSLLLCELPHPAFLLIPEKSDLRTVAPASSLNVRFDSRTMNXSWDCQENTTFSKXFXTDKKNRVVEPRLSNNECSXTFREICLHEGVTXEXHVNTSQRGFQQKLLYPNSGREGTAAQNFSCFXYNADLXNXTWARGPTAPRDVQXFXYIRNSKRRREIRCPYYIQDSGTHVGXHLDNLSGLTSRNYXLXNGTSREIGIQFFDSLLDTKKIERFNPPSNVTVRCNTTHXLVRXKQPRTYQKLSYLDXQXQXDXHRKNTQPGTENLXINVSGDLENRYNFPSSEPRAKHSXKXRXXDVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 338 - protein, 392 aa, Homo sapiens
  SITE (80)..(80): Xaa at position 80 is Cys, Ala, Val, Gly, Ser, or Thr
  SITE (93)..(93): Xaa at position 93 is Ala, Gly, or Pro
  SITE (123)..(123): Xaa at position 123 is Met, Ile, Leu, Val, Ala, or Gly
  SITE (125)..(125): Xaa at position 125 is Phe, Tyr, Met, His, Ile, Leu, Val Ala, or Gly
  SITE (139)..(139): Xaa at position 139 is Leu, Ala, Val, Gly, or Ile
  SITE (141)..(141): Xaa at position 141 is Cys, Ala, Val, Gly, Ser, or Thr
  SITE (148)..(148): Xaa at position 148 is Ala, Gly, or Pro
  SITE (160)..(160): Xaa at position 160 is Val, Ala, Gly, Leu, or Ile
  SITE (187)..(187): Xaa at position 187 is Val, Ala, Gly, Leu, or Ile
  SITE (208)..(208): Xaa at position 208 is Ile, Ala, Val, Leu, or Gly
  SITE (210)..(210): Xaa at position 210 is Cys, Ala, Val, Gly, Ser, or Thr
  SITE (226)..(226): Xaa at position 226 is Val, Ala, Gly, Leu, or Ile
  SITE (252)..(252): Xaa at position 252 is Val, Ala, Gly, Leu, or Ile
  SITE (268)..(268): Xaa at position 268 is Ile, Ala, Val, Leu, or Gly
  SITE (270)..(270): Xaa at position 270 is Cys, Ala, Val, Gly, Ser, or Thr
  SITE (283)..(283): Xaa at position 283 is Cys, Ala, Val, Gly, Ser, or Thr
MEPPGRRECPFPSWRFPGLLLAAMVLLLYSFSDACEEPPTFEAMELIGKPKPYYEIGERVDYKCKKGYFYIPPLATHTIXDRNHTWLPVSDDXCYRETCPYIRDPLNGQAVPANGTYEFGYQXHXICNEGYYLIGEEIXYXELKGSVXIWSGKPPICEKXLCTPPPKIKNGKHTFSEVEVFEYLDAXTYSCDPAPGPDPFSLIGESTXYXGDNSVWSRAAPECKVXKCRFPVVENGKQISGFGKKFYYKATXMFECDKGFYLDGSDTXVXDSNSTWDPPVPKXLKVLPPSSTKPPALSHSVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 339 - protein, 232 aa, Homo sapiens
  SITE (52)..(52): Xaa at position 52 is Cys, Ala, Val, Gly, Ser, or Thr
  SITE (61)..(61): Xaa at position 61 is Ile, Ala, Val, Leu, or Gly
  SITE (72)..(72): Xaa at position 72 is Ile, Ala, Val, Leu, or Gly
  SITE (73)..(73): Xaa at position 73 is Phe, Tyr, Met, His, Ile, Leu, Val Ala, or Gly
  SITE (78)..(78): Xaa at position 78 is Val, Ala, Gly, Leu, or Ile
  SITE (80)..(80): Xaa at position 80 is Leu, Ala, Val, Gly, or Ile
  SITE (92)..(92): Xaa at position 92 is Leu, Ala, Val, Gly, or Ile
  SITE (106)..(106): Xaa at position 106 is Ile, Ala, Val, Leu, or Gly
  SITE (122)..(122): Xaa at position 122 is Phe, Tyr, Met, His, Ile, Leu, Val Ala, or Gly
  SITE (213)..(213): Xaa at position 213 is Cys, Ala, Val, Gly, Ser, or Thr
  SITE (225)..(225): Xaa at position 225 is Cys, Ala, Val, Gly, Ser, or Thr
MNFLLSWVHWSLALLLYLHHAKWSQAAPMAEGGGQNHHEVVKFMDVYQRSYXHPIETLVDXFQEYPDEIEYXXKPSCXPXMRCGGCCNDEGXECVPTEESNITMQXMRIKPHQGQHIGEMSXLQHNKCECRPKKDRARQEKKSVRGKGKGQKRKRKKSRYKSWSVYVGARCCLMPWSLPGPHPCGPCSERRKHLFVQDPQTCKCSCKNTDSRXKARQLELNERTXRCDKPRR

SEQ ID NO: 340 - protein, 213 aa, Homo sapiens
  SITE (67)..(67): Xaa at position 67 is Trp, Tyr, Phe, Met, His, Ile, Leu Val, Ala, or Gly
  SITE (82)..(82): Xaa at position 82 is Cys, Ala, Val, Gly, Ser, or Thr
  SITE (97)..(97): Xaa at position 97 is Val, Ala, Gly, Leu, or Ile
  SITE (104)..(104): Xaa at position 104 is Leu, Ala, Val, Gly, or Ile
  SITE (106)..(106): Xaa at position 106 is Val, Ala, Gly, Leu, or Ile
  SITE (107)..(107): Xaa at position 107 is Leu, Ala, Val, Gly, or Ile
  SITE (116)..(116): Xaa at position 116 is Val, Ala, Gly, Leu, or Ile
  SITE (128)..(128): Xaa at position 128 is Ala, Gly, or Pro
  SITE (131)..(131): Xaa at position 131 is Ala, Gly, or Pro
  SITE (133)..(133): Xaa at position 133 is Leu, Ala, Val, Gly, or Ile
  SITE (135)..(135): Xaa at position 135 is Cys, Ala, Val, Gly, Ser, or Thr
  SITE (136)..(136): Xaa at position 136 is Leu, Ala, Val, Gly, or Ile
  SITE (137)..(137): Xaa at position 137 is Met, Ile, Leu, Val, Ala, or Gly
  SITE (140)..(140): Xaa at position 140 is Phe, Tyr, Met, His, Ile, Leu, Val Ala, or Gly
  SITE (141)..(141): Xaa at position 141 is Tyr, Phe, Met, His, Ile, Leu, Val Ala, or Gly
  SITE (145)..(145): Xaa at position 145 is Leu, Ala, Val, Gly, or Ile
  SITE (147)..(147): Xaa at position 147 is Val, Ala, Gly, Leu, or Ile
  SITE (149)..(149): Xaa at position 149 is Trp, Tyr, Phe, Met, His, Ile, Leu Val, Ala, or Gly
  SITE (151)..(151): Xaa at position 151 is Ala, Gly, or Pro
  SITE (174)..(174): Xaa at position 174 is Ala, Gly, or Pro
  SITE (175)..(175): Xaa at position 175 is Ala, Gly, or Pro
  SITE (179)..(179): Xaa at position 179 is Leu, Ala, Val, Gly, or Ile
  SITE (181)..(181): Xaa at position 181 is Leu, Ala, Val, Gly, or Ile
  SITE (192)..(192): Xaa at position 192 is Tyr, Phe, Met, His, Ile, Leu, Val Ala, or Gly
  SITE (194)..(194): Xaa at position 194 is Cys, Ala, Val, Gly, Ser, or Thr
  SITE (196)..(196): Xaa at position 196 is Val, Ala, Gly, Leu, or Ile
  SITE (198)..(198): Xaa at position 198 is His, Phe, Tyr, Lys, Arg, Gly, Ser Thr, Ala, Val, Leu, Ile, Asn, Met, or Gln
  SITE (203)..(203): Xaa at position 203 is Val, Ala, Gly, Leu, or Ile
MRPGTGQGGLEAPGEPGPNLRQRWPLLLLGLAVVTHGLLRPTAASQSRALGPGAPGGSSRSSLRSRXGRFLLQRGSWTGPRXWPRGFQSKHNSVTHXFGSGTQXTXXSQPKATPSXTLFPPSSEELQXNKXTXVXXXNDXXPGIXTXTXKXDGTPITQGVEMTTPSKQSNNKYXXSSYXSXTPEQWRSRRSXSXQXMXEGSTXEKTVAPAECS

SEQ ID NO: 341 - protein, 533 aa, Homo sapiens
  SITE (47)..(47): Xaa at position 47 is Leu, Ala, Val, Gly, or Ile
  SITE (48)..(48): Xaa at position 48 is Val, Ala, Gly, Leu, or Ile
  SITE (49)..(49): Xaa at position 49 is Phe, Tyr, Met, His, Ile, Leu, Val Ala, or Gly
  SITE (50)..(50): Xaa at position 50 is Leu, Ala, Val, Gly, or Ile
  SITE (51)..(51): Xaa at position 51 is Leu, Ala, Val, Gly, or Ile
  SITE (52)..(52): Xaa at position 52 is Ala, Gly, or Pro
  SITE (55)..(55): Xaa at position 55 is Leu, Ala, Val, Gly, or Ile
  SITE (60)..(60): Xaa at position 60 is Val, Ala, Gly, Leu, or Ile
  SITE (72)..(72): Xaa at position 72 is Leu, Ala, Val, Gly, or Ile
  SITE (80)..(80): Xaa at position 80 is Val, Ala, Gly, Leu, or Ile
  SITE (85)..(85): Xaa at position 85 is Tyr, Phe, Met, His, Ile, Leu, Val Ala, or Gly
  SITE (86)..(86): Xaa at position 86 is Tyr, Phe, Met, His, Ile, Leu, Val Ala, or Gly
  SITE (98)..(98): Xaa at position 98 is Leu, Ala, Val, Gly, or Ile
  SITE (105)..(105): Xaa at position 105 is Ile, Ala, Val, Leu, or Gly
  SITE (122)..(122): Xaa at position 122 is Val, Ala, Gly, Leu, or Ile
  SITE (128)..(128): Xaa at position 128 is Leu, Ala, Val, Gly, or Ile
  SITE (132)..(132): Xaa at position 132 is Leu, Ala, Val, Gly, or Ile
  SITE (133)..(133): Xaa at position 133 is Leu, Ala, Val, Gly, or Ile
  SITE (142)..(142): Xaa at position 142 is Met, Ile, Leu, Val, Ala, or Gly
  SITE (143)..(143): Xaa at position 143 is Val, Ala, Gly, Leu, or Ile
  SITE (146)..(146): Xaa at position 146 is Trp, Tyr, Phe, Met, His, Ile, Leu Val, Ala, or Gly
  SITE (148)..(148): Xaa at position 148 is Leu, Ala, Val, Gly, or Ile
  SITE (155)..(155): Xaa at position 155 is Cys, Ala, Val, Gly, Ser, or Thr
  SITE (168)..(168): Xaa at position 168 is Tyr, Phe, Met, His, Ile, Leu, Val Ala, or Gly
  SITE (169)..(169): Xaa at position 169 is Leu, Ala, Val, Gly, or Ile
  SITE (175)..(175): Xaa at position 175 is Tyr, Phe, Met, His, Ile, Leu, Val Ala, or Gly
  SITE (178)..(178): Xaa at position 178 is His, Phe, Tyr, Lys, Arg, Gly, Ser Thr, Ala, Val, Leu, Ile, Asn, Met, or Gln
  SITE (184)..(184): Xaa at position 184 is Ile, Ala, Val, Leu, or Gly
  SITE (193)..(193): Xaa at position 193 is Ala, Gly, or Pro
  SITE (196)..(196): Xaa at position 196 is Phe, Tyr, Met, His, Ile, Leu, Val Ala, or Gly
  SITE (215)..(215): Xaa at position 215 is Phe, Tyr, Met, His, Ile, Leu, Val Ala, or Gly
  SITE (219)..(219): Xaa at position 219 is Ala, Gly, or Pro
  SITE (232)..(232): Xaa at position 232 is Leu, Ala, Val, Gly, or Ile
  SITE (233)..(233): Xaa at position 233 is Phe, Tyr, Met, His, Ile, Leu, Val Ala, or Gly
  SITE (234)..(234): Xaa at position 234 is Leu, Ala, Val, Gly, or Ile
  SITE (236)..(236): Xaa at position 236 is Leu, Ala, Val, Gly, or Ile
  SITE (237)..(237): Xaa at position 237 is Ala, Gly, or Pro
  SITE (238)..(238): Xaa at position 238 is Leu, Ala, Val, Gly, or Ile
  SITE (241)..(241): Xaa at position 241 is Val, Ala, Gly, Leu, or Ile
  SITE (255)..(255): Xaa at position 255 is Tyr, Phe, Met, His, Ile, Leu, Val Ala, or Gly
  SITE (266)..(266): Xaa at position 266 is Tyr, Phe, Met, His, Ile, Leu, Val Ala, or Gly
  SITE (267)..(267): Xaa at position 267 is Ala, Gly, or Pro
  SITE (269)..(269): Xaa at position 269 is Met, Ile, Leu, Val, Ala, or Gly
  SITE (270)..(270): Xaa at position 270 is Val, Ala, Gly, Leu, or Ile
  SITE (273)..(273): Xaa at position 273 is Met, Ile, Leu, Val, Ala, or Gly
  SITE (277)..(277): Xaa at position 277 is Val, Ala, Gly, Leu, or Ile
  SITE (280)..(280): Xaa at position 280 is Val, Ala, Gly, Leu, or Ile
  SITE (284)..(284): Xaa at position 284 is Leu, Ala, Val, Gly, or Ile
  SITE (294)..(294): Xaa at position 294 is Val, Ala, Gly, Leu, or Ile
  SITE (295)..(295): Xaa at position 295 is Phe, Tyr, Met, His, Ile, Leu, Val Ala, or Gly
  SITE (296)..(296): Xaa at position 296 is Ile, Ala, Val, Leu, or Gly
  SITE (297)..(297): Xaa at position 297 is Phe, Tyr, Met, His, Ile, Leu, Val Ala, or Gly
  SITE (321)..(321): Xaa at position 321 is Leu, Ala, Val, Gly, or Ile
  SITE (326)..(326): Xaa at position 326 is Val, Ala, Gly, Leu, or Ile
  SITE (329)..(329): Xaa at position 329 is Val, Ala, Gly, Leu, or Ile
  SITE (331)..(331): Xaa at position 331 is Phe, Tyr, Met, His, Ile, Leu, Val Ala, or Gly
  SITE (332)..(332): Xaa at position 332 is Val, Ala, Gly, Leu, or Ile
  SITE (348)..(348): Xaa at position 348 is Ile, Ala, Val, Leu, or Gly
  SITE (349)..(349): Xaa at position 349 is His, Phe, Tyr, Lys, Arg, Gly, Ser Thr, Ala, Val, Leu, Ile, Asn, Met, or Gln
  SITE (350)..(350): Xaa at position 350 is Ile, Ala, Val, Leu, or Gly
  SITE (354)..(354): Xaa at position 354 is Leu, Ala, Val, Gly, or Ile
  SITE (357)..(357): Xaa at position 357 is Leu, Ala, Val, Gly, or Ile
  SITE (361)..(361): Xaa at position 361 is Ala, Gly, or Pro
  SITE (376)..(376): Xaa at position 376 is Val, Ala, Gly, Leu, or Ile
  SITE (380)..(380): Xaa at position 380 is Ile, Ala, Val, Leu, or Gly
  SITE (389)..(389): Xaa at position 389 is Ile, Ala, Val, Leu, or Gly
  SITE (391)..(391): Xaa at position 391 is Leu, Ala, Val, Gly, or Ile
  SITE (392)..(392): Xaa at position 392 is Leu, Ala, Val, Gly, or Ile
  SITE (431)..(431): Xaa at position 431 is Ala, Gly, or Pro
  SITE (432)..(432): Xaa at position 432 is Ala, Gly, or Pro
  SITE (433)..(433): Xaa at position 433 is Ile, Ala, Val, Leu, or Gly
  SITE (440)..(440): Xaa at position 440 is Leu, Ala, Val, Gly, or Ile
  SITE (441)..(441): Xaa at position 441 is Leu, Ala, Val, Gly, or Ile
  SITE (447)..(447): Xaa at position 447 is Cys, Ala, Val, Gly, Ser, or Thr
  SITE (474)..(474): Xaa at position 474 is Leu, Ala, Val, Gly, or Ile
  SITE (475)..(475): Xaa at position 475 is Phe, Tyr, Met, His, Ile, Leu, Val Ala, or Gly
  SITE (498)..(498): Xaa at position 498 is Leu, Ala, Val, Gly, or Ile
  SITE (502)..(502): Xaa at position 502 is Leu, Ala, Val, Gly, or Ile
  SITE (529)..(529): Xaa at position 529 is Trp, Tyr, Phe, Met, His, Ile, Leu Val, Ala, or Gly
MGPRGAASLPRGPGPRRLLLPVVLPLLLLLLLAPPGSGAGASRPPHXXXXXXDDXGWNDXGFHGSRIRTPHXDALAAGGXLLDNXXTQPLCTPSRSQXLTGRYQXRTGLQHQIIWPCQPSCXPLDEKXLPQXXKEAGYTTHXXGKXHXGMYRKEXLPTRRGFDTYFGXXLGSEDXYSXERCTLXDALNVTRCXLDXRDGEEVATGYKNMYSTNIXTKRXIALITNHPPEKPXXXYXXXQSXHEPLQVPEEYLKPXDFIQDKNRHHXXGXXSLXDEAXGNXTAAXKSSGLWNNTXXXXSTDNGGQTLAGGNNWPLRGRKWSXWEGGXRGXGXXASPLLKQKGVKNRELXXXSDWXPTXVKLXRGHTNGTKPLDGFDXWKTXSEGSPSPRXEXXHNIDPNFVDSSPCPRNSMAPAKDDSSLPEYSAFNTSVHXXXRHGNWKXXTGYPGXGYWFPPPSQYNVSEIPSSDPPTKTLWXXDIDRDPEERHDLSREYPHIVTKXLSRXQFYHKHSVPVYFPAQDPRCDPKATGVXGPWM

SEQ ID NO: 342 - protein, 406 aa, Homo sapiens
  SITE (109)..(109): Xaa at position 109 is Leu, Ala, Val, Gly, or Ile
  SITE (144)..(144): Xaa at position 144 is Leu, Ala, Val, Gly, or Ile
  SITE (160)..(160): Xaa at position 160 is Phe, Tyr, Met, His, Ile, Leu, Val Ala, or Gly
  SITE (165)..(165): Xaa at position 165 is Trp, Tyr, Phe, Met, His, Ile, Leu Val, Ala, or Gly
  SITE (178)..(178): Xaa at position 178 is Ala, Gly, or Pro
  SITE (184)..(184): Xaa at position 184 is Cys, Ala, Val, Gly, Ser, or Thr
  SITE (185)..(185): Xaa at position 185 is Ala, Gly, or Pro
  SITE (187)..(187): Xaa at position 187 is Val, Ala, Gly, Leu, or Ile
  SITE (193)..(193): Xaa at position 193 is Leu, Ala, Val, Gly, or Ile
  SITE (202)..(202): Xaa at position 202 is Ile, Ala, Val, Leu, or Gly
  SITE (207)..(207): Xaa at position 207 is Ala, Gly, or Pro
  SITE (208)..(208): Xaa at position 208 is Val, Ala, Gly, Leu, or Ile
  SITE (209)..(209): Xaa at position 209 is Leu, Ala, Val, Gly, or Ile
  SITE (214)..(214): Xaa at position 214 is Ala, Gly, or Pro
  SITE (223)..(223): Xaa at position 223 is Val, Ala, Gly, Leu, or Ile
  SITE (229)..(229): Xaa at position 229 is Ile, Ala, Val, Leu, or Gly
  SITE (231)..(231): Xaa at position 231 is Leu, Ala, Val, Gly, or Ile
  SITE (232)..(232): Xaa at position 232 is Met, Ile, Leu, Val, Ala, or Gly
  SITE (243)..(243): Xaa at position 243 is Phe, Tyr, Met, His, Ile, Leu, Val Ala, or Gly
  SITE (254)..(254): Xaa at position 254 is Leu, Ala, Val, Gly, or Ile
  SITE (255)..(255): Xaa at position 255 is Ile, Ala, Val, Leu, or Gly
  SITE (256)..(256): Xaa at position 256 is Val, Ala, Gly, Leu, or Ile
  SITE (269)..(269): Xaa at position 269 is Trp, Tyr, Phe, Met, His, Ile, Leu Val, Ala, or Gly
  SITE (277)..(277): Xaa at position 277 is Phe, Tyr, Met, His, Ile, Leu, Val Ala, or Gly
  SITE (281)..(281): Xaa at position 281 is Tyr, Phe, Met, His, Ile, Leu, Val Ala, or Gly
  SITE (284)..(284): Xaa at position 284 is Tyr, Phe, Met, His, Ile, Leu, Val Ala, or Gly
  SITE (293)..(293): Xaa at position 293 is Phe, Tyr, Met, His, Ile, Leu, Val Ala, or Gly
  SITE (295)..(295): Xaa at position 295 is Ile, Ala, Val, Leu, or Gly
  SITE (296)..(296): Xaa at position 296 is Leu, Ala, Val, Gly, or Ile
  SITE (300)..(300): Xaa at position 300 is Met, Ile, Leu, Val, Ala, or Gly
  SITE (304)..(304): Xaa at position 304 is Leu, Ala, Val, Gly, or Ile
  SITE (308)..(308): Xaa at position 308 is Leu, Ala, Val, Gly, or Ile
  SITE (325)..(325): Xaa at position 325 is Met, Ile, Leu, Val, Ala, or Gly
  SITE (326)..(326): Xaa at position 326 is Leu, Ala, Val, Gly, or Ile
  SITE (328)..(328): Xaa at position 328 is Ile, Ala, Val, Leu, or Gly
  SITE (329)..(329): Xaa at position 329 is Ile, Ala, Val, Leu, or Gly
  SITE (330)..(330): Xaa at position 330 is Ile, Ala, Val, Leu, or Gly
  SITE (331)..(331): Xaa at position 331 is Met, Ile, Leu, Val, Ala, or Gly
  SITE (332)..(332): Xaa at position 332 is Met, Ile, Leu, Val, Ala, or Gly
  SITE (335)..(335): Xaa at position 335 is Cys, Ala, Val, Gly, Ser, or Thr
  SITE (338)..(338): Xaa at position 338 is Val, Ala, Gly, Leu, or Ile
  SITE (340)..(340): Xaa at position 340 is Ile, Ala, Val, Leu, or Gly
  SITE (341)..(341): Xaa at position 341 is Tyr, Phe, Met, His, Ile, Leu, Val Ala, or Gly
  SITE (344)..(344): Xaa at position 344 is Leu, Ala, Val, Gly, or Ile
  SITE (369)..(369): Xaa at position 369 is Tyr, Phe, Met, His, Ile, Leu, Val Ala, or Gly
  SITE (378)..(378): Xaa at position 378 is Leu, Ala, Val, Gly, or Ile
  SITE (379)..(379): Xaa at position 379 is Val, Ala, Gly, Leu, or Ile
  SITE (382)..(382): Xaa at position 382 is Leu, Ala, Val, Gly, or Ile
  SITE (390)..(390): Xaa at position 390 is Ile, Ala, Val, Leu, or Gly
  SITE (392)..(392): Xaa at position 392 is Leu, Ala, Val, Gly, or Ile
  SITE (396)..(396): Xaa at position 396 is Ala, Gly, or Pro
  SITE (398)..(398): Xaa at position 398 is Leu, Ala, Val, Gly, or Ile
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRXQKIWKNYLSMNKYKVSYKGPGPGIKFSAEALRCHXRDHVNVSMVEVTDFPXNTSEXEGYLPKESIRTKXGPWGRXXVXSSAGSXKSSQLGREXDDHDXXXRFNGXPTANFQQDXGTKTTXRXXNSQLVTTEKRXLKDSLYNEGIXXXWDPSVYHSDIPKXYQNPDYNXFNNXKTXRKLHPNQPXYXXKPQXPWEXWDIXQEISPEEIQPNPPSSGXXGXXXXXTLXDQXDXXEFXPSKRKTDVCYYYQKFFDSACTMGAXHPLLYEKNXXKHXNQGTDEDXYXLGKXTXPGFRTIHC

SEQ ID NO: 343 - protein, 2871 aa, Homo sapiens
  SITE (191)..(191): Xaa at position 191 is Cys, Ala, Val, Gly, Ser, or Thr
  SITE (195)..(195): Xaa at position 195 is Met, Ile, Leu, Val, Ala, or Gly
  SITE (214)..(214): Xaa at position 214 is Val, Ala, Gly, Leu, or Ile
  SITE (228)..(228): Xaa at position 228 is Ile, Ala, Val, Leu, or Gly
  SITE (235)..(235): Xaa at position 235 is Leu, Ala, Val, Gly, or Ile
  SITE (247)..(247): Xaa at position 247 is Ala, Gly, or Pro
  SITE (251)..(251): Xaa at position 251 is Leu, Ala, Val, Gly, or Ile
  SITE (255)..(255): Xaa at position 255 is Tyr, Phe, Met, His, Ile, Leu, Val Ala, or Gly
  SITE (258)..(258): Xaa at position 258 is Leu, Ala, Val, Gly, or Ile
  SITE (275)..(275): Xaa at position 275 is Ile, Ala, Val, Leu, or Gly
  SITE (312)..(312): Xaa at position 312 is Phe, Tyr, Met, His, Ile, Leu, Val Ala, or Gly
  SITE (343)..(343): Xaa at position 343 is Ala, Gly, or Pro
  SITE (347)..(347): Xaa at position 347 is Ile, Ala, Val, Leu, or Gly
  SITE (364)..(364): Xaa at position 364 is Ile, Ala, Val, Leu, or Gly
  SITE (367)..(367): Xaa at position 367 is Cys, Ala, Val, Gly, Ser, or Thr
  SITE (368)..(368): Xaa at position 368 is Ile, Ala, Val, Leu, or Gly
  SITE (371)..(371): Xaa at position 371 is His, Phe, Tyr, Lys, Arg, Gly, Ser Thr, Ala, Val, Leu, Ile, Asn, Met, or Gln
  SITE (381)..(381): Xaa at position 381 is Phe, Tyr, Met, His, Ile, Leu, Val Ala, or Gly
  SITE (385)..(385): Xaa at position 385 is Ala, Gly, or Pro
  SITE (403)..(403): Xaa at position 403 is Tyr, Phe, Met, His, Ile, Leu, Val Ala, or Gly
  SITE (414)..(414): Xaa at position 414 is Leu, Ala, Val, Gly, or Ile
  SITE (421)..(421): Xaa at position 421 is Leu, Ala, Val, Gly, or Ile
  SITE (446)..(446): Xaa at position 446 is Val, Ala, Gly, Leu, or Ile
  SITE (463)..(463): Xaa at position 463 is Leu, Ala, Val, Gly, or Ile
  SITE (467)..(467): Xaa at position 467 is Cys, Ala, Val, Gly, Ser, or Thr
  SITE (476)..(476): Xaa at position 476 is Val, Ala, Gly, Leu, or Ile
  SITE (482)..(482): Xaa at position 482 is Cys, Ala, Val, Gly, Ser, or Thr
  SITE (493)..(493): Xaa at position 493 is Trp, Tyr, Phe, Met, His, Ile, Leu Val, Ala, or Gly
  SITE (495)..(495): Xaa at position 495 is Val, Ala, Gly, Leu, or Ile
  SITE (508)..(508): Xaa at position 508 is Val, Ala, Gly, Leu, or Ile
  SITE (510)..(510): Xaa at position 510 is Leu, Ala, Val, Gly, or Ile
  SITE (512)..(512): Xaa at position 512 is Ile, Ala, Val, Leu, or Gly
  SITE (519)..(519): Xaa at position 519 is Ala, Gly, or Pro
  SITE (526)..(526): Xaa at position 526 is Ile, Ala, Val, Leu, or Gly
  SITE (544)..(544): Xaa at position 544 is Met, Ile, Leu, Val, Ala, or Gly
  SITE (547)..(547): Xaa at position 547 is Leu, Ala, Val, Gly, or Ile
  SITE (553)..(553): Xaa at position 553 is Cys, Ala, Val, Gly, Ser, or Thr
  SITE (560)..(560): Xaa at position 560 is Ile, Ala, Val, Leu, or Gly
  SITE (562)..(562): Xaa at position 562 is Ala, Gly, or Pro
  SITE (568)..(568): Xaa at position 568 is Leu, Ala, Val, Gly, or Ile
  SITE (623)..(623): Xaa at position 623 is Val, Ala, Gly, Leu, or Ile
  SITE (1975)..(1975): Xaa at position 1975 is Val, Ala, Gly, Leu, or Ile
  SITE (1977)..(1977): Xaa at position 1977 is Ala, Gly, or Pro
  SITE (1980)..(1980): Xaa at position 1980 is Leu, Ala, Val, Gly, or Ile
  SITE (1983)..(1983): Xaa at position 1983 is Cys, Ala, Val, Gly, Ser, or Thr
  SITE (2004)..(2004): Xaa at position 2004 is Val, Ala, Gly, Leu, or Ile
  SITE (2018)..(2018): Xaa at position 2018 is Ile, Ala, Val, Leu, or Gly
  SITE (2019)..(2019): Xaa at position 2019 is Ala, Gly, or Pro
  SITE (2021)..(2021): Xaa at position 2021 is Ala, Gly, or Pro
  SITE (2031)..(2031): Xaa at position 2031 is Leu, Ala, Val, Gly, or Ile
  SITE (2034)..(2034): Xaa at position 2034 is Ala, Gly, or Pro
  SITE (2048)..(2048): Xaa at position 2048 is Leu, Ala, Val, Gly, or Ile
  SITE (2051)..(2051): Xaa at position 2051 is Ala, Gly, or Pro
  SITE (2053)..(2053): Xaa at position 2053 is Ala, Gly, or Pro
  SITE (2054)..(2054): Xaa at position 2054 is Ala, Gly, or Pro
  SITE (2058)..(2058): Xaa at position 2058 is Ile, Ala, Val, Leu, or Gly
  SITE (2069)..(2069): Xaa at position 2069 is Val, Ala, Gly, Leu, or Ile
  SITE (2072)..(2072): Xaa at position 2072 is Ala, Gly, or Pro
  SITE (2086)..(2086): Xaa at position 2086 is Ile, Ala, Val, Leu, or Gly
  SITE (2089)..(2089): Xaa at position 2089 is Ala, Gly, or Pro
  SITE (2092)..(2092): Xaa at position 2092 is Ala, Gly, or Pro
  SITE (2110)..(2110): Xaa at position 2110 is Ala, Gly, or Pro
  SITE (2122)..(2122): Xaa at position 2122 is Met, Ile, Leu, Val, Ala, or Gly
  SITE (2124)..(2124): Xaa at position 2124 is Leu, Ala, Val, Gly, or Ile
  SITE (2125)..(2125): Xaa at position 2125 is Leu, Ala, Val, Gly, or Ile
  SITE (2127)..(2127): Xaa at position 2127 is Ala, Gly, or Pro
  SITE (2134)..(2134): Xaa at position 2134 is Val, Ala, Gly, Leu, or Ile
  SITE (2141)..(2141): Xaa at position 2141 is Val, Ala, Gly, Leu, or Ile
  SITE (2142)..(2142): Xaa at position 2142 is Phe, Tyr, Met, His, Ile, Leu Val, Ala, or Gly
  SITE (2143)..(2143): Xaa at position 2143 is Leu, Ala, Val, Gly, or Ile
  SITE (2148)..(2148): Xaa at position 2148 is Ala, Gly, or Pro
  SITE (2172)..(2172): Xaa at position 2172 is Phe, Tyr, Met, His, Ile, Leu Val, Ala, or Gly
  SITE (2183)..(2183): Xaa at position 2183 is Tyr, Phe, Met, His, Ile, Leu Val, Ala, or Gly
  SITE (2186)..(2186): Xaa at position 2186 is Leu, Ala, Val, Gly, or Ile
  SITE (2201)..(2201): Xaa at position 2201 is Leu, Ala, Val, Gly, or Ile
  SITE (2217)..(2217): Xaa at position 2217 is Val, Ala, Gly, Leu, or Ile
  SITE (2222)..(2222): Xaa at position 2222 is Leu, Ala, Val, Gly, or Ile
  SITE (2250)..(2250): Xaa at position 2250 is Ile, Ala, Val, Leu, or Gly
  SITE (2260)..(2260): Xaa at position 2260 is Ile, Ala, Val, Leu, or Gly
  SITE (2261)..(2261): Xaa at position 2261 is Ala, Gly, or Pro
  SITE (2263)..(2263): Xaa at position 2263 is Ile, Ala, Val, Leu, or Gly
  SITE (2277)..(2277): Xaa at position 2277 is Ala, Gly, or Pro
  SITE (2288)..(2288): Xaa at position 2288 is Ala, Gly, or Pro
  SITE (2292)..(2292): Xaa at position 2292 is Leu, Ala, Val, Gly, or Ile
  SITE (2294)..(2294): Xaa at position 2294 is Ala, Gly, or Pro
  SITE (2296)..(2296): Xaa at position 2296 is Ala, Gly, or Pro
  SITE (2297)..(2297): Xaa at position 2297 is Ala, Gly, or Pro
  SITE (2301)..(2301): Xaa at position 2301 is Ile, Ala, Val, Leu, or Gly
  SITE (2312)..(2312): Xaa at position 2312 is Val, Ala, Gly, Leu, or Ile
  SITE (2315)..(2315): Xaa at position 2315 is Ala, Gly, or Pro
  SITE (2329)..(2329): Xaa at position 2329 is Leu, Ala, Val, Gly, or Ile
  SITE (2332)..(2332): Xaa at position 2332 is Ala, Gly, or Pro
  SITE (2336)..(2336): Xaa at position 2336 is Val, Ala, Gly, Leu, or Ile
  SITE (2339)..(2339): Xaa at position 2339 is Tyr, Phe, Met, His, Ile, Leu Val, Ala, or Gly
  SITE (2353)..(2353): Xaa at position 2353 is Ala, Gly, or Pro
  SITE (2367)..(2367): Xaa at position 2367 is Leu, Ala, Val, Gly, or Ile
  SITE (2368)..(2368): Xaa at position 2368 is Leu, Ala, Val, Gly, or Ile
  SITE (2370)..(2370): Xaa at position 2370 is Ala, Gly, or Pro
  SITE (2377)..(2377): Xaa at position 2377 is Ile, Ala, Val, Leu, or Gly
  SITE (2384)..(2384): Xaa at position 2384 is His, Phe, Tyr, Lys, Arg, Gly Ser, Thr, Ala, Val, Leu, Ile, Asn, Met, or Gln
  SITE (2386)..(2386): Xaa at position 2386 is Leu, Ala, Val, Gly, or Ile
  SITE (2391)..(2391): Xaa at position 2391 is Ala, Gly, or Pro
  SITE (2415)..(2415): Xaa at position 2415 is Phe, Tyr, Met, His, Ile, Leu Val, Ala, or Gly
  SITE (2424)..(2424): Xaa at position 2424 is Leu, Ala, Val, Gly, or Ile
  SITE (2426)..(2426): Xaa at position 2426 is Tyr, Phe, Met, His, Ile, Leu Val, Ala, or Gly
  SITE (2429)..(2429): Xaa at position 2429 is Leu, Ala, Val, Gly, or Ile
  SITE (2443)..(2443): Xaa at position 2443 is Leu, Ala, Val, Gly, or Ile
  SITE (2444)..(2444): Xaa at position 2444 is Leu, Ala, Val, Gly, or Ile
  SITE (2619)..(2619): Xaa at position 2619 is Ile, Ala, Val, Leu, or Gly
  SITE (2621)..(2621): Xaa at position 2621 is Ala, Gly, or Pro
  SITE (2622)..(2622): Xaa at position 2622 is Ile, Ala, Val, Leu, or Gly
  SITE (2631)..(2631): Xaa at position 2631 is Ile, Ala, Val, Leu, or Gly
  SITE (2650)..(2650): Xaa at position 2650 is Leu, Ala, Val, Gly, or Ile
  SITE (2651)..(2651): Xaa at position 2651 is Leu, Ala, Val, Gly, or Ile
  SITE (2653)..(2653): Xaa at position 2653 is Ala, Gly, or Pro
  SITE (2656)..(2656): Xaa at position 2656 is Cys, Ala, Val, Gly, Ser, or Thr
  SITE (2660)..(2660): Xaa at position 2660 is Ile, Ala, Val, Leu, or Gly
  SITE (2671)..(2671): Xaa at position 2671 is Leu, Ala, Val, Gly, or Ile
  SITE (2674)..(2674): Xaa at position 2674 is Ala, Gly, or Pro
  SITE (2679)..(2679): Xaa at position 2679 is Val, Ala, Gly, Leu, or Ile
  SITE (2688)..(2688): Xaa at position 2688 is Leu, Ala, Val, Gly, or Ile
  SITE (2691)..(2691): Xaa at position 2691 is Ala, Gly, or Pro
  SITE (2694)..(2694): Xaa at position 2694 is Ala, Gly, or Pro
  SITE (2709)..(2709): Xaa at position 2709 is Ala, Gly, or Pro
  SITE (2712)..(2712): Xaa at position 2712 is Ala, Gly, or Pro
  SITE (2726)..(2726): Xaa at position 2726 is Phe, Tyr, Met, His, Ile, Leu Val, Ala, or Gly
  SITE (2729)..(2729): Xaa at position 2729 is Phe, Tyr, Met, His, Ile, Leu Val, Ala, or Gly
  SITE (2736)..(2736): Xaa at position 2736 is Leu, Ala, Val, Gly, or Ile
  SITE (2737)..(2737): Xaa at position 2737 is Val, Ala, Gly, Leu, or Ile
  SITE (2750)..(2750): Xaa at position 2750 is Ala, Gly, or Pro
  SITE (2774)..(2774): Xaa at position 2774 is Leu, Ala, Val, Gly, or Ile
  SITE (2783)..(2783): Xaa at position 2783 is Ile, Ala, Val, Leu, or Gly
  SITE (2785)..(2785): Xaa at position 2785 is Tyr, Phe, Met, His, Ile, Leu Val, Ala, or Gly
  SITE (2788)..(2788): Xaa at position 2788 is Ala, Gly, or Pro
  SITE (2805)..(2805): Xaa at position 2805 is Ala, Gly, or Pro
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSEXLGWXRQQRAEMDMVAWGVDLASXEQHINSHRGIHNSXGDYRWQXDKIKADLREKSXIYQXEEEXENXLKASFERMDHLRQLQNXIQATSREIMWINDCEEEELLYDWSDKNTNIAQKQEAXSIRMSQLEVKEKELNKLKQESDQLVLNQHPXSDKXEAYMDTLQTQWSWILQXTKXXDVXLKENAAYFQXFEEXQSTEAYLKGLQDSIRKKXPCDKNMPLQHXLEQIKEXEKEREKILEYKRQVQNLVNKSKKIXQLKPRNPDYRSNKPIIXRALXDYKQDQKIXHKGDEXILKDNNERSKXYXTGPGGVDMLVPSXGXIXPPPNPLXVDLSCKXEQYYEAILALWNQLYINXKSXVSWHYXMIDIEKXRXMTIAKXKTMRQEDYMKTIADLELHYQEFIRNSQGSEMFGDDDKRKIQSQFTDAQKHYQTLXIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKXTXMQXYEXQLIDKTTLDKLLKGKKSVEEXASEIQPFLRGAGSXXGXSASPKEKYSXVEXKRKKLISPESTVMXLEXQXXTGGXIDPHRNEKLTXDSXIARDLIDFDDRQQXYAXEKXITGFDDPFSGKTVSVSEXIKKNLIDRETGXRXXEXQIASGGXVDPVNSXXXPKDVXLARGLIDRDLYRSLNDPRDSQKNXVDPVTKKKVSXVQXKERCRIEPHTGLLLXSVQKRSMSFQGIRQPXTVTEXVDSGILRPSTVNELESGQISYDEVGERXKDFLQGSSCXXGXYNETTKQKLGIYEXMKIGLVRPGTXLELXEXQXXTGFXVDPVSNLRLPXEEXYKRGLVGIEFKEKXLSXERAXTGXNDPETGNIISLFQXMNKELIEKGHGIRXXEXQIATGGXIDPKESXRXPVDIXYKRGYFNEELSEILSDPSDDTKGXFDPNTEENXTXLQXKERCIKDEETGLCXXPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPXAXXFDTENLEKXSITEGIERGIVDSITGQRXXEXQAXTGGXIHPTTGQKLSXQDXVSQGXIDQDMATRXKPXQKXFIGFEGVKGKKKMSXAEXVKEKWLPYEAGQRXLEXQYLTGGXXDPEVHGRISTEEXIRKGFIDGRAAQRLQDTSSYAKIXTCPKTKLKXSXKDXINRSMVEDITGLRLLEXASVSSKGLPSPYNMSSAPGSRSGSRSGSRSGSRSGSRSGSRRGSFDATGNSSYSYSYSFSSSSIGH

SEQ ID NO: 344 - protein, 1255 aa, Homo sapiens
  SITE (1049)..(1049): Xaa at position 1049 is Ile, Ala, Val, Leu, or Gly
  SITE (1054)..(1054): Xaa at position 1054 is Phe, Tyr, Met, His, Ile, Leu Val, Ala, or Gly
  SITE (1058)..(1058): Xaa at position 1058 is Leu, Ala, Val, Gly, or Ile
  SITE (1065)..(1065): Xaa at position 1065 is Tyr, Phe, Met, His, Ile, Leu Val, Ala, or Gly
  SITE (1066)..(1066): Xaa at position 1066 is Tyr, Phe, Met, His, Ile, Leu Val, Ala, or Gly
  SITE (1069)..(1069): Xaa at position 1069 is Leu, Ala, Val, Gly, or Ile
  SITE (1086)..(1086): Xaa at position 1086 is Phe, Tyr, Met, His, Ile, Leu Val, Ala, or Gly
  SITE (1094)..(1094): Xaa at position 1094 is Phe, Tyr, Met, His, Ile, Leu Val, Ala, or Gly
  SITE (1099)..(1099): Xaa at position 1099 is Val, Ala, Gly, Leu, or Ile
  SITE (1107)..(1107): Xaa at position 1107 is Phe, Tyr, Met, His, Ile, Leu Val, Ala, or Gly
  SITE (1134)..(1134): Xaa at position 1134 is Leu, Ala, Val, Gly, or Ile
  SITE (1141)..(1141): Xaa at position 1141 is Val, Ala, Gly, Leu, or Ile
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHXSNLQXNSSXEDPSTDXXQEXQRDISEMFLQIYKQGGXLGLSNIKXRPGSXVVQLTLAXREGTINVHDVETQFNQYKTEAASRYNXTISDVSXSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 345 - protein, 830 aa, Homo sapiens
  SITE (42)..(42): Xaa at position 42 is Trp, Tyr, Phe, Met, His, Ile, Leu Val, Ala, or Gly
  SITE (53)..(53): Xaa at position 53 is Trp, Tyr, Phe, Met, His, Ile, Leu Val, Ala, or Gly
  SITE (60)..(60): Xaa at position 60 is Cys, Ala, Val, Gly, Ser, or Thr
  SITE (67)..(67): Xaa at position 67 is Leu, Ala, Val, Gly, or Ile
  SITE (68)..(68): Xaa at position 68 is Val, Ala, Gly, Leu, or Ile
  SITE (69)..(69): Xaa at position 69 is Ala, Gly, or Pro
  SITE (79)..(79): Xaa at position 79 is Leu, Ala, Val, Gly, or Ile
  SITE (90)..(90): Xaa at position 90 is Tyr, Phe, Met, His, Ile, Leu, Val Ala, or Gly
  SITE (91)..(91): Xaa at position 91 is Trp, Tyr, Phe, Met, His, Ile, Leu Val, Ala, or Gly
  SITE (92)..(92): Xaa at position 92 is Ile, Ala, Val, Leu, or Gly
  SITE (94)..(94): Xaa at position 94 is Ile, Ala, Val, Leu, or Gly
  SITE (114)..(114): Xaa at position 114 is Ala, Gly, or Pro
  SITE (118)..(118): Xaa at position 118 is Ala, Gly, or Pro
  SITE (131)..(131): Xaa at position 131 is Cys, Ala, Val, Gly, Ser, or Thr
  SITE (132)..(132): Xaa at position 132 is Val, Ala, Gly, Leu, or Ile
  SITE (134)..(134): Xaa at position 134 is Ile, Ala, Val, Leu, or Gly
  SITE (136)..(136): Xaa at position 136 is Ile, Ala, Val, Leu, or Gly
  SITE (145)..(145): Xaa at position 145 is Trp, Tyr, Phe, Met, His, Ile, Leu Val, Ala, or Gly
  SITE (156)..(156): Xaa at position 156 is Ala, Gly, or Pro
  SITE (157)..(157): Xaa at position 157 is Leu, Ala, Val, Gly, or Ile
  SITE (158)..(158): Xaa at position 158 is Cys, Ala, Val, Gly, Ser, or Thr
  SITE (168)..(168): Xaa at position 168 is Cys, Ala, Val, Gly, Ser, or Thr
  SITE (194)..(194): Xaa at position 194 is Cys, Ala, Val, Gly, Ser, or Thr
  SITE (226)..(226): Xaa at position 226 is Cys, Ala, Val, Gly, Ser, or Thr
  SITE (244)..(244): Xaa at position 244 is Cys, Ala, Val, Gly, Ser, or Thr
  SITE (288)..(288): Xaa at position 288 is Cys, Ala, Val, Gly, Ser, or Thr
  SITE (290)..(290): Xaa at position 290 is Phe, Tyr, Met, His, Ile, Leu, Val Ala, or Gly
  SITE (306)..(306): Xaa at position 306 is Cys, Ala, Val, Gly, Ser, or Thr
MANCQIAILYQRFQRVVFGISQLLCFSALISELTNQKEVAAXTYHYSTKAYSXNISRKYXQNRYTDXXXIQNKNEIDYXNKVLPYYSSYXXXGXRKNNKTWTWVGTKKALTNEXENWXDNEPNNKRNNEDXXEXYXKSPSAPGKXNDEHCLKKKHXXXYTASCQDMSXSKQGECLETIGNYTCSCYPGFYGPEXEYVRECGELELPQHVLMNCSHPLGNFSFNSQXSFHCTDGYQVNGPSKLEXLASGIWTNKPPQCLAAQCPPLKIPERGNMTCLHSAKAFQHQSSXSXSCEEGFALVGPEVVQXTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGLQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 346 - protein, 1822 aa, Homo sapiens
  SITE (1544)..(1544): Xaa at position 1544 is Leu, Ala, Val, Gly, or Ile
  SITE (1546)..(1546): Xaa at position 1546 is Val, Ala, Gly, Leu, or Ile
  SITE (1560)..(1560): Xaa at position 1560 is Tyr, Phe, Met, His, Ile, Leu Val, Ala, or Gly
  SITE (1562)..(1562): Xaa at position 1562 is Val, Ala, Gly, Leu, or Ile
  SITE (1577)..(1577): Xaa at position 1577 is Ile, Ala, Val, Leu, or Gly
  SITE (1587)..(1587): Xaa at position 1587 is Val, Ala, Gly, Leu, or Ile
  SITE (1598)..(1598): Xaa at position 1598 is Phe, Tyr, Met, His, Ile, Leu Val, Ala, or Gly
  SITE (1600)..(1600): Xaa at position 1600 is Val, Ala, Gly, Leu, or Ile
  SITE (1602)..(1602): Xaa at position 1602 is Ala, Gly, or Pro
  SITE (1618)..(1618): Xaa at position 1618 is Ile, Ala, Val, Leu, or Gly
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSXRXSWQEPRCERPLQGXSXEYQLLNGGELHRLNXPNPAQTSVVXEDLLPNHSYVXRXRXQSQEGWGREREGVITXESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 347 - protein, 2710 aa, Peptoclostridium difficile
  SITE (9)..(9): Xaa at position 9 is Leu, Ala, Val, Gly, or Ile
  SITE (13)..(13): Xaa at position 13 is Ala, Gly, or Pro
  SITE (23)..(23): Xaa at position 23 is Tyr, Phe, Met, His, Ile, Leu, Val Ala, or Gly
  SITE (26)..(26): Xaa at position 26 is Ile, Ala, Val, Leu, or Gly
  SITE (27)..(27): Xaa at position 27 is Leu, Ala, Val, Gly, or Ile
  SITE (30)..(30): Xaa at position 30 is Leu, Ala, Val, Gly, or Ile
  SITE (36)..(36): Xaa at position 36 is Leu, Ala, Val, Gly, or Ile
  SITE (45)..(45): Xaa at position 45 is Tyr, Phe, Met, His, Ile, Leu, Val Ala, or Gly
  SITE (48)..(48): Xaa at position 48 is Leu, Ala, Val, Gly, or Ile
  SITE (51)..(51): Xaa at position 51 is Leu, Ala, Val, Gly, or Ile
  SITE (55)..(55): Xaa at position 55 is Ile, Ala, Val, Leu, or Gly
  SITE (58)..(58): Xaa at position 58 is Phe, Tyr, Met, His, Ile, Leu, Val Ala, or Gly
  SITE (59)..(59): Xaa at position 59 is Met, Ile, Leu, Val, Ala, or Gly
  SITE (71)..(71): Xaa at position 71 is Leu, Ala, Val, Gly, or Ile
  SITE (74)..(74): Xaa at position 74 is Leu, Ala, Val, Gly, or Ile
  SITE (78)..(78): Xaa at position 78 is Ile, Ala, Val, Leu, or Gly
  SITE (82)..(82): Xaa at position 82 is Val, Ala, Gly, Leu, or Ile
  SITE (97)..(97): Xaa at position 97 is Leu, Ala, Val, Gly, or Ile
  SITE (98)..(98): Xaa at position 98 is His, Phe, Tyr, Lys, Arg, Gly, Ser Thr, Ala, Val, Leu, Ile, Asn, Met, or Gln
  SITE (99)..(99): Xaa at position 99 is Phe, Tyr, Met, His, Ile, Leu, Val Ala, or Gly
  SITE (106)..(106): Xaa at position 106 is Val, Ala, Gly, Leu, or Ile
  SITE (110)..(110): Xaa at position 110 is Ala, Gly, or Pro
  SITE (113)..(113): Xaa at position 113 is Tyr, Phe, Met, His, Ile, Leu, Val Ala, or Gly
  SITE (117)..(117): Xaa at position 117 is Trp, Tyr, Phe, Met, His, Ile, Leu Val, Ala, or Gly
  SITE (128)..(128): Xaa at position 128 is Leu, Ala, Val, Gly, or Ile
  SITE (129)..(129): Xaa at position 129 is Trp, Tyr, Phe, Met, His, Ile, Leu Val, Ala, or Gly
  SITE (134)..(134): Xaa at position 134 is Ala, Gly, or Pro
  SITE (135)..(135): Xaa at position 135 is Phe, Tyr, Met, His, Ile, Leu, Val Ala, or Gly
  SITE (136)..(136): Xaa at position 136 is Leu, Ala, Val, Gly, or Ile
  SITE (137)..(137): Xaa at position 137 is Val, Ala, Gly, Leu, or Ile
  SITE (140)..(140): Xaa at position 140 is Leu, Ala, Val, Gly, or Ile
  SITE (143)..(143): Xaa at position 143 is Ala, Gly, or Pro
  SITE (144)..(144): Xaa at position 144 is Ile, Ala, Val, Leu, or Gly
  SITE (152)..(152): Xaa at position 152 is Ala, Gly, or Pro
  SITE (156)..(156): Xaa at position 156 is Leu, Ala, Val, Gly, or Ile
  SITE (170)..(170): Xaa at position 170 is Phe, Tyr, Met, His, Ile, Leu, Val Ala, or Gly
  SITE (171)..(171): Xaa at position 171 is Tyr, Phe, Met, His, Ile, Leu, Val Ala, or Gly
  SITE (175)..(175): Xaa at position 175 is Met, Ile, Leu, Val, Ala, or Gly
  SITE (178)..(178): Xaa at position 178 is Ile, Ala, Val, Leu, or Gly
  SITE (179)..(179): Xaa at position 179 is Tyr, Phe, Met, His, Ile, Leu, Val Ala, or Gly
  SITE (185)..(185): Xaa at position 185 is Phe, Tyr, Met, His, Ile, Leu, Val Ala, or Gly
  SITE (201)..(201): Xaa at position 201 is Ile, Ala, Val, Leu, or Gly
  SITE (204)..(204): Xaa at position 204 is Ile, Ala, Val, Leu, or Gly
  SITE (205)..(205): Xaa at position 205 is Ile, Ala, Val, Leu, or Gly
  SITE (208)..(208): Xaa at position 208 is His, Phe, Tyr, Lys, Arg, Gly, Ser Thr, Ala, Val, Leu, Ile, Asn, Met, or Gln
  SITE (209)..(209): Xaa at position 209 is Leu, Ala, Val, Gly, or Ile
  SITE (231)..(231): Xaa at position 231 is Ile, Ala, Val, Leu, or Gly
  SITE (239)..(239): Xaa at position 239 is Ile, Ala, Val, Leu, or Gly
  SITE (244)..(244): Xaa at position 244 is Leu, Ala, Val, Gly, or Ile
  SITE (245)..(245): Xaa at position 245 is Phe, Tyr, Met, His, Ile, Leu, Val Ala, or Gly
  SITE (253)..(253): Xaa at position 253 is Ile, Ala, Val, Leu, or Gly
  SITE (254)..(254): Xaa at position 254 is Tyr, Phe, Met, His, Ile, Leu, Val Ala, or Gly
  SITE (258)..(258): Xaa at position 258 is Leu, Ala, Val, Gly, or Ile
  SITE (259)..(259): Xaa at position 259 is Leu, Ala, Val, Gly, or Ile
  SITE (266)..(266): Xaa at position 266 is Ala, Gly, or Pro
  SITE (267)..(267): Xaa at position 267 is Ala, Gly, or Pro
  SITE (270)..(270): Xaa at position 270 is Ile, Ala, Val, Leu, or Gly
  SITE (271)..(271): Xaa at position 271 is Val, Ala, Gly, Leu, or Ile
  SITE (273)..(273): Xaa at position 273 is Leu, Ala, Val, Gly, or Ile
  SITE (274)..(274): Xaa at position 274 is Leu, Ala, Val, Gly, or Ile
  SITE (275)..(275): Xaa at position 275 is Ala, Gly, or Pro
  SITE (276)..(276): Xaa at position 276 is Leu, Ala, Val, Gly, or Ile
  SITE (282)..(282): Xaa at position 282 is Val, Ala, Gly, Leu, or Ile
  SITE (283)..(283): Xaa at position 283 is Tyr, Phe, Met, His, Ile, Leu, Val Ala, or Gly
  SITE (284)..(284): Xaa at position 284 is Leu, Ala, Val, Gly, or Ile
  SITE (288)..(288): Xaa at position 288 is Met, Ile, Leu, Val, Ala, or Gly
  SITE (289)..(289): Xaa at position 289 is Leu, Ala, Val, Gly, or Ile
  SITE (314)..(314): Xaa at position 314 is Ile, Ala, Val, Leu, or Gly
  SITE (316)..(316): Xaa at position 316 is Leu, Ala, Val, Gly, or Ile
  SITE (318)..(318): Xaa at position 318 is Ala, Gly, or Pro
  SITE (319)..(319): Xaa at position 319 is Ile, Ala, Val, Leu, or Gly
  SITE (334)..(334): Xaa at position 334 is Phe, Tyr, Met, His, Ile, Leu, Val Ala, or Gly
  SITE (345)..(345): Xaa at position 345 is Phe, Tyr, Met, His, Ile, Leu, Val Ala, or Gly
  SITE (349)..(349): Xaa at position 349 is Ile, Ala, Val, Leu, or Gly
  SITE (358)..(358): Xaa at position 358 is Ile, Ala, Val, Leu, or Gly
  SITE (359)..(359): Xaa at position 359 is Phe, Tyr, Met, His, Ile, Leu, Val Ala, or Gly
  SITE (362)..(362): Xaa at position 362 is Leu, Ala, Val, Gly, or Ile
  SITE (367)..(367): Xaa at position 367 is Val, Ala, Gly, Leu, or Ile
  SITE (370)..(370): Xaa at position 370 is Leu, Ala, Val, Gly, or Ile
  SITE (372)..(372): Xaa at position 372 is Ile, Ala, Val, Leu, or Gly
  SITE (374)..(374): Xaa at position 374 is Ile, Ala, Val, Leu, or Gly
  SITE (375)..(375): Xaa at position 375 is Ala, Gly, or Pro
  SITE (385)..(385): Xaa at position 385 is Ala, Gly, or Pro
  SITE (386)..(386): Xaa at position 386 is Leu, Ala, Val, Gly, or Ile
  SITE (387)..(387): Xaa at position 387 is Ile, Ala, Val, Leu, or Gly
  SITE (394)..(394): Xaa at position 394 is Leu, Ala, Val, Gly, or Ile
  SITE (398)..(398): Xaa at position 398 is Val, Ala, Gly, Leu, or Ile
  SITE (402)..(402): Xaa at position 402 is Val, Ala, Gly, Leu, or Ile
  SITE (406)..(406): Xaa at position 406 is Tyr, Phe, Met, His, Ile, Leu, Val Ala, or Gly
  SITE (409)..(409): Xaa at position 409 is Leu, Ala, Val, Gly, or Ile
  SITE (413)..(413): Xaa at position 413 is Leu, Ala, Val, Gly, or Ile
  SITE (416)..(416): Xaa at position 416 is Ala, Gly, or Pro
  SITE (423)..(423): Xaa at position 423 is Phe, Tyr, Met, His, Ile, Leu, Val Ala, or Gly
  SITE (430)..(430): Xaa at position 430 is Phe, Tyr, Met, His, Ile, Leu, Val Ala, or Gly
  SITE (434)..(434): Xaa at position 434 is Leu, Ala, Val, Gly, or Ile
  SITE (445)..(445): Xaa at position 445 is Phe, Tyr, Met, His, Ile, Leu, Val Ala, or Gly
  SITE (446)..(446): Xaa at position 446 is Leu, Ala, Val, Gly, or Ile
  SITE (449)..(449): Xaa at position 449 is Ile, Ala, Val, Leu, or Gly
  SITE (453)..(453): Xaa at position 453 is Leu, Ala, Val, Gly, or Ile
  SITE (457)..(457): Xaa at position 457 is Phe, Tyr, Met, His, Ile, Leu, Val Ala, or Gly
  SITE (461)..(461): Xaa at position 461 is Ala, Gly, or Pro
  SITE (467)..(467): Xaa at position 467 is Leu, Ala, Val, Gly, or Ile
  SITE (472)..(472): Xaa at position 472 is Ala, Gly, or Pro
  SITE (473)..(473): Xaa at position 473 is Tyr, Phe, Met, His, Ile, Leu, Val Ala, or Gly
  SITE (476)..(476): Xaa at position 476 is Ala, Gly, or Pro
  SITE (477)..(477): Xaa at position 477 is Tyr, Phe, Met, His, Ile, Leu, Val Ala, or Gly
  SITE (480)..(480): Xaa at position 480 is Phe, Tyr, Met, His, Ile, Leu, Val Ala, or Gly
  SITE (483)..(483): Xaa at position 483 is Leu, Ala, Val, Gly, or Ile
  SITE (497)..(497): Xaa at position 497 is Leu, Ala, Val, Gly, or Ile
  SITE (500)..(500): Xaa at position 500 is Phe, Tyr, Met, His, Ile, Leu, Val Ala, or Gly
  SITE (526)..(526): Xaa at position 526 is Ala, Gly, or Pro
  SITE (561)..(561): Xaa at position 561 is Leu, Ala, Val, Gly, or Ile
  SITE (580)..(580): Xaa at position 580 is Val, Ala, Gly, Leu, or Ile
  SITE (582)..(582): Xaa at position 582 is Tyr, Phe, Met, His, Ile, Leu, Val Ala, or Gly
  SITE (583)..(583): Xaa at position 583 is Ile, Ala, Val, Leu, or Gly
  SITE (584)..(584): Xaa at position 584 is Ile, Ala, Val, Leu, or Gly
  SITE (597)..(597): Xaa at position 597 is Cys, Ala, Val, Gly, Ser, or Thr
  SITE (600)..(600): Xaa at position 600 is Phe, Tyr, Met, His, Ile, Leu, Val Ala, or Gly
  SITE (608)..(608): Xaa at position 608 is Ile, Ala, Val, Leu, or Gly
  SITE (609)..(609): Xaa at position 609 is Ile, Ala, Val, Leu, or Gly
  SITE (610)..(610): Xaa at position 610 is Ile, Ala, Val, Leu, or Gly
  SITE (636)..(636): Xaa at position 636 is Tyr, Phe, Met, His, Ile, Leu, Val Ala, or Gly
  SITE (638)..(638): Xaa at position 638 is Ile, Ala, Val, Leu, or Gly
  SITE (642)..(642): Xaa at position 642 is Leu, Ala, Val, Gly, or Ile
  SITE (648)..(648): Xaa at position 648 is Val, Ala, Gly, Leu, or Ile
  SITE (650)..(650): Xaa at position 650 is Val, Ala, Gly, Leu, or Ile
  SITE (652)..(652): Xaa at position 652 is Phe, Tyr, Met, His, Ile, Leu, Val Ala, or Gly
  SITE (653)..(653): Xaa at position 653 is Ile, Ala, Val, Leu, or Gly
  SITE (665)..(665): Xaa at position 665 is Phe, Tyr, Met, His, Ile, Leu, Val Ala, or Gly
  SITE (673)..(673): Xaa at position 673 is Leu, Ala, Val, Gly, or Ile
  SITE (677)..(677): Xaa at position 677 is Ile, Ala, Val, Leu, or Gly
  SITE (680)..(680): Xaa at position 680 is Phe, Tyr, Met, His, Ile, Leu, Val Ala, or Gly
  SITE (684)..(684): Xaa at position 684 is Ile, Ala, Val, Leu, or Gly
  SITE (688)..(688): Xaa at position 688 is Ile, Ala, Val, Leu, or Gly
  SITE (693)..(693): Xaa at position 693 is Val, Ala, Gly, Leu, or Ile
  SITE (695)..(695): Xaa at position 695 is Val, Ala, Gly, Leu, or Ile
  SITE (697)..(697): Xaa at position 697 is Leu, Ala, Val, Gly, or Ile
  SITE (700)..(700): Xaa at position 700 is Cys, Ala, Val, Gly, Ser, or Thr
  SITE (702)..(702): Xaa at position 702 is Met, Ile, Leu, Val, Ala, or Gly
  SITE (703)..(703): Xaa at position 703 is Phe, Tyr, Met, His, Ile, Leu, Val Ala, or Gly
  SITE (713)..(713): Xaa at position 713 is Tyr, Phe, Met, His, Ile, Leu, Val Ala, or Gly
  SITE (717)..(717): Xaa at position 717 is Leu, Ala, Val, Gly, or Ile
  SITE (718)..(718): Xaa at position 718 is Leu, Ala, Val, Gly, or Ile
  SITE (721)..(721): Xaa at position 721 is Ile, Ala, Val, Leu, or Gly
  SITE (725)..(725): Xaa at position 725 is Ile, Ala, Val, Leu, or Gly
  SITE (729)..(729): Xaa at position 729 is Leu, Ala, Val, Gly, or Ile
  SITE (732)..(732): Xaa at position 732 is Val, Ala, Gly, Leu, or Ile
  SITE (737)..(737): Xaa at position 737 is Ile, Ala, Val, Leu, or Gly
  SITE (739)..(739): Xaa at position 739 is Ile, Ala, Val, Leu, or Gly
  SITE (741)..(741): Xaa at position 741 is Ala, Gly, or Pro
  SITE (756)..(756): Xaa at position 756 is Leu, Ala, Val, Gly, or Ile
  SITE (764)..(764): Xaa at position 764 is Ile, Ala, Val, Leu, or Gly
  SITE (769)..(769): Xaa at position 769 is Ala, Gly, or Pro
  SITE (770)..(770): Xaa at position 770 is Ile, Ala, Val, Leu, or Gly
  SITE (780)..(780): Xaa at position 780 is Ile, Ala, Val, Leu, or Gly
  SITE (791)..(791): Xaa at position 791 is Ala, Gly, or Pro
  SITE (806)..(806): Xaa at position 806 is Ile, Ala, Val, Leu, or Gly
  SITE (857)..(857): Xaa at position 857 is Leu, Ala, Val, Gly, or Ile
  SITE (867)..(867): Xaa at position 867 is Val, Ala, Gly, Leu, or Ile
  SITE (871)..(871): Xaa at position 871 is Leu, Ala, Val, Gly, or Ile
  SITE (885)..(885): Xaa at position 885 is Leu, Ala, Val, Gly, or Ile
  SITE (886)..(886): Xaa at position 886 is Ile, Ala, Val, Leu, or Gly
  SITE (888)..(888): Xaa at position 888 is Phe, Tyr, Met, His, Ile, Leu, Val Ala, or Gly
  SITE (900)..(900): Xaa at position 900 is Val, Ala, Gly, Leu, or Ile
  SITE (902)..(902): Xaa at position 902 is Phe, Tyr, Met, His, Ile, Leu, Val Ala, or Gly
  SITE (903)..(903): Xaa at position 903 is Ile, Ala, Val, Leu, or Gly
  SITE (920)..(920): Xaa at position 920 is Phe, Tyr, Met, His, Ile, Leu, Val Ala, or Gly
  SITE (923)..(923): Xaa at position 923 is Tyr, Phe, Met, His, Ile, Leu, Val Ala, or Gly
  SITE (927)..(927): Xaa at position 927 is Ile, Ala, Val, Leu, or Gly
  SITE (961)..(961): Xaa at position 961 is Leu, Ala, Val, Gly, or Ile
  SITE (965)..(965): Xaa at position 965 is Phe, Tyr, Met, His, Ile, Leu, Val Ala, or Gly
  SITE (967)..(967): Xaa at position 967 is Ile, Ala, Val, Leu, or Gly
  SITE (987)..(987): Xaa at position 987 is Val, Ala, Gly, Leu, or Ile
  SITE (989)..(989): Xaa at position 989 is Val, Ala, Gly, Leu, or Ile
  SITE (991)..(991): Xaa at position 991 is Leu, Ala, Val, Gly, or Ile
  SITE (993)..(993): Xaa at position 993 is Ala, Gly, or Pro
  SITE (1000)..(1000): Xaa at position 1000 is Leu, Ala, Val, Gly, or Ile
  SITE (1003)..(1003): Xaa at position 1003 is Ile, Ala, Val, Leu, or Gly
  SITE (1009)..(1009): Xaa at position 1009 is Leu, Ala, Val, Gly, or Ile
  SITE (1016)..(1016): Xaa at position 1016 is Ala, Gly, or Pro
  SITE (1050)..(1050): Xaa at position 1050 is Leu, Ala, Val, Gly, or Ile
  SITE (1068)..(1068): Xaa at position 1068 is Val, Ala, Gly, Leu, or Ile
  SITE (1078)..(1078): Xaa at position 1078 is Ala, Gly, or Pro
  SITE (1084)..(1084): Xaa at position 1084 is Ile, Ala, Val, Leu, or Gly
  SITE (1122)..(1122): Xaa at position 1122 is Val, Ala, Gly, Leu, or Ile
  SITE (1125)..(1125): Xaa at position 1125 is Tyr, Phe, Met, His, Ile, Leu Val, Ala, or Gly
  SITE (1126)..(1126): Xaa at position 1126 is Phe, Tyr, Met, His, Ile, Leu Val, Ala, or Gly
  SITE (1129)..(1129): Xaa at position 1129 is Leu, Ala, Val, Gly, or Ile
  SITE (1152)..(1152): Xaa at position 1152 is Leu, Ala, Val, Gly, or Ile
  SITE (1153)..(1153): Xaa at position 1153 is Val, Ala, Gly, Leu, or Ile
  SITE (1154)..(1154): Xaa at position 1154 is Ile, Ala, Val, Leu, or Gly
  SITE (1169)..(1169): Xaa at position 1169 is Cys, Ala, Val, Gly, Ser, or Thr
  SITE (1171)..(1171): Xaa at position 1171 is Ile, Ala, Val, Leu, or Gly
  SITE (1173)..(1173): Xaa at position 1173 is Ala, Gly, or Pro
  SITE (1204)..(1204): Xaa at position 1204 is Ile, Ala, Val, Leu, or Gly
  SITE (1222)..(1222): Xaa at position 1222 is Met, Ile, Leu, Val, Ala, or Gly
  SITE (1224)..(1224): Xaa at position 1224 is Leu, Ala, Val, Gly, or Ile
  SITE (1227)..(1227): Xaa at position 1227 is Ala, Gly, or Pro
  SITE (1232)..(1232): Xaa at position 1232 is Phe, Tyr, Met, His, Ile, Leu Val, Ala, or Gly
  SITE (1253)..(1253): Xaa at position 1253 is Leu, Ala, Val, Gly, or Ile
  SITE (1256)..(1256): Xaa at position 1256 is Ile, Ala, Val, Leu, or Gly
  SITE (1264)..(1264): Xaa at position 1264 is Phe, Tyr, Met, His, Ile, Leu Val, Ala, or Gly
  SITE (1276)..(1276): Xaa at position 1276 is Ile, Ala, Val, Leu, or Gly
  SITE (1279)..(1279): Xaa at position 1279 is Leu, Ala, Val, Gly, or Ile
  SITE (1288)..(1288): Xaa at position 1288 is Ile, Ala, Val, Leu, or Gly
  SITE (1290)..(1290): Xaa at position 1290 is Ile, Ala, Val, Leu, or Gly
  SITE (1299)..(1299): Xaa at position 1299 is Phe, Tyr, Met, His, Ile, Leu Val, Ala, or Gly
  SITE (1304)..(1304): Xaa at position 1304 is Ile, Ala, Val, Leu, or Gly
  SITE (1317)..(1317): Xaa at position 1317 is Phe, Tyr, Met, His, Ile, Leu Val, Ala, or Gly
  SITE (1324)..(1324): Xaa at position 1324 is Tyr, Phe, Met, His, Ile, Leu Val, Ala, or Gly
  SITE (1326)..(1326): Xaa at position 1326 is Leu, Ala, Val, Gly, or Ile
  SITE (1328)..(1328): Xaa at position 1328 is Leu, Ala, Val, Gly, or Ile
  SITE (1333)..(1333): Xaa at position 1333 is Ile, Ala, Val, Leu, or Gly
  SITE (1337)..(1337): Xaa at position 1337 is Ile, Ala, Val, Leu, or Gly
  SITE (1339)..(1339): Xaa at position 1339 is Leu, Ala, Val, Gly, or Ile
  SITE (1345)..(1345): Xaa at position 1345 is Trp, Tyr, Phe, Met, His, Ile Leu, Val, Ala, or Gly
  SITE (1346)..(1346): Xaa at position 1346 is Ile, Ala, Val, Leu, or Gly
  SITE (1347)..(1347): Xaa at position 1347 is Phe, Tyr, Met, His, Ile, Leu Val, Ala, or Gly
  SITE (1353)..(1353): Xaa at position 1353 is Val, Ala, Gly, Leu, or Ile
  SITE (1383)..(1383): Xaa at position 1383 is Leu, Ala, Val, Gly, or Ile
  SITE (1390)..(1390): Xaa at position 1390 is Ile, Ala, Val, Leu, or Gly
  SITE (1405)..(1405): Xaa at position 1405 is Leu, Ala, Val, Gly, or Ile
  SITE (1413)..(1413): Xaa at position 1413 is Ile, Ala, Val, Leu, or Gly
  SITE (1415)..(1415): Xaa at position 1415 is Leu, Ala, Val, Gly, or Ile
  SITE (1416)..(1416): Xaa at position 1416 is Ile, Ala, Val, Leu, or Gly
  SITE (1417)..(1417): Xaa at position 1417 is Ile, Ala, Val, Leu, or Gly
  SITE (1419)..(1419): Xaa at position 1419 is Ile, Ala, Val, Leu, or Gly
  SITE (1430)..(1430): Xaa at position 1430 is Leu, Ala, Val, Gly, or Ile
  SITE (1441)..(1441): Xaa at position 1441 is Leu, Ala, Val, Gly, or Ile
  SITE (1448)..(1448): Xaa at position 1448 is Ile, Ala, Val, Leu, or Gly
  SITE (1451)..(1451): Xaa at position 1451 is Leu, Ala, Val, Gly, or Ile
  SITE (1458)..(1458): Xaa at position 1458 is Ile, Ala, Val, Leu, or Gly
  SITE (1473)..(1473): Xaa at position 1473 is Ala, Gly, or Pro
  SITE (1474)..(1474): Xaa at position 1474 is Ile, Ala, Val, Leu, or Gly
  SITE (1482)..(1482): Xaa at position 1482 is Ile, Ala, Val, Leu, or Gly
  SITE (1493)..(1493): Xaa at position 1493 is Leu, Ala, Val, Gly, or Ile
  SITE (1503)..(1503): Xaa at position 1503 is Phe, Tyr, Met, His, Ile, Leu Val, Ala, or Gly
  SITE (1516)..(1516): Xaa at position 1516 is Phe, Tyr, Met, His, Ile, Leu Val, Ala, or Gly
  SITE (1517)..(1517): Xaa at position 1517 is Met, Ile, Leu, Val, Ala, or Gly
  SITE (1524)..(1524): Xaa at position 1524 is Ile, Ala, Val, Leu, or Gly
  SITE (1538)..(1538): Xaa at position 1538 is Ile, Ala, Val, Leu, or Gly
  SITE (1540)..(1540): Xaa at position 1540 is Phe, Tyr, Met, His, Ile, Leu Val, Ala, or Gly
  SITE (1542)..(1542): Xaa at position 1542 is Ile, Ala, Val, Leu, or Gly
  SITE (1550)..(1550): Xaa at position 1550 is Val, Ala, Gly, Leu, or Ile
  SITE (1552)..(1552): Xaa at position 1552 is Val, Ala, Gly, Leu, or Ile
  SITE (1555)..(1555): Xaa at position 1555 is Leu, Ala, Val, Gly, or Ile
  SITE (1557)..(1557): Xaa at position 1557 is Leu, Ala, Val, Gly, or Ile
  SITE (1561)..(1561): Xaa at position 1561 is Val, Ala, Gly, Leu, or Ile
  SITE (1565)..(1565): Xaa at position 1565 is Tyr, Phe, Met, His, Ile, Leu Val, Ala, or Gly
  SITE (1569)..(1569): Xaa at position 1569 is Val, Ala, Gly, Leu, or Ile
  SITE (1582)..(1582): Xaa at position 1582 is Met, Ile, Leu, Val, Ala, or Gly
  SITE (1585)..(1585): Xaa at position 1585 is Phe, Tyr, Met, His, Ile, Leu Val, Ala, or Gly
  SITE (1586)..(1586): Xaa at position 1586 is Leu, Ala, Val, Gly, or Ile
  SITE (1591)..(1591): Xaa at position 1591 is Phe, Tyr, Met, His, Ile, Leu Val, Ala, or Gly
  SITE (1594)..(1594): Xaa at position 1594 is Leu, Ala, Val, Gly, or Ile
  SITE (1608)..(1608): Xaa at position 1608 is Phe, Tyr, Met, His, Ile, Leu Val, Ala, or Gly
  SITE (1610)..(1610): Xaa at position 1610 is Leu, Ala, Val, Gly, or Ile
  SITE (1611)..(1611): Xaa at position 1611 is Val, Ala, Gly, Leu, or Ile
  SITE (1621)..(1621): Xaa at position 1621 is Phe, Tyr, Met, His, Ile, Leu Val, Ala, or Gly
  SITE (1633)..(1633): Xaa at position 1633 is Phe, Tyr, Met, His, Ile, Leu Val, Ala, or Gly
  SITE (1646)..(1646): Xaa at position 1646 is Phe, Tyr, Met, His, Ile, Leu Val, Ala, or Gly
  SITE (1653)..(1653): Xaa at position 1653 is Val, Ala, Gly, Leu, or Ile
  SITE (1654)..(1654): Xaa at position 1654 is Val, Ala, Gly, Leu, or Ile
  SITE (1655)..(1655): Xaa at position 1655 is Val, Ala, Gly, Leu, or Ile
  SITE (1671)..(1671): Xaa at position 1671 is Leu, Ala, Val, Gly, or Ile
  SITE (1675)..(1675): Xaa at position 1675 is Tyr, Phe, Met, His, Ile, Leu Val, Ala, or Gly
  SITE (1678)..(1678): Xaa at position 1678 is Leu, Ala, Val, Gly, or Ile
  SITE (1688)..(1688): Xaa at position 1688 is Val, Ala, Gly, Leu, or Ile
  SITE (1689)..(1689): Xaa at position 1689 is Leu, Ala, Val, Gly, or Ile
  SITE (1690)..(1690): Xaa at position 1690 is Ile, Ala, Val, Leu, or Gly
  SITE (1695)..(1695): Xaa at position 1695 is Tyr, Phe, Met, His, Ile, Leu Val, Ala, or Gly
  SITE (1701)..(1701): Xaa at position 1701 is Ile, Ala, Val, Leu, or Gly
  SITE (1714)..(1714): Xaa at position 1714 is Ile, Ala, Val, Leu, or Gly
  SITE (1728)..(1728): Xaa at position 1728 is Ile, Ala, Val, Leu, or Gly
  SITE (1730)..(1730): Xaa at position 1730 is Leu, Ala, Val, Gly, or Ile
  SITE (1739)..(1739): Xaa at position 1739 is Trp, Tyr, Phe, Met, His, Ile Leu, Val, Ala, or Gly
  SITE (1746)..(1746): Xaa at position 1746 is Phe, Tyr, Met, His, Ile, Leu Val, Ala, or Gly
  SITE (1768)..(1768): Xaa at position 1768 is Ile, Ala, Val, Leu, or Gly
  SITE (1769)..(1769): Xaa at position 1769 is Leu, Ala, Val, Gly, or Ile
  SITE (1782)..(1782): Xaa at position 1782 is Phe, Tyr, Met, His, Ile, Leu Val, Ala, or Gly
  SITE (1790)..(1790): Xaa at position 1790 is Leu, Ala, Val, Gly, or Ile
  SITE (1793)..(1793): Xaa at position 1793 is Ile, Ala, Val, Leu, or Gly
  SITE (1864)..(1864): Xaa at position 1864 is Phe, Tyr, Met, His, Ile, Leu Val, Ala, or Gly
  SITE (1872)..(1872): Xaa at position 1872 is Leu, Ala, Val, Gly, or Ile
  SITE (1883)..(1883): Xaa at position 1883 is Phe, Tyr, Met, His, Ile, Leu Val, Ala, or Gly
  SITE (1905)..(1905): Xaa at position 1905 is Phe, Tyr, Met, His, Ile, Leu Val, Ala, or Gly
  SITE (1906)..(1906): Xaa at position 1906 is Ala, Gly, or Pro
  SITE (1936)..(1936): Xaa at position 1936 is Phe, Tyr, Met, His, Ile, Leu Val, Ala, or Gly
  SITE (1956)..(1956): Xaa at position 1956 is Phe, Tyr, Met, His, Ile, Leu Val, Ala, or Gly
  SITE (1961)..(1961): Xaa at position 1961 is Ala, Gly, or Pro
  SITE (1963)..(1963): Xaa at position 1963 is Ala, Gly, or Pro
  SITE (1964)..(1964): Xaa at position 1964 is Ala, Gly, or Pro
  SITE (1965)..(1965): Xaa at position 1965 is Val, Ala, Gly, Leu, or Ile
  SITE (1977)..(1977): Xaa at position 1977 is Phe, Tyr, Met, His, Ile, Leu Val, Ala, or Gly
  SITE (1998)..(1998): Xaa at position 1998 is Phe, Tyr, Met, His, Ile, Leu Val, Ala, or Gly
  SITE (2006)..(2006): Xaa at position 2006 is Phe, Tyr, Met, His, Ile, Leu Val, Ala, or Gly
  SITE (2017)..(2017): Xaa at position 2017 is Phe, Tyr, Met, His, Ile, Leu Val, Ala, or Gly
  SITE (2039)..(2039): Xaa at position 2039 is Phe, Tyr, Met, His, Ile, Leu Val, Ala, or Gly
  SITE (2040)..(2040): Xaa at position 2040 is Ala, Gly, or Pro
  SITE (2070)..(2070): Xaa at position 2070 is Phe, Tyr, Met, His, Ile, Leu Val, Ala, or Gly
  SITE (2090)..(2090): Xaa at position 2090 is Phe, Tyr, Met, His, Ile, Leu Val, Ala, or Gly
  SITE (2095)..(2095): Xaa at position 2095 is Ala, Gly, or Pro
  SITE (2097)..(2097): Xaa at position 2097 is Ala, Gly, or Pro
  SITE (2098)..(2098): Xaa at position 2098 is Ala, Gly, or Pro
  SITE (2109)..(2109): Xaa at position 2109 is Tyr, Phe, Met, His, Ile, Leu Val, Ala, or Gly
  SITE (2110)..(2110): Xaa at position 2110 is Tyr, Phe, Met, His, Ile, Leu Val, Ala, or Gly
  SITE (2111)..(2111): Xaa at position 2111 is Phe, Tyr, Met, His, Ile, Leu Val, Ala, or Gly
  SITE (2132)..(2132): Xaa at position 2132 is Phe, Tyr, Met, His, Ile, Leu Val, Ala, or Gly
  SITE (2151)..(2151): Xaa at position 2151 is Phe, Tyr, Met, His, Ile, Leu Val, Ala, or Gly
  SITE (2153)..(2153): Xaa at position 2153 is Phe, Tyr, Met, His, Ile, Leu Val, Ala, or Gly
  SITE (2158)..(2158): Xaa at position 2158 is Ile, Ala, Val, Leu, or Gly
  SITE (2161)..(2161): Xaa at position 2161 is Ile, Ala, Val, Leu, or Gly
  SITE (2173)..(2173): Xaa at position 2173 is Phe, Tyr, Met, His, Ile, Leu Val, Ala, or Gly
  SITE (2174)..(2174): Xaa at position 2174 is Ala, Gly, or Pro
  SITE (2204)..(2204): Xaa at position 2204 is Phe, Tyr, Met, His, Ile, Leu Val, Ala, or Gly
  SITE (2224)..(2224): Xaa at position 2224 is Phe, Tyr, Met, His, Ile, Leu Val, Ala, or Gly
  SITE (2229)..(2229): Xaa at position 2229 is Ala, Gly, or Pro
  SITE (2231)..(2231): Xaa at position 2231 is Ala, Gly, or Pro
  SITE (2232)..(2232): Xaa at position 2232 is Ala, Gly, or Pro
  SITE (2244)..(2244): Xaa at position 2244 is Tyr, Phe, Met, His, Ile, Leu Val, Ala, or Gly
  SITE (2245)..(2245): Xaa at position 2245 is Phe, Tyr, Met, His, Ile, Leu Val, Ala, or Gly
  SITE (2263)..(2263): Xaa at position 2263 is Phe, Tyr, Met, His, Ile, Leu Val, Ala, or Gly
  SITE (2265)..(2265): Xaa at position 2265 is Phe, Tyr, Met, His, Ile, Leu Val, Ala, or Gly
  SITE (2287)..(2287): Xaa at position 2287 is Phe, Tyr, Met, His, Ile, Leu Val, Ala, or Gly
  SITE (2288)..(2288): Xaa at position 2288 is Ala, Gly, or Pro
  SITE (2318)..(2318): Xaa at position 2318 is Phe, Tyr, Met, His, Ile, Leu Val, Ala, or Gly
  SITE (2338)..(2338): Xaa at position 2338 is Phe, Tyr, Met, His, Ile, Leu Val, Ala, or Gly
  SITE (2343)..(2343): Xaa at position 2343 is Ala, Gly, or Pro
  SITE (2345)..(2345): Xaa at position 2345 is Ala, Gly, or Pro
  SITE (2346)..(2346): Xaa at position 2346 is Ala, Gly, or Pro
  SITE (2352)..(2352): Xaa at position 2352 is Ile, Ala, Val, Leu, or Gly
  SITE (2357)..(2357): Xaa at position 2357 is Tyr, Phe, Met, His, Ile, Leu Val, Ala, or Gly
  SITE (2359)..(2359): Xaa at position 2359 is Phe, Tyr, Met, His, Ile, Leu Val, Ala, or Gly
  SITE (2380)..(2380): Xaa at position 2380 is Phe, Tyr, Met, His, Ile, Leu Val, Ala, or Gly
  SITE (2399)..(2399): Xaa at position 2399 is Phe, Tyr, Met, His, Ile, Leu Val, Ala, or Gly
  SITE (2401)..(2401): Xaa at position 2401 is Phe, Tyr, Met, His, Ile, Leu Val, Ala, or Gly
  SITE (2406)..(2406): Xaa at position 2406 is Ile, Ala, Val, Leu, or Gly
  SITE (2409)..(2409): Xaa at position 2409 is Ile, Ala, Val, Leu, or Gly
  SITE (2421)..(2421): Xaa at position 2421 is Phe, Tyr, Met, His, Ile, Leu Val, Ala, or Gly
  SITE (2422)..(2422): Xaa at position 2422 is Ala, Gly, or Pro
  SITE (2445)..(2445): Xaa at position 2445 is Leu, Ala, Val, Gly, or Ile
  SITE (2452)..(2452): Xaa at position 2452 is Phe, Tyr, Met, His, Ile, Leu Val, Ala, or Gly
  SITE (2472)..(2472): Xaa at position 2472 is Phe, Tyr, Met, His, Ile, Leu Val, Ala, or Gly
  SITE (2477)..(2477): Xaa at position 2477 is Ala, Gly, or Pro
  SITE (2478)..(2478): Xaa at position 2478 is Val, Ala, Gly, Leu, or Ile
  SITE (2479)..(2479): Xaa at position 2479 is Ala, Gly, or Pro
  SITE (2480)..(2480): Xaa at position 2480 is Val, Ala, Gly, Leu, or Ile
  SITE (2492)..(2492): Xaa at position 2492 is Tyr, Phe, Met, His, Ile, Leu Val, Ala, or Gly
  SITE (2493)..(2493): Xaa at position 2493 is Phe, Tyr, Met, His, Ile, Leu Val, Ala, or Gly
  SITE (2512)..(2512): Xaa at position 2512 is Phe, Tyr, Met, His, Ile, Leu Val, Ala, or Gly
  SITE (2514)..(2514): Xaa at position 2514 is Phe, Tyr, Met, His, Ile, Leu Val, Ala, or Gly
  SITE (2534)..(2534): Xaa at position 2534 is Phe, Tyr, Met, His, Ile, Leu Val, Ala, or Gly
  SITE (2535)..(2535): Xaa at position 2535 is Ala, Gly, or Pro
  SITE (2565)..(2565): Xaa at position 2565 is Phe, Tyr, Met, His, Ile, Leu Val, Ala, or Gly
  SITE (2585)..(2585): Xaa at position 2585 is Phe, Tyr, Met, His, Ile, Leu Val, Ala, or Gly
  SITE (2590)..(2590): Xaa at position 2590 is Ala, Gly, or Pro
  SITE (2593)..(2593): Xaa at position 2593 is Ala, Gly, or Pro
  SITE (2599)..(2599): Xaa at position 2599 is Ile, Ala, Val, Leu, or Gly
  SITE (2604)..(2604): Xaa at position 2604 is Phe, Tyr, Met, His, Ile, Leu Val, Ala, or Gly
  SITE (2605)..(2605): Xaa at position 2605 is Tyr, Phe, Met, His, Ile, Leu Val, Ala, or Gly
  SITE (2606)..(2606): Xaa at position 2606 is Phe, Tyr, Met, His, Ile, Leu Val, Ala, or Gly
  SITE (2625)..(2625): Xaa at position 2625 is Phe, Tyr, Met, His, Ile, Leu Val, Ala, or Gly
  SITE (2626)..(2626): Xaa at position 2626 is Ala, Gly, or Pro
  SITE (2656)..(2656): Xaa at position 2656 is Phe, Tyr, Met, His, Ile, Leu Val, Ala, or Gly
  SITE (2676)..(2676): Xaa at position 2676 is Phe, Tyr, Met, His, Ile, Leu Val, Ala, or Gly
  SITE (2681)..(2681): Xaa at position 2681 is Ala, Gly, or Pro
  SITE (2683)..(2683): Xaa at position 2683 is Ala, Gly, or Pro
  SITE (2684)..(2684): Xaa at position 2684 is Ala, Gly, or Pro
  SITE (2685)..(2685): Xaa at position 2685 is Ala, Gly, or Pro
  SITE (2691)..(2691): Xaa at position 2691 is Ile, Ala, Val, Leu, or Gly
  SITE (2697)..(2697): Xaa at position 2697 is Phe, Tyr, Met, His, Ile, Leu Val, Ala, or Gly
  SITE (2698)..(2698): Xaa at position 2698 is Phe, Tyr, Met, His, Ile, Leu Val, Ala, or Gly
MSLISKEEXIKLXYSIRPRENEXKTXXTNXDEYNKXTTNNNENKXLQXKKXNESXDVXXNKYKTSSRNRAXSNXKKDXLKEXILIKNSNTSPVEKNXXXVWIGGEXSDIXLEXIKQXADINAEYNIKXXYDSEXXXXNTXKKXXVESSTTEXLQLXEEEIQNPQFDNMKXXKKRXEFXXDRQKRXINYYKSQINKPTVPTXDDXXKSXXVSEYNRDETVLESYRTNSLRKXNSNHGIDXRANSXXTEQELLNXXSQEXXNRGNLAXXSDXXRXXXXKNFGGXXXDVDXXPGIHSDLFKTISRPSSIGLDRWEMXKXEXXMKYKKYINNYTSENXDKLDQQLKDNXKLIXESKSEKSEXXSKXENLNXSDXEXKXXFALGSVINQXXXSKQGSYXTNLXIEQXKNRXQFXNQHXNPXIESDNNXTDTTKIXHDSXFNSATAENSMXXTKXAPYXQVGXMPEXRSTISXSGPGXXASXXYDXINXQENTIEKTLKASDXIEXKFPENNLSQLTEQEINSLWSFDQASXKYQFEKYVRDYTGGSLSEDNGVDFNKNTALDKNYXLNNKIPSNNVEEAGSKNYXHXXXQLQGDDISYEATXNLXSKNPKNSXXXQRNMNESAKSYFLSDDGESILELNKXRXPERXKNKEKXKXTXXGHGKDEFNTSEXARLSVDSXSNEXSSXLDTXKLDXSPKNXEXNXLGXNXXSYDFNVEETXPGKXXLSXMDKXTSTXPDXNKNSXTXGXNQYEVRINSEGRKEXLAHSGKWXNKEEXXMSDLSSKEYXFFDSIDNKLKXKSKNIPGLASISEDXKTLLLDASVSPDTKFILNNLKLNIESSIGDYIYYEKLEPVKNIIHNSIDDXIDEFNLLENXSDEXYELKKLNNLDEKYXXSXEDISKNNSTYSXRXXNKSNGESVYVETEKEIXSKXSEHXTKEISTIKNSIITDVNGNLLDNIQLDHTSQVNTXNAAXFXQSLIDYSSNKDVLNDLSTSXKXQXYXQLFSTGXNTXYDSIQXVNLISNXVNDTINVLPTITEGIPIVSTILDGINLGAAIKEXLDEHDPLLKKELEAKVGXLAINMSLSIXATVASXVGIGAEVTIFLLPIAGISAGIPSLVNNELILHDKATSXVNXXNHXSESKKYGPLKTEDDKILVPIDDXXXSEIDFNNNSIKLGTXNXLXMEGGSGHTVTGNIDHFFSSPSISSHIPSLSXYSAIGIETENLDFSKKIXMXPNXPSRVXWWETGAVPGLRSLENDGTRLXDSXRDLYPGKXYWRFYAFFDYAXTTXKPVYEDTNXKXKLDKDTRNXIMPTXTTNEIRNKLSYSXDGAGGTXSXLXSSYPXSTNXNXSKDDLXXXNIDNEXREISIENGTIKKGKLIKDVLSKIDINKNKXIIGNQTXDFSGDIDNKDRYIFXTCELDDKXSXXXEXNLVAKSYSLLXSGDKNYLISNXSNTIEKXNTXGLDSKNXAYNYTDESNNKYFGXXSKTSQKSXIHYKKDSKNIXEFYNDSTLEXNSKDFIAEDINVXXKDDINTXTGKYYVDNNTDKSXDXSXSLVSKNQXKXNGXYXNESXYSSXLDFXKNSDGHHNTSNFXNLXXDNISXWKXFGFENINFVIDKYXTXXGKTNLGYVEXICDNNKNIDIYXGEWKTSSSKSTIXSGNGRNXXXEPIYNPDTGEDISTSXDFSXEPXYGIDRYINKXXXAPDLXTSLINXNTNYYSNEYYPEXIVLNPNTFHKKVNXNXDSSSFEYKXSTEGSDXILVRYLEESNKKILQKIRIKGXXSNTQSFNKMSIDXKDIKKLSXGYXMSNFKSFNSENELDRDHLGFKIIDNKTYYYDEDSKLVKGLININNSLFYFDPIEFNLVTGWQTINGKKYYXDINTGAAXTSYKIINGKHXYFNNDGVMQLGVFKGPDGFEYXXPANTQNNNIEGQAIVYQSKFLTLNGKKYYXDNNSKAVTGWRIINNEKYYXNPNNXIXXXGLQVIDNNKYYXNPDTAIISKGWQTVNGSRYYXDTDTAIAXNGYKTIDGKHXYFDSDCVVKIGVFSTSNGFEYXXPANTYNNNIEGQAIVYQSKFLTLNGKKYYXDNNSKAVTGLQTIDSKKYYXNTNTXEXXTGWQTIDGKKXXXNTNTAEAATGWQTIDGKKYYXNTNTAIASTGYTIINGKHXYXNTDGXMQXGVFKGPNGFEYXXPANTDANNIEGQAILYQNEFLTLNGKKYYXGSDSKAVTGWRIINNKKYYXNPNNXIXXIHLCTINNDKYXXSYDGILQNGYITIERNNXYXDANNESKMVTGVFKGPNGFEYXXPANTHNNNIEGQAIVYQNKFLTLNGKKYYXDNDSKAVTGWQTIDGKKYYXNLNTXEXXTGWQTXDGKKXYXNLNTAEAATGWQTIDGKKYYXNTNTFIASTGYTSINGKHXYXNTDGXMQXGVFKGPNGFEYXXPANTDANNIEGQAILYQNKFLTXNGKKYYXGSDSKAVTGLRTIDGKKYYXNTNTXXXXTGWQTINGKKYXXNTNTSIASTGYTIISGKHXYXNTDGIMQIGVFKGPDGFEYXXPANTDANNIEGQAIRYQNRFLYLHDNIYYXGNNSKAATGWVTIDGNRYYXEPNTXMGXNGYKTXDNKNXXXRNGLPQIGVFKGSNGFEYXXPANTDANNIEGQAIRYQNRFLHLLGKIYYXGNNSKAVTGWQTINGKVYYXMPDTXMXXXGGLFEXDGVIYXXGVDGVKAPGIYG

SEQ ID NO: 348 - protein, 677 aa, Homo sapiens
  SITE (41)..(41): Xaa at position 41 is Phe, Tyr, Met, His, Ile, Leu, Val Ala, or Gly
  SITE (51)..(51): Xaa at position 51 is Ile, Ala, Val, Leu, or Gly
  SITE (55)..(55): Xaa at position 55 is Ile, Ala, Val, Leu, or Gly
  SITE (56)..(56): Xaa at position 56 is His, Phe, Tyr, Lys, Arg, Gly, Ser Thr, Ala, Val, Leu, Ile, Asn, Met, or Gln
  SITE (57)..(57): Xaa at position 57 is Tyr, Phe, Met, His, Ile, Leu, Val Ala, or Gly
  SITE (65)..(65): Xaa at position 65 is Trp, Tyr, Phe, Met, His, Ile, Leu Val, Ala, or Gly
  SITE (69)..(69): Xaa at position 69 is Leu, Ala, Val, Gly, or Ile
  SITE (72)..(72): Xaa at position 72 is Met, Ile, Leu, Val, Ala, or Gly
  SITE (75)..(75): Xaa at position 75 is Ala, Gly, or Pro
  SITE (79)..(79): Xaa at position 79 is Ala, Gly, or Pro
  SITE (80)..(80): Xaa at position 80 is Ile, Ala, Val, Leu, or Gly
  SITE (84)..(84): Xaa at position 84 is Val, Ala, Gly, Leu, or Ile
  SITE (86)..(86): Xaa at position 86 is Trp, Tyr, Phe, Met, His, Ile, Leu Val, Ala, or Gly
  SITE (89)..(89): Xaa at position 89 is His, Phe, Tyr, Lys, Arg, Gly, Ser Thr, Ala, Val, Leu, Ile, Asn, Met, or Gln
  SITE (104)..(104): Xaa at position 104 is Val, Ala, Gly, Leu, or Ile
  SITE (107)..(107): Xaa at position 107 is Phe, Tyr, Met, His, Ile, Leu, Val Ala, or Gly
  SITE (108)..(108): Xaa at position 108 is Leu, Ala, Val, Gly, or Ile
  SITE (111)..(111): Xaa at position 111 is Ala, Gly, or Pro
  SITE (112)..(112): Xaa at position 112 is His, Phe, Tyr, Lys, Arg, Gly, Ser Thr, Ala, Val, Leu, Ile, Asn, Met, or Gln
  SITE (116)..(116): Xaa at position 116 is Leu, Ala, Val, Gly, or Ile
  SITE (118)..(118): Xaa at position 118 is Val, Ala, Gly, Leu, or Ile
  SITE (119)..(119): Xaa at position 119 is Ile, Ala, Val, Leu, or Gly
  SITE (120)..(120): Xaa at position 120 is Leu, Ala, Val, Gly, or Ile
  SITE (125)..(125): Xaa at position 125 is Tyr, Phe, Met, His, Ile, Leu, Val Ala, or Gly
  SITE (126)..(126): Xaa at position 126 is Ile, Ala, Val, Leu, or Gly
  SITE (128)..(128): Xaa at position 128 is Ala, Gly, or Pro
  SITE (130)..(130): Xaa at position 130 is Trp, Tyr, Phe, Met, His, Ile, Leu Val, Ala, or Gly
  SITE (132)..(132): Xaa at position 132 is Met, Ile, Leu, Val, Ala, or Gly
  SITE (135)..(135): Xaa at position 135 is Leu, Ala, Val, Gly, or Ile
  SITE (137)..(137): Xaa at position 137 is Ala, Gly, or Pro
  SITE (139)..(139): Xaa at position 139 is Leu, Ala, Val, Gly, or Ile
  SITE (140)..(140): Xaa at position 140 is Leu, Ala, Val, Gly, or Ile
  SITE (146)..(146): Xaa at position 146 is Leu, Ala, Val, Gly, or Ile
  SITE (147)..(147): Xaa at position 147 is Leu, Ala, Val, Gly, or Ile
  SITE (154)..(154): Xaa at position 154 is Tyr, Phe, Met, His, Ile, Leu, Val Ala, or Gly
  SITE (158)..(158): Xaa at position 158 is Val, Ala, Gly, Leu, or Ile
  SITE (161)..(161): Xaa at position 161 is Trp, Tyr, Phe, Met, His, Ile, Leu Val, Ala, or Gly
  SITE (162)..(162): Xaa at position 162 is Leu, Ala, Val, Gly, or Ile
  SITE (165)..(165): Xaa at position 165 is Leu, Ala, Val, Gly, or Ile
  SITE (166)..(166): Xaa at position 166 is Leu, Ala, Val, Gly, or Ile
  SITE (169)..(169): Xaa at position 169 is Met, Ile, Leu, Val, Ala, or Gly
  SITE (172)..(172): Xaa at position 172 is Leu, Ala, Val, Gly, or Ile
  SITE (173)..(173): Xaa at position 173 is Leu, Ala, Val, Gly, or Ile
  SITE (180)..(180): Xaa at position 180 is Val, Ala, Gly, Leu, or Ile
  SITE (181)..(181): Xaa at position 181 is Ile, Ala, Val, Leu, or Gly
  SITE (183)..(183): Xaa at position 183 is Val, Ala, Gly, Leu, or Ile
  SITE (189)..(189): Xaa at position 189 is Tyr, Phe, Met, His, Ile, Leu, Val Ala, or Gly
  SITE (199)..(199): Xaa at position 199 is Tyr, Phe, Met, His, Ile, Leu, Val Ala, or Gly
  SITE (200)..(200): Xaa at position 200 is Leu, Ala, Val, Gly, or Ile
  SITE (203)..(203): Xaa at position 203 is Leu, Ala, Val, Gly, or Ile
  SITE (207)..(207): Xaa at position 207 is Phe, Tyr, Met, His, Ile, Leu, Val Ala, or Gly
  SITE (215)..(215): Xaa at position 215 is Val, Ala, Gly, Leu, or Ile
  SITE (218)..(218): Xaa at position 218 is Phe, Tyr, Met, His, Ile, Leu, Val Ala, or Gly
  SITE (228)..(228): Xaa at position 228 is Leu, Ala, Val, Gly, or Ile
  SITE (236)..(236): Xaa at position 236 is Leu, Ala, Val, Gly, or Ile
  SITE (237)..(237): Xaa at position 237 is Tyr, Phe, Met, His, Ile, Leu, Val Ala, or Gly
  SITE (240)..(240): Xaa at position 240 is Val, Ala, Gly, Leu, or Ile
  SITE (251)..(251): Xaa at position 251 is Ala, Gly, or Pro
  SITE (269)..(269): Xaa at position 269 is Phe, Tyr, Met, His, Ile, Leu, Val Ala, or Gly
  SITE (289)..(289): Xaa at position 289 is Val, Ala, Gly, Leu, or Ile
  SITE (293)..(293): Xaa at position 293 is Leu, Ala, Val, Gly, or Ile
  SITE (296)..(296): Xaa at position 296 is Ile, Ala, Val, Leu, or Gly
  SITE (301)..(301): Xaa at position 301 is Ala, Gly, or Pro
  SITE (303)..(303): Xaa at position 303 is Val, Ala, Gly, Leu, or Ile
  SITE (305)..(305): Xaa at position 305 is Leu, Ala, Val, Gly, or Ile
  SITE (307)..(307): Xaa at position 307 is Met, Ile, Leu, Val, Ala, or Gly
  SITE (308)..(308): Xaa at position 308 is Phe, Tyr, Met, His, Ile, Leu, Val Ala, or Gly
  SITE (309)..(309): Xaa at position 309 is Ile, Ala, Val, Leu, or Gly
  SITE (320)..(320): Xaa at position 320 is Ala, Gly, or Pro
  SITE (337)..(337): Xaa at position 337 is Leu, Ala, Val, Gly, or Ile
  SITE (340)..(340): Xaa at position 340 is Ala, Gly, or Pro
  SITE (347)..(347): Xaa at position 347 is Tyr, Phe, Met, His, Ile, Leu, Val Ala, or Gly
  SITE (350)..(350): Xaa at position 350 is Leu, Ala, Val, Gly, or Ile
  SITE (353)..(353): Xaa at position 353 is Ile, Ala, Val, Leu, or Gly
  SITE (354)..(354): Xaa at position 354 is Ile, Ala, Val, Leu, or Gly
  SITE (387)..(387): Xaa at position 387 is Ala, Gly, or Pro
  SITE (388)..(388): Xaa at position 388 is Ala, Gly, or Pro
  SITE (392)..(392): Xaa at position 392 is Leu, Ala, Val, Gly, or Ile
  SITE (406)..(406): Xaa at position 406 is Phe, Tyr, Met, His, Ile, Leu, Val Ala, or Gly
  SITE (415)..(415): Xaa at position 415 is Phe, Tyr, Met, His, Ile, Leu, Val Ala, or Gly
  SITE (416)..(416): Xaa at position 416 is Val, Ala, Gly, Leu, or Ile
  SITE (418)..(418): Xaa at position 418 is Tyr, Phe, Met, His, Ile, Leu, Val Ala, or Gly
  SITE (426)..(426): Xaa at position 426 is Cys, Ala, Val, Gly, Ser, or Thr
  SITE (432)..(432): Xaa at position 432 is Leu, Ala, Val, Gly, or Ile
  SITE (439)..(439): Xaa at position 439 is Val, Ala, Gly, Leu, or Ile
  SITE (443)..(443): Xaa at position 443 is Ala, Gly, or Pro
  SITE (447)..(447): Xaa at position 447 is Val, Ala, Gly, Leu, or Ile
  SITE (455)..(455): Xaa at position 455 is Leu, Ala, Val, Gly, or Ile
  SITE (465)..(465): Xaa at position 465 is Ile, Ala, Val, Leu, or Gly
  SITE (471)..(471): Xaa at position 471 is Ala, Gly, or Pro
  SITE (473)..(473): Xaa at position 473 is Leu, Ala, Val, Gly, or Ile
  SITE (475)..(475): Xaa at position 475 is Leu, Ala, Val, Gly, or Ile
  SITE (477)..(477): Xaa at position 477 is Val, Ala, Gly, Leu, or Ile
  SITE (483)..(483): Xaa at position 483 is Val, Ala, Gly, Leu, or Ile
  SITE (489)..(489): Xaa at position 489 is Ile, Ala, Val, Leu, or Gly
  SITE (495)..(495): Xaa at position 495 is Leu, Ala, Val, Gly, or Ile
  SITE (499)..(499): Xaa at position 499 is Leu, Ala, Val, Gly, or Ile
  SITE (501)..(501): Xaa at position 501 is Leu, Ala, Val, Gly, or Ile
  SITE (509)..(509): Xaa at position 509 is Trp, Tyr, Phe, Met, His, Ile, Leu Val, Ala, or Gly
  SITE (511)..(511): Xaa at position 511 is Ile, Ala, Val, Leu, or Gly
  SITE (519)..(519): Xaa at position 519 is Ala, Gly, or Pro
  SITE (524)..(524): Xaa at position 524 is Leu, Ala, Val, Gly, or Ile
  SITE (550)..(550): Xaa at position 550 is Ala, Gly, or Pro
  SITE (551)..(551): Xaa at position 551 is Phe, Tyr, Met, His, Ile, Leu, Val Ala, or Gly
  SITE (558)..(558): Xaa at position 558 is Ile, Ala, Val, Leu, or Gly
  SITE (571)..(571): Xaa at position 571 is Ile, Ala, Val, Leu, or Gly
  SITE (573)..(573): Xaa at position 573 is Phe, Tyr, Met, His, Ile, Leu, Val Ala, or Gly
  SITE (581)..(581): Xaa at position 581 is Val, Ala, Gly, Leu, or Ile
  SITE (582)..(582): Xaa at position 582 is Trp, Tyr, Phe, Met, His, Ile, Leu Val, Ala, or Gly
  SITE (583)..(583): Xaa at position 583 is Ile, Ala, Val, Leu, or Gly
  SITE (588)..(588): Xaa at position 588 is Leu, Ala, Val, Gly, or Ile
  SITE (591)..(591): Xaa at position 591 is Tyr, Phe, Met, His, Ile, Leu, Val Ala, or Gly
  SITE (601)..(601): Xaa at position 601 is Leu, Ala, Val, Gly, or Ile
  SITE (603)..(603): Xaa at position 603 is Val, Ala, Gly, Leu, or Ile
  SITE (616)..(616): Xaa at position 616 is Ile, Ala, Val, Leu, or Gly
  SITE (618)..(618): Xaa at position 618 is Val, Ala, Gly, Leu, or Ile
  SITE (624)..(624): Xaa at position 624 is Ala, Gly, or Pro
  SITE (635)..(635): Xaa at position 635 is Ala, Gly, or Pro
  SITE (636)..(636): Xaa at position 636 is Val, Ala, Gly, Leu, or Ile
  SITE (638)..(638): Xaa at position 638 is Phe, Tyr, Met, His, Ile, Leu, Val Ala, or Gly
MPGFLVRILPLLLVLLLLGPTRGLRNATQRMFEIDYSRDSXLKDGQPFRYXSGSXXXSRVPRFYXKDRXLKXKMXGLNXXQTYXPXNFXEPWPGQYQFSEDHDXEYXXRLXXELGXLXXXRPGPXXCXEXEXGGXPXWXXEKESIXXRSSDPDXLAAXDKXXGVXXPKXKPXXYQNGGPXXTXQVENEXGSYFACDFDXXRFXQKRXRHHLGDDXVLXTTDGAHKTFXKCGALQGXXTTXDFGTGSNITDXFLSQRKCEPKGPLINSEXYTGWLDHWGQPHSTIKTEAXASSXYDXLARGXSXNXYXXXGGTNFAYWNGXNSPYAAQPTSYDYDAPXSEXGDLTEKXFAXRNXXQKFEKVPEGPIPPSTPKFAYGKVTLEKLKTVGXXLDIXCPSGPIKSLYPLTXIQVKQHYGXXLXRTTLPQDXSNPAPXSSPLNGXHDRXYVAXDGIPQGVXERNNVITLNXTGKAGXTXDXLXENMGRXNYGAYXNDFKGXVSNXTXSSNILTDXTXFPLDTEDXVRSHXGGWGHRDSGHHDEAWAHNSSNYTLPXXYMGNFSXPSGIPDLPQDTFXQXPGWTKGQXXXNGFNXGRXWPARGPQLTXFXPQHILMTSAPNTXTXLELEWXPCSSDDPELCXXTXVDRPVIGSSVTYDHPSKPVEKRLMPPPPQKNKDSWLDHV

SEQ ID NO: 349 - protein, 226 aa, Homo sapiens
  SITE (47)..(47): Xaa at position 47 is Ile, Ala, Val, Leu, or Gly
  SITE (65)..(65): Xaa at position 65 is Leu, Ala, Val, Gly, or Ile
  SITE (83)..(83): Xaa at position 83 is Ile, Ala, Val, Leu, or Gly
  SITE (87)..(87): Xaa at position 87 is Leu, Ala, Val, Gly, or Ile
  SITE (90)..(90): Xaa at position 90 is Leu, Ala, Val, Gly, or Ile
  SITE (96)..(96): Xaa at position 96 is Leu, Ala, Val, Gly, or Ile
MSETAPAETATPAPVEKSPAKKKATKKAAGAGAAKRKATGPPVSELXTKAVAASKERNGLSLAAXKKALAAGGYDVEKNNSRXKLGXKSXVSKGTXVQTKGTGASGSFKLNKKAASGEAKPKAKKAGAAKAKKPAGATPKKAKKAAGAKKAVKKTPKKAKKPAAAGVKKVAKSPKKAKAAAKPKKATKSPAKPKAVKPKAAKPKAAKPKAAKPKAAKAKKAAAKKK

SEQ ID NO: 350 - protein, 223 aa, Homo sapiens
  SITE (40)..(40): Xaa at position 40 is Val, Ala, Gly, Leu, or Ile
  SITE (48)..(48): Xaa at position 48 is Ala, Gly, or Pro
  SITE (54)..(54): Xaa at position 54 is Ala, Gly, or Pro
  SITE (56)..(56): Xaa at position 56 is Phe, Tyr, Met, His, Ile, Leu, Val Ala, or Gly
  SITE (58)..(58): Xaa at position 58 is Cys, Ala, Val, Gly, Ser, or Thr
  SITE (60)..(60): Xaa at position 60 is Tyr, Phe, Met, His, Ile, Leu, Val Ala, or Gly
  SITE (66)..(66): Xaa at position 66 is Ala, Gly, or Pro
  SITE (69)..(69): Xaa at position 69 is Val, Ala, Gly, Leu, or Ile
  SITE (71)..(71): Xaa at position 71 is Val, Ala, Gly, Leu, or Ile
  SITE (73)..(73): Xaa at position 73 is Val, Ala, Gly, Leu, or Ile
  SITE (85)..(85): Xaa at position 85 is Cys, Ala, Val, Gly, Ser, or Thr
  SITE (86)..(86): Xaa at position 86 is Ala, Gly, or Pro
  SITE (87)..(87): Xaa at position 87 is Ala, Gly, or Pro
  SITE (95)..(95): Xaa at position 95 is Leu, Ala, Val, Gly, or Ile
  SITE (112)..(112): Xaa at position 112 is Val, Ala, Gly, Leu, or Ile
  SITE (114)..(114): Xaa at position 114 is Leu, Ala, Val, Gly, or Ile
  SITE (116)..(116): Xaa at position 116 is Ile, Ala, Val, Leu, or Gly
  SITE (127)..(127): Xaa at position 127 is Tyr, Phe, Met, His, Ile, Leu, Val Ala, or Gly
  SITE (129)..(129): Xaa at position 129 is Cys, Ala, Val, Gly, Ser, or Thr
  SITE (131)..(131): Xaa at position 131 is Val, Ala, Gly, Leu, or Ile
  SITE (149)..(149): Xaa at position 149 is Ile, Ala, Val, Leu, or Gly
  SITE (151)..(151): Xaa at position 151 is Val, Ala, Gly, Leu, or Ile
MACLGFQRHKAQLNLATRTWPCTLLFFLLFIPVFCKAMHXAQPAVVLXSSRGIXSXVXEXASPGKXTEXRXTXLRQADSQVTEVXXXTYMMGNEXTFLDDSICTGTSSGNQXNXTXQGLRAMDTGLXIXKXELMYPPPYYLGIGNGTQXYXIDPEPCPDSDFLLWILAAVSSGLFFYSFLLTAVSLSKMLKKRSPLTTGVYVKMPPTEPECEKQFQPYFIPIN

SEQ ID NO: 351 - protein, 314 aa, Homo sapiens
  SITE (32)..(32): Xaa at position 32 is Tyr, Phe, Met, His, Ile, Leu, Val Ala, or Gly
  SITE (48)..(48): Xaa at position 48 is Cys, Ala, Val, Gly, Ser, or Thr
  SITE (66)..(66): Xaa at position 66 is Cys, Ala, Val, Gly, Ser, or Thr
  SITE (68)..(68): Xaa at position 68 is Val, Ala, Gly, Leu, or Ile
  SITE (122)..(122): Xaa at position 122 is Ala, Gly, or Pro
  SITE (144)..(144): Xaa at position 144 is Ile, Ala, Val, Leu, or Gly
  SITE (150)..(150): Xaa at position 150 is His, Phe, Tyr, Lys, Arg, Gly, Ser Thr, Ala, Val, Leu, Ile, Asn, Met, or Gln
  SITE (162)..(162): Xaa at position 162 is Leu, Ala, Val, Gly, or Ile
  SITE (176)..(176): Xaa at position 176 is Leu, Ala, Val, Gly, or Ile
  SITE (180)..(180): Xaa at position 180 is Phe, Tyr, Met, His, Ile, Leu, Val Ala, or Gly
  SITE (185)..(185): Xaa at position 185 is Leu, Ala, Val, Gly, or Ile
  SITE (191)..(191): Xaa at position 191 is Ile, Ala, Val, Leu, or Gly
  SITE (195)..(195): Xaa at position 195 is Leu, Ala, Val, Gly, or Ile
  SITE (207)..(207): Xaa at position 207 is Val, Ala, Gly, Leu, or Ile
  SITE (209)..(209): Xaa at position 209 is Ile, Ala, Val, Leu, or Gly
  SITE (213)..(213): Xaa at position 213 is Ala, Gly, or Pro
  SITE (215)..(215): Xaa at position 215 is Tyr, Phe, Met, His, Ile, Leu, Val Ala, or Gly
MAPPQVLAFGLLLAAATATFAAAQEECVCENXKLAVNCFVNNNRQCQXTSVGAQNTVICSKLAAKXLXMKAEMNGSKLGRRAKPEGALQNNDGLYDPDCDESGLFKAKQCNGTSMCWCVNTXGVRRTDKDTEITCSERVRTYWXIIELKXKAREKPYDSKSXRTALQKEITTRYQXDPKXITSIXYENNVXTIDXVQNSSQKTQNDXDXADVXYXFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 352 - protein, 354 aa, Homo sapiens
  SITE (92)..(92): Xaa at position 92 is Ala, Gly, or Pro
  SITE (94)..(94): Xaa at position 94 is Ile, Ala, Val, Leu, or Gly
  SITE (116)..(116): Xaa at position 116 is Ile, Ala, Val, Leu, or Gly
  SITE (118)..(118): Xaa at position 118 is Leu, Ala, Val, Gly, or Ile
  SITE (120)..(120): Xaa at position 120 is Val, Ala, Gly, Leu, or Ile
  SITE (122)..(122): Xaa at position 122 is Ala, Gly, or Pro
  SITE (123)..(123): Xaa at position 123 is Ile, Ala, Val, Leu, or Gly
  SITE (130)..(130): Xaa at position 130 is Leu, Ala, Val, Gly, or Ile
  SITE (133)..(133): Xaa at position 133 is Phe, Tyr, Met, His, Ile, Leu, Val Ala, or Gly
  SITE (134)..(134): Xaa at position 134 is Leu, Ala, Val, Gly, or Ile
  SITE (137)..(137): Xaa at position 137 is Ala, Gly, or Pro
  SITE (141)..(141): Xaa at position 141 is Phe, Tyr, Met, His, Ile, Leu, Val Ala, or Gly
  SITE (142)..(142): Xaa at position 142 is Met, Ile, Leu, Val, Ala, or Gly
  SITE (145)..(145): Xaa at position 145 is His, Phe, Tyr, Lys, Arg, Gly, Ser Thr, Ala, Val, Leu, Ile, Asn, Met, or Gln
  SITE (147)..(147): Xaa at position 147 is Val, Ala, Gly, Leu, or Ile
  SITE (148)..(148): Xaa at position 148 is His, Phe, Tyr, Lys, Arg, Gly, Ser Thr, Ala, Val, Leu, Ile, Asn, Met, or Gln
  SITE (149)..(149): Xaa at position 149 is Tyr, Phe, Met, His, Ile, Leu, Val Ala, or Gly
  SITE (150)..(150): Xaa at position 150 is Tyr, Phe, Met, His, Ile, Leu, Val Ala, or Gly
  SITE (151)..(151): Xaa at position 151 is Val, Ala, Gly, Leu, or Ile
  SITE (152)..(152): Xaa at position 152 is Phe, Tyr, Met, His, Ile, Leu, Val Ala, or Gly
  SITE (189)..(189): Xaa at position 189 is Met, Ile, Leu, Val, Ala, or Gly
  SITE (191)..(191): Xaa at position 191 is Met, Ile, Leu, Val, Ala, or Gly
  SITE (192)..(192): Xaa at position 192 is Ile, Ala, Val, Leu, or Gly
  SITE (195)..(195): Xaa at position 195 is Phe, Tyr, Met, His, Ile, Leu, Val Ala, or Gly
  SITE (196)..(196): Xaa at position 196 is Cys, Ala, Val, Gly, Ser, or Thr
  SITE (200)..(200): Xaa at position 200 is Phe, Tyr, Met, His, Ile, Leu, Val Ala, or Gly
  SITE (204)..(204): Xaa at position 204 is Val, Ala, Gly, Leu, or Ile
  SITE (206)..(206): Xaa at position 206 is Tyr, Phe, Met, His, Ile, Leu, Val Ala, or Gly
  SITE (207)..(207): Xaa at position 207 is Leu, Ala, Val, Gly, or Ile
  SITE (208)..(208): Xaa at position 208 is Val, Ala, Gly, Leu, or Ile
  SITE (209)..(209): Xaa at position 209 is Cys, Ala, Val, Gly, Ser, or Thr
  SITE (210)..(210): Xaa at position 210 is Val, Ala, Gly, Leu, or Ile
  SITE (212)..(212): Xaa at position 212 is Val, Ala, Gly, Leu, or Ile
  SITE (214)..(214): Xaa at position 214 is Met, Ile, Leu, Val, Ala, or Gly
  SITE (216)..(216): Xaa at position 216 is Phe, Tyr, Met, His, Ile, Leu, Val Ala, or Gly
  SITE (220)..(220): Xaa at position 220 is Val, Ala, Gly, Leu, or Ile
  SITE (222)..(222): Xaa at position 222 is Val, Ala, Gly, Leu, or Ile
  SITE (224)..(224): Xaa at position 224 is Ile, Ala, Val, Leu, or Gly
  SITE (225)..(225): Xaa at position 225 is Leu, Ala, Val, Gly, or Ile
  SITE (228)..(228): Xaa at position 228 is Leu, Ala, Val, Gly, or Ile
  SITE (229)..(229): Xaa at position 229 is Phe, Tyr, Met, His, Ile, Leu, Val Ala, or Gly
  SITE (232)..(232): Xaa at position 232 is Leu, Ala, Val, Gly, or Ile
  SITE (254)..(254): Xaa at position 254 is Ala, Gly, or Pro
  SITE (256)..(256): Xaa at position 256 is Ile, Ala, Val, Leu, or Gly
  SITE (264)..(264): Xaa at position 264 is Tyr, Phe, Met, His, Ile, Leu, Val Ala, or Gly
  SITE (265)..(265): Xaa at position 265 is Tyr, Phe, Met, His, Ile, Leu, Val Ala, or Gly
  SITE (266)..(266): Xaa at position 266 is Leu, Ala, Val, Gly, or Ile
  SITE (268)..(268): Xaa at position 268 is Gly, Ala, or Pro
  SITE (269)..(269): Xaa at position 269 is Phe, Tyr, Met, His, Ile, Leu, Val Ala, or Gly
  SITE (270)..(270): Xaa at position 270 is Phe, Tyr, Met, His, Ile, Leu, Val Ala, or Gly
  SITE (274)..(274): Xaa at position 274 is Val, Ala, Gly, Leu, or Ile
  SITE (277)..(277): Xaa at position 277 is Val, Ala, Gly, Leu, or Ile
  SITE (280)..(280): Xaa at position 280 is Leu, Ala, Val, Gly, or Ile
  SITE (284)..(284): Xaa at position 284 is Cys, Ala, Val, Gly, Ser, or Thr
  SITE (288)..(288): Xaa at position 288 is Met, Ile, Leu, Val, Ala, or Gly
  SITE (290)..(290): Xaa at position 290 is Val, Ala, Gly, Leu, or Ile
  SITE (298)..(298): Xaa at position 298 is Ala, Gly, or Pro
  SITE (305)..(305): Xaa at position 305 is His, Phe, Tyr, Lys, Arg, Gly, Ser Thr, Ala, Val, Leu, Ile, Asn, Met, or Gln
  SITE (306)..(306): Xaa at position 306 is Leu, Ala, Val, Gly, or Ile
  SITE (310)..(310): Xaa at position 310 is Leu, Ala, Val, Gly, or Ile
  SITE (318)..(318): Xaa at position 318 is Val, Ala, Gly, Leu, or Ile
  SITE (319)..(319): Xaa at position 319 is Leu, Ala, Val, Gly, or Ile
  SITE (323)..(323): Xaa at position 323 is Tyr, Phe, Met, His, Ile, Leu, Val Ala, or Gly
  SITE (324)..(324): Xaa at position 324 is Leu, Ala, Val, Gly, or Ile
  SITE (325)..(325): Xaa at position 325 is Trp, Tyr, Phe, Met, His, Ile, Leu Val, Ala, or Gly
  SITE (336)..(336): Xaa at position 336 is Leu, Ala, Val, Gly, or Ile
  SITE (339)..(339): Xaa at position 339 is Leu, Ala, Val, Gly, or Ile
  SITE (341)..(341): Xaa at position 341 is Phe, Tyr, Met, His, Ile, Leu, Val Ala, or Gly
MAEVLRTLAGKPKCHALRPMILFLIMLVLVLFGYGVLSPRSLMPGSLERGFCMAVREPDHLQRVSLPRMVYPQPKVLTPCRKDVLVVTPWLXPXVWEGTFNIDILNEQFRLQNTTXGXTXFXXKKYVAFXKLXXETXEKHXXVGXRXXXXXXTDQPAAVPRVTLGTGRQLSVLEVRAYKRWQDVSMRRXEXXSDXXERRXLSEXDXXXXXDXDXEXRDHXGXEXXTPXXGTXHPGFYGSSREAFTYERRPQSQXYXPKDEGDFXXXGXXXGGSXQEXQRXTRAXHQAXMXDQANGIEXVWHDESXXNKYXLRHKPTKXXSPEXXXDQQLLGWPAVXRKXRXTAVPKNHQAVRNP

SEQ ID NO: 353 - protein, 764 aa, Homo sapiens
  SITE (41)..(41): Xaa at position 41 is Cys, Ala, Val, Gly, Ser, or Thr
  SITE (57)..(57): Xaa at position 57 is Leu, Ala, Val, Gly, or Ile
  SITE (59)..(59): Xaa at position 59 is Leu, Ala, Val, Gly, or Ile
  SITE (64)..(64): Xaa at position 64 is Leu, Ala, Val, Gly, or Ile
  SITE (67)..(67): Xaa at position 67 is Ile, Ala, Val, Leu, or Gly
  SITE (72)..(72): Xaa at position 72 is Phe, Tyr, Met, His, Ile, Leu, Val Ala, or Gly
  SITE (78)..(78): Xaa at position 78 is Ile, Ala, Val, Leu, or Gly
  SITE (81)..(81): Xaa at position 81 is Ile, Ala, Val, Leu, or Gly
  SITE (83)..(83): Xaa at position 83 is Val, Ala, Gly, Leu, or Ile
  SITE (89)..(89): Xaa at position 89 is Leu, Ala, Val, Gly, or Ile
  SITE (92)..(92): Xaa at position 92 is Leu, Ala, Val, Gly, or Ile
  SITE (97)..(97): Xaa at position 97 is Phe, Tyr, Met, His, Ile, Leu, Val Ala, or Gly
  SITE (103)..(103): Xaa at position 103 is Val, Ala, Gly, Leu, or Ile
  SITE (106)..(106): Xaa at position 106 is Ile, Ala, Val, Leu, or Gly
  SITE (108)..(108): Xaa at position 108 is Ile, Ala, Val, Leu, or Gly
  SITE (114)..(114): Xaa at position 114 is Leu, Ala, Val, Gly, or Ile
  SITE (121)..(121): Xaa at position 121 is Ala, Gly, or Pro
  SITE (122)..(122): Xaa at position 122 is Leu, Ala, Val, Gly, or Ile
  SITE (125)..(125): Xaa at position 125 is Leu, Ala, Val, Gly, or Ile
  SITE (128)..(128): Xaa at position 128 is Leu, Ala, Val, Gly, or Ile
  SITE (131)..(131): Xaa at position 131 is Leu, Ala, Val, Gly, or Ile
  SITE (133)..(133): Xaa at position 133 is Ile, Ala, Val, Leu, or Gly
  SITE (144)..(144): Xaa at position 144 is Leu, Ala, Val, Gly, or Ile
  SITE (147)..(147): Xaa at position 147 is Val, Ala, Gly, Leu, or Ile
  SITE (154)..(154): Xaa at position 154 is Phe, Tyr, Met, His, Ile, Leu, Val Ala, or Gly
  SITE (156)..(156): Xaa at position 156 is Leu, Ala, Val, Gly, or Ile
  SITE (158)..(158): Xaa at position 158 is Ile, Ala, Val, Leu, or Gly
  SITE (164)..(164): Xaa at position 164 is Met, Ile, Leu, Val, Ala, or Gly
  SITE (167)..(167): Xaa at position 167 is Ile, Ala, Val, Leu, or Gly
  SITE (175)..(175): Xaa at position 175 is Leu, Ala, Val, Gly, or Ile
  SITE (180)..(180): Xaa at position 180 is Leu, Ala, Val, Gly, or Ile
  SITE (182)..(182): Xaa at position 182 is Leu, Ala, Val, Gly, or Ile
  SITE (184)..(184): Xaa at position 184 is Leu, Ala, Val, Gly, or Ile
  SITE (189)..(189): Xaa at position 189 is Phe, Tyr, Met, His, Ile, Leu, Val Ala, or Gly
  SITE (192)..(192): Xaa at position 192 is Val, Ala, Gly, Leu, or Ile
  SITE (196)..(196): Xaa at position 196 is Ala, Gly, or Pro
  SITE (197)..(197): Xaa at position 197 is Phe, Tyr, Met, His, Ile, Leu, Val Ala, or Gly
  SITE (205)..(205): Xaa at position 205 is Val, Ala, Gly, Leu, or Ile
  SITE (207)..(207): Xaa at position 207 is Leu, Ala, Val, Gly, or Ile
  SITE (213)..(213): Xaa at position 213 is Leu, Ala, Val, Gly, or Ile
  SITE (220)..(220): Xaa at position 220 is Ala, Gly, or Pro
  SITE (231)..(231): Xaa at position 231 is Leu, Ala, Val, Gly, or Ile
  SITE (233)..(233): Xaa at position 233 is Val, Ala, Gly, Leu, or Ile
  SITE (252)..(252): Xaa at position 252 is Leu, Ala, Val, Gly, or Ile
MRPADLLQLVLLLDLPRDLGGMGCSSPPCECHQEEDFRVTXKDIQRIPSLPPSTQTXKXIETHXRTXPSHAXSNLPNXSRXYXSIDVTXQQXESHSXYNLSKXTHXEXRNTRNXTYIDPDXXKEXPLXKFXGXFNTGLKMFPDXTKXYSTDIFXIXEXTDNPYXTSXPVNAFQGXCNETXTXKXYNNGXTSXQGYXXNGTKLDAXYXNKNKYXTVIDKDXFGGVYSGPSLXDXSQTSVTALPSKGLEHLKEXIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 354 - protein, 459 aa, Homo sapiens
  SITE (55)..(55): Xaa at position 55 is Leu, Ala, Val, Gly, or Ile
  SITE (57)..(57): Xaa at position 57 is Cys, Ala, Val, Gly, Ser, or Thr
  SITE (73)..(73): Xaa at position 73 is Ile, Ala, Val, Leu, or Gly
  SITE (92)..(92): Xaa at position 92 is Tyr, Phe, Met, His, Ile, Leu, Val Ala, or Gly
  SITE (107)..(107): Xaa at position 107 is Ile, Ala, Val, Leu, or Gly
  SITE (109)..(109): Xaa at position 109 is Val, Ala, Gly, Leu, or Ile
  SITE (123)..(123): Xaa at position 123 is Leu, Ala, Val, Gly, or Ile
  SITE (127)..(127): Xaa at position 127 is Val, Ala, Gly, Leu, or Ile
  SITE (146)..(146): Xaa at position 146 is Phe, Tyr, Met, His, Ile, Leu, Val Ala, or Gly
  SITE (148)..(148): Xaa at position 148 is Val, Ala, Gly, Leu, or Ile
  SITE (160)..(160): Xaa at position 160 is Val, Ala, Gly, Leu, or Ile
  SITE (167)..(167): Xaa at position 167 is Val, Ala, Gly, Leu, or Ile
  SITE (168)..(168): Xaa at position 168 is Ala, Gly, or Pro
  SITE (203)..(203): Xaa at position 203 is Ile, Ala, Val, Leu, or Gly
  SITE (205)..(205): Xaa at position 205 is Val, Ala, Gly, Leu, or Ile
MTILGTTFGMVFSLLQVVSGESGYAQNGDLEDAELDDYSFSCYSQLEVNGSQHSXTXAFEDPDVNTTNLEFEXCGALVEVKCLNFRKLQEIXFIETKKFLLIGKSNXCXKVGEKSLTCKKIDXTTIXKPEAPFDLSVIYREGANDXVXTFNTSHLQKKYXKVLMHDXXYRQEKDENKWTHVNLSSTKLTLLQRKLQPAAMYEXKXRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 355 - protein, 419 aa, Homo sapiens
  SITE (17)..(17): Xaa at position 17 is Leu, Ala, Val, Gly, or Ile
  SITE (21)..(21): Xaa at position 21 is Val, Ala, Gly, Leu, or Ile
  SITE (22)..(22): Xaa at position 22 is Phe, Tyr, Met, His, Ile, Leu, Val Ala, or Gly
  SITE (32)..(32): Xaa at position 32 is Ile, Ala, Val, Leu, or Gly
  SITE (34)..(34): Xaa at position 34 is Val, Ala, Gly, Leu, or Ile
  SITE (35)..(35): Xaa at position 35 is Ala, Gly, or Pro
  SITE (36)..(36): Xaa at position 36 is Ile, Ala, Val, Leu, or Gly
  SITE (40)..(40): Xaa at position 40 is Ile, Ala, Val, Leu, or Gly
  SITE (41)..(41): Xaa at position 41 is Leu, Ala, Val, Gly, or Ile
  SITE (43)..(43): Xaa at position 43 is Leu, Ala, Val, Gly, or Ile
  SITE (46)..(46): Xaa at position 46 is Ile, Ala, Val, Leu, or Gly
  SITE (50)..(50): Xaa at position 50 is Phe, Tyr, Met, His, Ile, Leu, Val Ala, or Gly
  SITE (55)..(55): Xaa at position 55 is Leu, Ala, Val, Gly, or Ile
  SITE (62)..(62): Xaa at position 62 is Phe, Tyr, Met, His, Ile, Leu, Val Ala, or Gly
  SITE (67)..(67): Xaa at position 67 is Leu, Ala, Val, Gly, or Ile
  SITE (70)..(70): Xaa at position 70 is Phe, Tyr, Met, His, Ile, Leu, Val Ala, or Gly
  SITE (71)..(71): Xaa at position 71 is Met, Ile, Leu, Val, Ala, or Gly
  SITE (77)..(77): Xaa at position 77 is Ala, Gly, or Pro
  SITE (81)..(81): Xaa at position 81 is Ala, Gly, or Pro
  SITE (85)..(85): Xaa at position 85 is Leu, Ala, Val, Gly, or Ile
  SITE (89)..(89): Xaa at position 89 is Leu, Ala, Val, Gly, or Ile
  SITE (96)..(96): Xaa at position 96 is Leu, Ala, Val, Gly, or Ile
  SITE (102)..(102): Xaa at position 102 is Leu, Ala, Val, Gly, or Ile
  SITE (106)..(106): Xaa at position 106 is Ala, Gly, or Pro
  SITE (196)..(196): Xaa at position 196 is Leu, Ala, Val, Gly, or Ile
  SITE (198)..(198): Xaa at position 198 is Met, Ile, Leu, Val, Ala, or Gly
  SITE (200)..(200): Xaa at position 200 is Leu, Ala, Val, Gly, or Ile
  SITE (202)..(202): Xaa at position 202 is Met, Ile, Leu, Val, Ala, or Gly
  SITE (203)..(203): Xaa at position 203 is Ala, Gly, or Pro
  SITE (204)..(204): Xaa at position 204 is Phe, Tyr, Met, His, Ile, Leu, Val Ala, or Gly
  SITE (205)..(205): Xaa at position 205 is Phe, Tyr, Met, His, Ile, Leu, Val Ala, or Gly
  SITE (206)..(206): Xaa at position 206 is Val, Ala, Gly, Leu, or Ile
  SITE (221)..(221): Xaa at position 221 is Ala, Gly, or Pro
  SITE (228)..(228): Xaa at position 228 is Met, Ile, Leu, Val, Ala, or Gly
  SITE (229)..(229): Xaa at position 229 is Val, Ala, Gly, Leu, or Ile
  SITE (230)..(230): Xaa at position 230 is Leu, Ala, Val, Gly, or Ile
  SITE (231)..(231): Xaa at position 231 is Met, Ile, Leu, Val, Ala, or Gly
  SITE (234)..(234): Xaa at position 234 is Trp, Tyr, Phe, Met, His, Ile, Leu Val, Ala, or Gly
  SITE (236)..(236): Xaa at position 236 is Ala, Gly, or Pro
  SITE (259)..(259): Xaa at position 259 is Val, Ala, Gly, Leu, or Ile
  SITE (263)..(263): Xaa at position 263 is Val, Ala, Gly, Leu, or Ile
  SITE (264)..(264): Xaa at position 264 is Val, Ala, Gly, Leu, or Ile
  SITE (268)..(268): Xaa at position 268 is Ala, Gly, or Pro
  SITE (269)..(269): Xaa at position 269 is Leu, Ala, Val, Gly, or Ile
  SITE (287)..(287): Xaa at position 287 is Leu, Ala, Val, Gly, or Ile
  SITE (295)..(295): Xaa at position 295 is Phe, Tyr, Met, His, Ile, Leu, Val Ala, or Gly
  SITE (297)..(297): Xaa at position 297 is Ile, Ala, Val, Leu, or Gly
  SITE (301)..(301): Xaa at position 301 is Val, Ala, Gly, Leu, or Ile
  SITE (303)..(303): Xaa at position 303 is Leu, Ala, Val, Gly, or Ile
  SITE (315)..(315): Xaa at position 315 is Cys, Ala, Val, Gly, Ser, or Thr
  SITE (324)..(324): Xaa at position 324 is Trp, Tyr, Phe, Met, His, Ile, Leu Val, Ala, or Gly
  SITE (326)..(326): Xaa at position 326 is Met, Ile, Leu, Val, Ala, or Gly
  SITE (327)..(327): Xaa at position 327 is Leu, Ala, Val, Gly, or Ile
  SITE (330)..(330): Xaa at position 330 is Leu, Ala, Val, Gly, or Ile
  SITE (345)..(345): Xaa at position 345 is Leu, Ala, Val, Gly, or Ile
  SITE (346)..(346): Xaa at position 346 is Leu, Ala, Val, Gly, or Ile
  SITE (347)..(347): Xaa at position 347 is Ala, Gly, or Pro
  SITE (351)..(351): Xaa at position 351 is Ile, Ala, Val, Leu, or Gly
  SITE (362)..(362): Xaa at position 362 is Met, Ile, Leu, Val, Ala, or Gly
  SITE (375)..(375): Xaa at position 375 is Leu, Ala, Val, Gly, or Ile
  SITE (390)..(390): Xaa at position 390 is Val, Ala, Gly, Leu, or Ile
  SITE (392)..(392): Xaa at position 392 is Ile, Ala, Val, Leu, or Gly
  SITE (396)..(396): Xaa at position 396 is Cys, Ala, Val, Gly, Ser, or Thr
  SITE (403)..(403): Xaa at position 403 is Ile, Ala, Val, Leu, or Gly
  SITE (405)..(405): Xaa at position 405 is Phe, Tyr, Met, His, Ile, Leu, Val Ala, or Gly
  SITE (408)..(408): Xaa at position 408 is Cys, Ala, Val, Gly, Ser, or Thr
  SITE (412)..(412): Xaa at position 412 is Val, Ala, Gly, Leu, or Ile
MSFIPVAEDSDFPIHNXPYGXXSTRGDPRPRXGXXXGDQXXDXSIXKHLXTGPVXSKHQDVXNQPTXNSXXGLGQAXWKEXRVFXQNLXSVSQARXRDDTEXRKCXFISQASATMHLPATIGDYTDFYSSRQHATNVGIMFRDKENALMPNWLHLPVGYHGRASSVVVSGTPIRRPMGQMKPDDSKPPVYGACKLXDXEXEXXXXXGPGNRLGEPIPISKXHEHIFGXXXXNDXSXRDIQKWEYVPLGPFLGKSFGTTXSPWXXPMDXXMPFAVPNPKQDPRPLPYXCHDEPYTXDXNLSXNXKGEGMSQAATIXKSNFKYMYXTXXQQXTHHSVNGCNLRPGDXXXSGTXSGPEPENFGSXLELSWKGTKPIDXGNGQTRKFLLDGDEXIXTGYXQGDGYRXGXGQXAGKXLPALLPS

SEQ ID NO: 356 - protein, 411 aa, Homo sapiens
  SITE (30)..(30): Xaa at position 30 is Trp, Tyr, Phe, Met, His, Ile, Leu Val, Ala, or Gly
  SITE (32)..(32): Xaa at position 32 is Ala, Gly, or Pro
  SITE (49)..(49): Xaa at position 49 is Cys, Ala, Val, Gly, Ser, or Thr
  SITE (50)..(50): Xaa at position 50 is Ile, Ala, Val, Leu, or Gly
  SITE (54)..(54): Xaa at position 54 is Leu, Ala, Val, Gly, or Ile
  SITE (55)..(55): Xaa at position 55 is Phe, Tyr, Met, His, Ile, Leu, Val Ala, or Gly
  SITE (58)..(58): Xaa at position 58 is Met, Ile, Leu, Val, Ala, or Gly
  SITE (59)..(59): Xaa at position 59 is Ala, Gly, or Pro
  SITE (62)..(62): Xaa at position 62 is Met, Ile, Leu, Val, Ala, or Gly
  SITE (67)..(67): Xaa at position 67 is Trp, Tyr, Phe, Met, His, Ile, Leu Val, Ala, or Gly
  SITE (72)..(72): Xaa at position 72 is Tyr, Phe, Met, His, Ile, Leu, Val Ala, or Gly
  SITE (75)..(75): Xaa at position 75 is Leu, Ala, Val, Gly, or Ile
  SITE (77)..(77): Xaa at position 77 is Ile, Ala, Val, Leu, or Gly
  SITE (80)..(80): Xaa at position 80 is Cys, Ala, Val, Gly, Ser, or Thr
  SITE (81)..(81): Xaa at position 81 is Trp, Tyr, Phe, Met, His, Ile, Leu Val, Ala, or Gly
  SITE (91)..(91): Xaa at position 91 is Leu, Ala, Val, Gly, or Ile
  SITE (102)..(102): Xaa at position 102 is Ile, Ala, Val, Leu, or Gly
  SITE (105)..(105): Xaa at position 105 is Leu, Ala, Val, Gly, or Ile
  SITE (106)..(106): Xaa at position 106 is Ala, Gly, or Pro
  SITE (109)..(109): Xaa at position 109 is Val, Ala, Gly, Leu, or Ile
  SITE (116)..(116): Xaa at position 116 is Leu, Ala, Val, Gly, or Ile
  SITE (118)..(118): Xaa at position 118 is Ile, Ala, Val, Leu, or Gly
  SITE (119)..(119): Xaa at position 119 is Tyr, Phe, Met, His, Ile, Leu, Val Ala, or Gly
  SITE (120)..(120): Xaa at position 120 is Ala, Gly, or Pro
  SITE (122)..(122): Xaa at position 122 is Met, Ile, Leu, Val, Ala, or Gly
  SITE (138)..(138): Xaa at position 138 is Val, Ala, Gly, Leu, or Ile
  SITE (142)..(142): Xaa at position 142 is Ala, Gly, or Pro
  SITE (145)..(145): Xaa at position 145 is Phe, Tyr, Met, His, Ile, Leu, Val Ala, or Gly
  SITE (150)..(150): Xaa at position 150 is Val, Ala, Gly, Leu, or Ile
  SITE (153)..(153): Xaa at position 153 is Leu, Ala, Val, Gly, or Ile
  SITE (155)..(155): Xaa at position 155 is Leu, Ala, Val, Gly, or Ile
  SITE (169)..(169): Xaa at position 169 is Tyr, Phe, Met, His, Ile, Leu, Val Ala, or Gly
  SITE (172)..(172): Xaa at position 172 is Met, Ile, Leu, Val, Ala, or Gly
  SITE (184)..(184): Xaa at position 184 is Ala, Gly, or Pro
  SITE (185)..(185): Xaa at position 185 is Phe, Tyr, Met, His, Ile, Leu, Val Ala, or Gly
  SITE (187)..(187): Xaa at position 187 is Cys, Ala, Val, Gly, Ser, or Thr
  SITE (205)..(205): Xaa at position 205 is Leu, Ala, Val, Gly, or Ile
  SITE (209)..(209): Xaa at position 209 is Cys, Ala, Val, Gly, Ser, or Thr
  SITE (211)..(211): Xaa at position 211 is Leu, Ala, Val, Gly, or Ile
  SITE (212)..(212): Xaa at position 212 is Trp, Tyr, Phe, Met, His, Ile, Leu Val, Ala, or Gly
  SITE (218)..(218): Xaa at position 218 is Ile, Ala, Val, Leu, or Gly
  SITE (225)..(225): Xaa at position 225 is Val, Ala, Gly, Leu, or Ile
  SITE (228)..(228): Xaa at position 228 is Ile, Ala, Val, Leu, or Gly
  SITE (229)..(229): Xaa at position 229 is Leu, Ala, Val, Gly, or Ile
  SITE (239)..(239): Xaa at position 239 is Leu, Ala, Val, Gly, or Ile
  SITE (242)..(242): Xaa at position 242 is Val, Ala, Gly, Leu, or Ile
  SITE (248)..(248): Xaa at position 248 is Trp, Tyr, Phe, Met, His, Ile, Leu Val, Ala, or Gly
  SITE (253)..(253): Xaa at position 253 is Met, Ile, Leu, Val, Ala, or Gly
  SITE (254)..(254): Xaa at position 254 is Leu, Ala, Val, Gly, or Ile
  SITE (255)..(255): Xaa at position 255 is Leu, Ala, Val, Gly, or Ile
  SITE (256)..(256): Xaa at position 256 is Ile, Ala, Val, Leu, or Gly
  SITE (268)..(268): Xaa at position 268 is Ala, Gly, or Pro
  SITE (270)..(270): Xaa at position 270 is Met, Ile, Leu, Val, Ala, or Gly
  SITE (271)..(271): Xaa at position 271 is Ala, Gly, or Pro
  SITE (272)..(272): Xaa at position 272 is Leu, Ala, Val, Gly, or Ile
  SITE (273)..(273): Xaa at position 273 is Trp, Tyr, Phe, Met, His, Ile, Leu Val, Ala, or Gly
  SITE (275)..(275): Xaa at position 275 is Val, Ala, Gly, Leu, or Ile
  SITE (276)..(276): Xaa at position 276 is Leu, Ala, Val, Gly, or Ile
  SITE (277)..(277): Xaa at position 277 is Ala, Gly, or Pro
  SITE (278)..(278): Xaa at position 278 is Ala, Gly, or Pro
  SITE (280)..(280): Xaa at position 280 is Leu, Ala, Val, Gly, or Ile
  SITE (282)..(282): Xaa at position 282 is Met, Ile, Leu, Val, Ala, or Gly
  SITE (296)..(296): Xaa at position 296 is Ile, Ala, Val, Leu, or Gly
  SITE (297)..(297): Xaa at position 297 is Leu, Ala, Val, Gly, or Ile
  SITE (302)..(302): Xaa at position 302 is Met, Ile, Leu, Val, Ala, or Gly
  SITE (305)..(305): Xaa at position 305 is Ile, Ala, Val, Leu, or Gly
  SITE (324)..(324): Xaa at position 324 is Ile, Ala, Val, Leu, or Gly
  SITE (326)..(326): Xaa at position 326 is Val, Ala, Gly, Leu, or Ile
  SITE (327)..(327): Xaa at position 327 is Tyr, Phe, Met, His, Ile, Leu, Val Ala, or Gly
  SITE (337)..(337): Xaa at position 337 is Ala, Gly, or Pro
  SITE (338)..(338): Xaa at position 338 is Leu, Ala, Val, Gly, or Ile
  SITE (339)..(339): Xaa at position 339 is Val, Ala, Gly, Leu, or Ile
  SITE (340)..(340): Xaa at position 340 is Phe, Tyr, Met, His, Ile, Leu, Val Ala, or Gly
  SITE (341)..(341): Xaa at position 341 is Phe, Tyr, Met, His, Ile, Leu, Val Ala, or Gly
  SITE (355)..(355): Xaa at position 355 is Leu, Ala, Val, Gly, or Ile
  SITE (365)..(365): Xaa at position 365 is Ile, Ala, Val, Leu, or Gly
  SITE (368)..(368): Xaa at position 368 is Ala, Gly, or Pro
  SITE (386)..(386): Xaa at position 386 is Phe, Tyr, Met, His, Ile, Leu, Val Ala, or Gly
  SITE (390)..(390): Xaa at position 390 is Ile, Ala, Val, Leu, or Gly
  SITE (397)..(397): Xaa at position 397 is Met, Ile, Leu, Val, Ala, or Gly
  SITE (400)..(400): Xaa at position 400 is Leu, Ala, Val, Gly, or Ile
MLLKTVLLLGHVAQVLMLDNGLLQTPPMGXLXWERFRCNINCDEDPKNXXSEQXXMEXXDRXAQDGXRDMGXTYXNXDDXXIGGRDASGRXMPDPKRFPHGXPFXXDYXHSLGLKXGXXXDXGNFTCMGYPGTTLDKXVQDXQTXAEWKXDMXKXDGCFSTPEERAQGXPKXAAALNATGRPIXXSXSWPAYEGGLPPRVNYSLXADIXNXXRNYDDXQDSWWSXLSXXNWFVEHQDIXQPXAGPGHXNDPDXXXXGNFGLSLEQSRXQXXXXTXXXXPXLXSTDLRTISAQNMDXXQNPLXIKXNQDPLGIQGRRIHKEKSLXEXXMRPLSNKASXXXXXSCRTDMPYRYHSSXGQLNFTGSVXYEXQDVYSGDIISGLRDETNXTVIXNPSGVVXWYXYPIKNLEMSQQ

SEQ ID NO: 357 - protein, 413 aa, Homo sapiens
  SITE (34)..(34): Xaa at position 34 is Val, Ala, Gly, Leu, or Ile
  SITE (36)..(36): Xaa at position 36 is Leu, Ala, Val, Gly, or Ile
  SITE (51)..(51): Xaa at position 51 is Leu, Ala, Val, Gly, or Ile
  SITE (53)..(53): Xaa at position 53 is Val, Ala, Gly, Leu, or Ile
  SITE (54)..(54): Xaa at position 54 is Val, Ala, Gly, Leu, or Ile
  SITE (57)..(57): Xaa at position 57 is Val, Ala, Gly, Leu, or Ile
  SITE (80)..(80): Xaa at position 80 is Phe, Tyr, Met, His, Ile, Leu, Val Ala, or Gly
  SITE (84)..(84): Xaa at position 84 is Ala, Gly, or Pro
  SITE (88)..(88): Xaa at position 88 is Ala, Gly, or Pro
  SITE (95)..(95): Xaa at position 95 is Ala, Gly, or Pro
  SITE (104)..(104): Xaa at position 104 is Val, Ala, Gly, Leu, or Ile
  SITE (112)..(112): Xaa at position 112 is Ala, Gly, or Pro
  SITE (113)..(113): Xaa at position 113 is Leu, Ala, Val, Gly, or Ile
  SITE (115)..(115): Xaa at position 115 is Ile, Ala, Val, Leu, or Gly
  SITE (117)..(117): Xaa at position 117 is Ala, Gly, or Pro
  SITE (120)..(120): Xaa at position 120 is Leu, Ala, Val, Gly, or Ile
  SITE (121)..(121): Xaa at position 121 is Ala, Gly, or Pro
  SITE (134)..(134): Xaa at position 134 is Val, Ala, Gly, Leu, or Ile
  SITE (136)..(136): Xaa at position 136 is Val, Ala, Gly, Leu, or Ile
  SITE (144)..(144): Xaa at position 144 is His, Phe, Tyr, Lys, Arg, Gly, Ser Thr, Ala, Val, Leu, Ile, Asn, Met, or Gln
  SITE (148)..(148): Xaa at position 148 is Phe, Tyr, Met, His, Ile, Leu, Val Ala, or Gly
  SITE (174)..(174): Xaa at position 174 is Phe, Tyr, Met, His, Ile, Leu, Val Ala, or Gly
  SITE (178)..(178): Xaa at position 178 is Leu, Ala, Val, Gly, or Ile
  SITE (181)..(181): Xaa at position 181 is Ala, Gly, or Pro
  SITE (186)..(186): Xaa at position 186 is Ile, Ala, Val, Leu, or Gly
  SITE (187)..(187): Xaa at position 187 is Val, Ala, Gly, Leu, or Ile
  SITE (188)..(188): Xaa at position 188 is Val, Ala, Gly, Leu, or Ile
  SITE (189)..(189): Xaa at position 189 is Leu, Ala, Val, Gly, or Ile
  SITE (193)..(193): Xaa at position 193 is Ala, Gly, or Pro
  SITE (194)..(194): Xaa at position 194 is His, Phe, Tyr, Lys, Arg, Gly, Ser Thr, Ala, Val, Leu, Ile, Asn, Met, or Gln
  SITE (209)..(209): Xaa at position 209 is Ile, Ala, Val, Leu, or Gly
  SITE (210)..(210): Xaa at position 210 is Ala, Gly, or Pro
  SITE (213)..(213): Xaa at position 213 is Met, Ile, Leu, Val, Ala, or Gly
  SITE (221)..(221): Xaa at position 221 is Phe, Tyr, Met, His, Ile, Leu, Val Ala, or Gly
  SITE (222)..(222): Xaa at position 222 is Phe, Tyr, Met, His, Ile, Leu, Val Ala, or Gly
  SITE (238)..(238): Xaa at position 238 is Ala, Gly, or Pro
  SITE (240)..(240): Xaa at position 240 is Ala, Gly, or Pro
  SITE (241)..(241): Xaa at position 241 is Ile, Ala, Val, Leu, or Gly
  SITE (244)..(244): Xaa at position 244 is Phe, Tyr, Met, His, Ile, Leu, Val Ala, or Gly
  SITE (251)..(251): Xaa at position 251 is Phe, Tyr, Met, His, Ile, Leu, Val Ala, or Gly
  SITE (253)..(253): Xaa at position 253 is Cys, Ala, Val, Gly, Ser, or Thr
  SITE (254)..(254): Xaa at position 254 is Ala, Gly, or Pro
  SITE (257)..(257): Xaa at position 257 is Phe, Tyr, Met, His, Ile, Leu, Val Ala, or Gly
  SITE (261)..(261): Xaa at position 261 is Phe, Tyr, Met, His, Ile, Leu, Val Ala, or Gly
  SITE (268)..(268): Xaa at position 268 is Val, Ala, Gly, Leu, or Ile
  SITE (271)..(271): Xaa at position 271 is Leu, Ala, Val, Gly, or Ile
  SITE (288)..(288): Xaa at position 288 is Met, Ile, Leu, Val, Ala, or Gly
  SITE (292)..(292): Xaa at position 292 is Val, Ala, Gly, Leu, or Ile
  SITE (304)..(304): Xaa at position 304 is Ala, Gly, or Pro
  SITE (306)..(306): Xaa at position 306 is Ile, Ala, Val, Leu, or Gly
  SITE (307)..(307): Xaa at position 307 is Val, Ala, Gly, Leu, or Ile
  SITE (308)..(308): Xaa at position 308 is Ala, Gly, or Pro
  SITE (320)..(320): Xaa at position 320 is Trp, Tyr, Phe, Met, His, Ile, Leu Val, Ala, or Gly
  SITE (324)..(324): Xaa at position 324 is Val, Ala, Gly, Leu, or Ile
  SITE (327)..(327): Xaa at position 327 is Met, Ile, Leu, Val, Ala, or Gly
  SITE (328)..(328): Xaa at position 328 is Ala, Gly, or Pro
  SITE (338)..(338): Xaa at position 338 is Leu, Ala, Val, Gly, or Ile
  SITE (342)..(342): Xaa at position 342 is Leu, Ala, Val, Gly, or Ile
  SITE (354)..(354): Xaa at position 354 is Ile, Ala, Val, Leu, or Gly
  SITE (360)..(360): Xaa at position 360 is Met, Ile, Leu, Val, Ala, or Gly
  SITE (361)..(361): Xaa at position 361 is Phe, Tyr, Met, His, Ile, Leu, Val Ala, or Gly
  SITE (374)..(374): Xaa at position 374 is Leu, Ala, Val, Gly, or Ile
  SITE (380)..(380): Xaa at position 380 is Ile, Ala, Val, Leu, or Gly
  SITE (382)..(382): Xaa at position 382 is Leu, Ala, Val, Gly, or Ile
  SITE (388)..(388): Xaa at position 388 is Ile, Ala, Val, Leu, or Gly
  SITE (390)..(390): Xaa at position 390 is Val, Ala, Gly, Leu, or Ile
  SITE (393)..(393): Xaa at position 393 is Leu, Ala, Val, Gly, or Ile
  SITE (398)..(398): Xaa at position 398 is Leu, Ala, Val, Gly, or Ile
  SITE (401)..(401): Xaa at position 401 is Val, Ala, Gly, Leu, or Ile
  SITE (402)..(402): Xaa at position 402 is Ala, Gly, or Pro
  SITE (408)..(408): Xaa at position 408 is Ala, Gly, or Pro
MAPPSVFAEVPQAQPVLVFKLTADFREDPDPRKXNXGVGAYRTDDCHPWVXPXXKKXEQKIANDNSLNHEYLPILGLAEXRSCXSRLXLGDDSPXLKEKRVGGXQSLGGTGXXRXGXDFXXRWYNGTNNKNTPXYXSSPTWENXNAVXSAAGFKDIRSYRYWDAEKRGLDLQGXLNDXENXPEFSXXXXHACXXNPTGIDPTPEQWKQXXSVXKHRFLFPXXDSAYQGFASGNLERDXWXXRYXVSEGFEXFXXQSXSKNXGLYNERXGNXTVVGKEPESILQVLSQXEKIXRITWSNPPAQGXRXXXSTLSNPELFEEXTGNXKTXXDRILTMRSEXRARXEALKTPGTWNHXTDQIGXXSFTGLNPKQVEYXVNEKHXYXLPSGRXNXSGXTTKNXDYXXTSIHEXVTKIQ

SEQ ID NO: 358 - protein, 338 aa, Homo sapiens
  SITE (29)..(29): Xaa at position 29 is Met, Ile, Leu, Val, Ala, or Gly
  SITE (31)..(31): Xaa at position 31 is Tyr, Phe, Met, His, Ile, Leu, Val Ala, or Gly
  SITE (34)..(34): Xaa at position 34 is Ala, Gly, or Pro
  SITE (35)..(35): Xaa at position 35 is Ala, Gly, or Pro
  SITE (46)..(46): Xaa at position 46 is Phe, Tyr, Met, His, Ile, Leu, Val Ala, or Gly
  SITE (48)..(48): Xaa at position 48 is Ala, Gly, or Pro
  SITE (52)..(52): Xaa at position 52 is Val, Ala, Gly, Leu, or Ile
  SITE (57)..(57): Xaa at position 57 is Phe, Tyr, Met, His, Ile, Leu, Val Ala, or Gly
  SITE (58)..(58): Xaa at position 58 is Val, Ala, Gly, Leu, or Ile
  SITE (60)..(60): Xaa at position 60 is Phe, Tyr, Met, His, Ile, Leu, Val Ala, or Gly
  SITE (69)..(69): Xaa at position 69 is Met, Ile, Leu, Val, Ala, or Gly
  SITE (73)..(73): Xaa at position 73 is Ala, Gly, or Pro
  SITE (75)..(75): Xaa at position 75 is Trp, Tyr, Phe, Met, His, Ile, Leu Val, Ala, or Gly
  SITE (76)..(76): Xaa at position 76 is Val, Ala, Gly, Leu, or Ile
  SITE (83)..(83): Xaa at position 83 is Tyr, Phe, Met, His, Ile, Leu, Val Ala, or Gly
  SITE (95)..(95): Xaa at position 95 is Ala, Gly, or Pro
  SITE (102)..(102): Xaa at position 102 is Leu, Ala, Val, Gly, or Ile
  SITE (105)..(105): Xaa at position 105 is Leu, Ala, Val, Gly, or Ile
  SITE (119)..(119): Xaa at position 119 is Leu, Ala, Val, Gly, or Ile
  SITE (121)..(121): Xaa at position 121 is Trp, Tyr, Phe, Met, His, Ile, Leu Val, Ala, or Gly
  SITE (122)..(122): Xaa at position 122 is Met, Ile, Leu, Val, Ala, or Gly
  SITE (125)..(125): Xaa at position 125 is Cys, Ala, Val, Gly, Ser, or Thr
  SITE (127)..(127): Xaa at position 127 is Leu, Ala, Val, Gly, or Ile
  SITE (140)..(140): Xaa at position 140 is Tyr, Phe, Met, His, Ile, Leu, Val Ala, or Gly
  SITE (142)..(142): Xaa at position 142 is Tyr, Phe, Met, His, Ile, Leu, Val Ala, or Gly
  SITE (147)..(147): Xaa at position 147 is Tyr, Phe, Met, His, Ile, Leu, Val Ala, or Gly
  SITE (148)..(148): Xaa at position 148 is Leu, Ala, Val, Gly, or Ile
  SITE (150)..(150): Xaa at position 150 is Leu, Ala, Val, Gly, or Ile
  SITE (154)..(154): Xaa at position 154 is Leu, Ala, Val, Gly, or Ile
  SITE (157)..(157): Xaa at position 157 is Trp, Tyr, Phe, Met, His, Ile, Leu Val, Ala, or Gly
  SITE (163)..(163): Xaa at position 163 is Ala, Gly, or Pro
  SITE (164)..(164): Xaa at position 164 is Ala, Gly, or Pro
  SITE (176)..(176): Xaa at position 176 is Val, Ala, Gly, Leu, or Ile
  SITE (177)..(177): Xaa at position 177 is Ala, Gly, or Pro
  SITE (184)..(184): Xaa at position 184 is Leu, Ala, Val, Gly, or Ile
  SITE (188)..(188): Xaa at position 188 is Cys, Ala, Val, Gly, Ser, or Thr
  SITE (189)..(189): Xaa at position 189 is Val, Ala, Gly, Leu, or Ile
  SITE (192)..(192): Xaa at position 192 is Leu, Ala, Val, Gly, or Ile
  SITE (195)..(195): Xaa at position 195 is Tyr, Phe, Met, His, Ile, Leu, Val Ala, or Gly
  SITE (196)..(196): Xaa at position 196 is Leu, Ala, Val, Gly, or Ile
  SITE (203)..(203): Xaa at position 203 is Leu, Ala, Val, Gly, or Ile
  SITE (213)..(213): Xaa at position 213 is Val, Ala, Gly, Leu, or Ile
  SITE (223)..(223): Xaa at position 223 is Ala, Gly, or Pro
  SITE (225)..(225): Xaa at position 225 is Leu, Ala, Val, Gly, or Ile
  SITE (227)..(227): Xaa at position 227 is Cys, Ala, Val, Gly, Ser, or Thr
  SITE (229)..(229): Xaa at position 229 is Ala, Gly, or Pro
  SITE (232)..(232): Xaa at position 232 is Phe, Tyr, Met, His, Ile, Leu, Val Ala, or Gly
  SITE (233)..(233): Xaa at position 233 is Tyr, Phe, Met, His, Ile, Leu, Val Ala, or Gly
  SITE (239)..(239): Xaa at position 239 is Leu, Ala, Val, Gly, or Ile
  SITE (241)..(241): Xaa at position 241 is Trp, Tyr, Phe, Met, His, Ile, Leu Val, Ala, or Gly
  SITE (269)..(269): Xaa at position 269 is Ala, Gly, or Pro
  SITE (270)..(270): Xaa at position 270 is Ala, Gly, or Pro
  SITE (271)..(271): Xaa at position 271 is Val, Ala, Gly, Leu, or Ile
  SITE (272)..(272): Xaa at position 272 is Val, Ala, Gly, Leu, or Ile
  SITE (273)..(273): Xaa at position 273 is Val, Ala, Gly, Leu, or Ile
  SITE (281)..(281): Xaa at position 281 is Tyr, Phe, Met, His, Ile, Leu, Val Ala, or Gly
  SITE (283)..(283): Xaa at position 283 is Cys, Ala, Val, Gly, Ser, or Thr
  SITE (285)..(285): Xaa at position 285 is Val, Ala, Gly, Leu, or Ile
  SITE (287)..(287): Xaa at position 287 is His, Phe, Tyr, Lys, Arg, Gly, Ser Thr, Ala, Val, Leu, Ile, Asn, Met, or Gln
MVVMAPRTLFLLLSGALTLTETWAGSHSXRXFSXXVSRPGRGEPRXIXMGYXDDTQXXRXDSDSACPRXEPRXPXXEQEGPEXWEEETRNTKAHXQTDRMNXQTXRGYYNQSEASSHTXQXXIGXDXGSDGRLLRGYEQXAXDGKDXXAXNEDXRSXTAADTXXQISKRKCEAANXXEQRRAYXEGTXXEWXHRXXENGKEMXQRADPPKTHXTHHPVFDYEXTXRXWXLGXXPAEIIXTXQRDGEDQTQDVELVETRPAGDGTFQKWXXXXXPSGEEQRXTXHXQXEGLPEPLMLRWKQSSLPTIPIMGIVAGLVVLAAVVTGAAVAAVLWRKKSSD

SEQ ID NO: 359 - protein, 502 aa, Homo sapiens
  SITE (56)..(56): Xaa at position 56 is Val, Ala, Gly, Leu, or Ile
  SITE (60)..(60): Xaa at position 60 is Leu, Ala, Val, Gly, or Ile
  SITE (83)..(83): Xaa at position 83 is Leu, Ala, Val, Gly, or Ile
  SITE (87)..(87): Xaa at position 87 is Trp, Tyr, Phe, Met, His, Ile, Leu Val, Ala, or Gly
  SITE (119)..(119): Xaa at position 119 is Leu, Ala, Val, Gly, or Ile
  SITE (135)..(135): Xaa at position 135 is Ala, Gly, or Pro
  SITE (137)..(137): Xaa at position 137 is Val, Ala, Gly, Leu, or Ile
  SITE (143)..(143): Xaa at position 143 is Ile, Ala, Val, Leu, or Gly
  SITE (145)..(145): Xaa at position 145 is Trp, Tyr, Phe, Met, His, Ile, Leu Val, Ala, or Gly
  SITE (149)..(149): Xaa at position 149 is Ala, Gly, or Pro
  SITE (173)..(173): Xaa at position 173 is Phe, Tyr, Met, His, Ile, Leu, Val Ala, or Gly
  SITE (183)..(183): Xaa at position 183 is Ile, Ala, Val, Leu, or Gly
  SITE (185)..(185): Xaa at position 185 is Leu, Ala, Val, Gly, or Ile
MARRCGPVALLLGFGLLRLCSGVWGTDTEERLVEHLLDPSRYNKLIRPATNGSELXTVQXMVSLAQLISVHEREQIMTTNVWXTQEXEDYRLTWKPEEFDNMKKVRLPSKHIWLPDVVXYNNADGMYEVSFYSNXVXSYDGSXFXLPPXIYKSACKIEVKHFPFDQQNCTMKXRSWTYDRTEXDXVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 360 - protein, 780 aa, Homo sapiens
  SITE (18)..(18): Xaa at position 18 is Ile, Ala, Val, Leu, or Gly
  SITE (20)..(20): Xaa at position 20 is Val, Ala, Gly, Leu, or Ile
  SITE (21)..(21): Xaa at position 21 is Leu, Ala, Val, Gly, or Ile
  SITE (27)..(27): Xaa at position 27 is Ala, Gly, or Pro
  SITE (30)..(30): Xaa at position 30 is Met, Ile, Leu, Val, Ala, or Gly
  SITE (32)..(32): Xaa at position 32 is Ala, Gly, or Pro
  SITE (33)..(33): Xaa at position 33 is Ala, Gly, or Pro
  SITE (34)..(34): Xaa at position 34 is Val, Ala, Gly, Leu, or Ile
  SITE (36)..(36): Xaa at position 36 is Ala, Gly, or Pro
  SITE (37)..(37): Xaa at position 37 is Val, Ala, Gly, Leu, or Ile
  SITE (46)..(46): Xaa at position 46 is Ala, Gly, or Pro
  SITE (48)..(48): Xaa at position 48 is Val, Ala, Gly, Leu, or Ile
  SITE (51)..(51): Xaa at position 51 is Ile, Ala, Val, Leu, or Gly
  SITE (58)..(58): Xaa at position 58 is Leu, Ala, Val, Gly, or Ile
  SITE (59)..(59): Xaa at position 59 is Val, Ala, Gly, Leu, or Ile
  SITE (73)..(73): Xaa at position 73 is Val, Ala, Gly, Leu, or Ile
  SITE (77)..(77): Xaa at position 77 is Ile, Ala, Val, Leu, or Gly
  SITE (101)..(101): Xaa at position 101 is Ala, Gly, or Pro
  SITE (102)..(102): Xaa at position 102 is Ala, Gly, or Pro
  SITE (105)..(105): Xaa at position 105 is Leu, Ala, Val, Gly, or Ile
  SITE (113)..(113): Xaa at position 113 is Leu, Ala, Val, Gly, or Ile
  SITE (114)..(114): Xaa at position 114 is Cys, Ala, Val, Gly, Ser, or Thr
  SITE (115)..(115): Xaa at position 115 is Val, Ala, Gly, Leu, or Ile
  SITE (116)..(116): Xaa at position 116 is Ile, Ala, Val, Leu, or Gly
  SITE (122)..(122): Xaa at position 122 is Leu, Ala, Val, Gly, or Ile
  SITE (128)..(128): Xaa at position 128 is Phe, Tyr, Met, His, Ile, Leu, Val Ala, or Gly
  SITE (135)..(135): Xaa at position 135 is Leu, Ala, Val, Gly, or Ile
  SITE (159)..(159): Xaa at position 159 is Ala, Gly, or Pro
  SITE (161)..(161): Xaa at position 161 is Leu, Ala, Val, Gly, or Ile
  SITE (162)..(162): Xaa at position 162 is Val, Ala, Gly, Leu, or Ile
  SITE (165)..(165): Xaa at position 165 is Ile, Ala, Val, Leu, or Gly
  SITE (169)..(169): Xaa at position 169 is Phe, Tyr, Met, His, Ile, Leu, Val Ala, or Gly
  SITE (176)..(176): Xaa at position 176 is Ile, Ala, Val, Leu, or Gly
  SITE (181)..(181): Xaa at position 181 is Ala, Gly, or Pro
  SITE (185)..(185): Xaa at position 185 is Ile, Ala, Val, Leu, or Gly
  SITE (186)..(186): Xaa at position 186 is Met, Ile, Leu, Val, Ala, or Gly
  SITE (189)..(189): Xaa at position 189 is Ile, Ala, Val, Leu, or Gly
  SITE (196)..(196): Xaa at position 196 is Ala, Gly, or Pro
  SITE (203)..(203): Xaa at position 203 is Phe, Tyr, Met, His, Ile, Leu, Val Ala, or Gly
  SITE (204)..(204): Xaa at position 204 is Val, Ala, Gly, Leu, or Ile
  SITE (205)..(205): Xaa at position 205 is Leu, Ala, Val, Gly, or Ile
  SITE (207)..(207): Xaa at position 207 is Val, Ala, Gly, Leu, or Ile
  SITE (212)..(212): Xaa at position 212 is Cys, Ala, Val, Gly, Ser, or Thr
  SITE (215)..(215): Xaa at position 215 is Leu, Ala, Val, Gly, or Ile
  SITE (216)..(216): Xaa at position 216 is Ala, Gly, or Pro
  SITE (217)..(217): Xaa at position 217 is Leu, Ala, Val, Gly, or Ile
  SITE (229)..(229): Xaa at position 229 is Phe, Tyr, Met, His, Ile, Leu, Val Ala, or Gly
  SITE (230)..(230): Xaa at position 230 is Ile, Ala, Val, Leu, or Gly
  SITE (243)..(243): Xaa at position 243 is Met, Ile, Leu, Val, Ala, or Gly
  SITE (244)..(244): Xaa at position 244 is Cys, Ala, Val, Gly, Ser, or Thr
  SITE (247)..(247): Xaa at position 247 is Leu, Ala, Val, Gly, or Ile
  SITE (260)..(260): Xaa at position 260 is Ile, Ala, Val, Leu, or Gly
  SITE (261)..(261): Xaa at position 261 is Ile, Ala, Val, Leu, or Gly
  SITE (262)..(262): Xaa at position 262 is Ile, Ala, Val, Leu, or Gly
  SITE (263)..(263): Xaa at position 263 is Ala, Gly, or Pro
  SITE (266)..(266): Xaa at position 266 is Ala, Gly, or Pro
  SITE (279)..(279): Xaa at position 279 is Val, Ala, Gly, Leu, or Ile
  SITE (283)..(283): Xaa at position 283 is Val, Ala, Gly, Leu, or Ile
  SITE (284)..(284): Xaa at position 284 is Val, Ala, Gly, Leu, or Ile
  SITE (293)..(293): Xaa at position 293 is Val, Ala, Gly, Leu, or Ile
  SITE (296)..(296): Xaa at position 296 is Leu, Ala, Val, Gly, or Ile
  SITE (307)..(307): Xaa at position 307 is Ala, Gly, or Pro
  SITE (312)..(312): Xaa at position 312 is Leu, Ala, Val, Gly, or Ile
  SITE (320)..(320): Xaa at position 320 is Ala, Gly, or Pro
  SITE (321)..(321): Xaa at position 321 is Val, Ala, Gly, Leu, or Ile
  SITE (324)..(324): Xaa at position 324 is Leu, Ala, Val, Gly, or Ile
  SITE (325)..(325): Xaa at position 325 is Leu, Ala, Val, Gly, or Ile
  SITE (333)..(333): Xaa at position 333 is Ala, Gly, or Pro
  SITE (335)..(335): Xaa at position 335 is Val, Ala, Gly, Leu, or Ile
  SITE (336)..(336): Xaa at position 336 is Val, Ala, Gly, Leu, or Ile
  SITE (348)..(348): Xaa at position 348 is Leu, Ala, Val, Gly, or Ile
  SITE (358)..(358): Xaa at position 358 is Val, Ala, Gly, Leu, or Ile
  SITE (370)..(370): Xaa at position 370 is Ala, Gly, or Pro
  SITE (389)..(389): Xaa at position 389 is Ala, Gly, or Pro
  SITE (403)..(403): Xaa at position 403 is Ala, Gly, or Pro
  SITE (404)..(404): Xaa at position 404 is Ile, Ala, Val, Leu, or Gly
  SITE (405)..(405): Xaa at position 405 is Leu, Ala, Val, Gly, or Ile
  SITE (407)..(407): Xaa at position 407 is Val, Ala, Gly, Leu, or Ile
  SITE (411)..(411): Xaa at position 411 is Ala, Gly, or Pro
  SITE (412)..(412): Xaa at position 412 is Ala, Gly, or Pro
  SITE (414)..(414): Xaa at position 414 is Met, Ile, Leu, Val, Ala, or Gly
  SITE (416)..(416): Xaa at position 416 is Ala, Gly, or Pro
  SITE (417)..(417): Xaa at position 417 is Ala, Gly, or Pro
  SITE (418)..(418): Xaa at position 418 is Val, Ala, Gly, Leu, or Ile
  SITE (422)..(422): Xaa at position 422 is Val, Ala, Gly, Leu, or Ile
  SITE (432)..(432): Xaa at position 432 is Val, Ala, Gly, Leu, or Ile
  SITE (433)..(433): Xaa at position 433 is Tyr, Phe, Met, His, Ile, Leu, Val Ala, or Gly
  SITE (434)..(434): Xaa at position 434 is Val, Ala, Gly, Leu, or Ile
  SITE (435)..(435): Xaa at position 435 is Val, Ala, Gly, Leu, or Ile
  SITE (439)..(439): Xaa at position 439 is Phe, Tyr, Met, His, Ile, Leu, Val Ala, or Gly
  SITE (455)..(455): Xaa at position 455 is Val, Ala, Gly, Leu, or Ile
  SITE (480)..(480): Xaa at position 480 is Ile, Ala, Val, Leu, or Gly
  SITE (493)..(493): Xaa at position 493 is Leu, Ala, Val, Gly, or Ile
  SITE (494)..(494): Xaa at position 494 is Val, Ala, Gly, Leu, or Ile
  SITE (495)..(495): Xaa at position 495 is Val, Ala, Gly, Leu, or Ile
  SITE (500)..(500): Xaa at position 500 is Ala, Gly, or Pro
  SITE (501)..(501): Xaa at position 501 is Tyr, Phe, Met, His, Ile, Leu, Val Ala, or Gly
  SITE (505)..(505): Xaa at position 505 is Leu, Ala, Val, Gly, or Ile
  SITE (510)..(510): Xaa at position 510 is Ala, Gly, or Pro
  SITE (518)..(518): Xaa at position 518 is Cys, Ala, Val, Gly, Ser, or Thr
  SITE (521)..(521): Xaa at position 521 is Met, Ile, Leu, Val, Ala, or Gly
  SITE (522)..(522): Xaa at position 522 is Cys, Ala, Val, Gly, Ser, or Thr
  SITE (523)..(523): Xaa at position 523 is Val, Ala, Gly, Leu, or Ile
  SITE (524)..(524): Xaa at position 524 is Ile, Ala, Val, Leu, or Gly
  SITE (526)..(526): Xaa at position 526 is Ala, Gly, or Pro
  SITE (532)..(532): Xaa at position 532 is Val, Ala, Gly, Leu, or Ile
  SITE (539)..(539): Xaa at position 539 is Leu, Ala, Val, Gly, or Ile
  SITE (544)..(544): Xaa at position 544 is Ala, Gly, or Pro
  SITE (549)..(549): Xaa at position 549 is Met, Ile, Leu, Val, Ala, or Gly
  SITE (552)..(552): Xaa at position 552 is Cys, Ala, Val, Gly, Ser, or Thr
  SITE (559)..(559): Xaa at position 559 is Ala, Gly, or Pro
  SITE (566)..(566): Xaa at position 566 is Val, Ala, Gly, Leu, or Ile
  SITE (567)..(567): Xaa at position 567 is Phe, Tyr, Met, His, Ile, Leu, Val Ala, or Gly
  SITE (568)..(568): Xaa at position 568 is Ile, Ala, Val, Leu, or Gly
  SITE (569)..(569): Xaa at position 569 is Val, Ala, Gly, Leu, or Ile
  SITE (576)..(576): Xaa at position 576 is Cys, Ala, Val, Gly, Ser, or Thr
  SITE (579)..(579): Xaa at position 579 is Leu, Ala, Val, Gly, or Ile
  SITE (580)..(580): Xaa at position 580 is Ala, Gly, or Pro
  SITE (585)..(585): Xaa at position 585 is Ile, Ala, Val, Leu, or Gly
  SITE (586)..(586): Xaa at position 586 is Ala, Gly, or Pro
  SITE (594)..(594): Xaa at position 594 is Val, Ala, Gly, Leu, or Ile
  SITE (604)..(604): Xaa at position 604 is Leu, Ala, Val, Gly, or Ile
  SITE (608)..(608): Xaa at position 608 is Val, Ala, Gly, Leu, or Ile
  SITE (611)..(611): Xaa at position 611 is Met, Ile, Leu, Val, Ala, or Gly
  SITE (615)..(615): Xaa at position 615 is Met, Ile, Leu, Val, Ala, or Gly
  SITE (623)..(623): Xaa at position 623 is Leu, Ala, Val, Gly, or Ile
  SITE (624)..(624): Xaa at position 624 is Val, Ala, Gly, Leu, or Ile
  SITE (625)..(625): Xaa at position 625 is Leu, Ala, Val, Gly, or Ile
  SITE (639)..(639): Xaa at position 639 is Leu, Ala, Val, Gly, or Ile
  SITE (643)..(643): Xaa at position 643 is Tyr, Phe, Met, His, Ile, Leu, Val Ala, or Gly
  SITE (678)..(678): Xaa at position 678 is Leu, Ala, Val, Gly, or Ile
  SITE (682)..(682): Xaa at position 682 is Ala, Gly, or Pro
  SITE (683)..(683): Xaa at position 683 is Met, Ile, Leu, Val, Ala, or Gly
  SITE (686)..(686): Xaa at position 686 is Leu, Ala, Val, Gly, or Ile
  SITE (690)..(690): Xaa at position 690 is Leu, Ala, Val, Gly, or Ile
  SITE (701)..(701): Xaa at position 701 is Ala, Gly, or Pro
  SITE (709)..(709): Xaa at position 709 is Val, Ala, Gly, Leu, or Ile
  SITE (710)..(710): Xaa at position 710 is Ile, Ala, Val, Leu, or Gly
  SITE (722)..(722): Xaa at position 722 is Val, Ala, Gly, Leu, or Ile
  SITE (725)..(725): Xaa at position 725 is Leu, Ala, Val, Gly, or Ile
  SITE (741)..(741): Xaa at position 741 is Trp, Tyr, Phe, Met, His, Ile, Leu Val, Ala, or Gly
  SITE (744)..(744): Xaa at position 744 is Leu, Ala, Val, Gly, or Ile
MAAVDLEKLRASGAGKAXGXXTSGGDXQGXNXXXRXXTRMGIYVGXKXFLXYEGYEGXXEGGENIKQANWLSXSNIXQLGGTIIGSARCKAFTTREGRRAXXYNXVQHGITNXXXXGGDGSXTGANIXRSEWGSXLEELVAEGKISETTARTYSHLNIXGXXGSXDNDXCGTDMTXGTDSXLHRXXEVXDAITTTXQSHQRTXXXEXMGRHXGYXXXVSALASGADWLXXPEAPPEDGWENFXXERXGETRSRGSRLNIXXXXEGXIDRNGKPISSSYXKDLXXQRLGFDTRXTVXGHVQRGGTPSXFDRIXSSKMGMEXXMAXXEATPDTPXCXXTLSGNQSVRLPXMECVQMTKEXQKAMDDKRFDEXTQLRGGSFENNWNIYKLLXHQKPPKEKSNFSLXXXNXGAPXXGXNXXXRSAXRTGISHGHTXXXXHDGXEGLAKGQVQEVGWHDXAGWLGRGGSMLGTKRTLPKGQLESXVENIRIYGIHALXXXGGFEXXEGVXQLVEXRGRYEELXIVXXXXPXTISNNXPGTDFSXGSDTXVNAAXESXDRIKQSXSGTKRRXXXXETMGGYXGYXXTVTGXXVGADAAYXFEDPFNIHDXKVNXEHXTEKXKTDIQRGXXXRNEKCHDYYTTEFXYNLXSSEGKGVFDCRTNVLGHLQQGGAPTPFDRNYGTKXGVKXXLWXSEKXREVYRKGRVFXNAPDSACXXGLKKKAVAFSPXTEXKKDTDFEHRMPREQWXLSXRLMLKMLAQYRISMAAYVSGELEHVTRRTLSMDKGF

SEQ ID NO: 361 - protein, 193 aa, Homo sapiens
  SITE (80)..(80): Xaa at position 80 is Leu, Ala, Val, Gly, or Ile
  SITE (106)..(106): Xaa at position 106 is Cys, Ala, Val, Gly, Ser, or Thr
  SITE (136)..(136): Xaa at position 136 is Cys, Ala, Val, Gly, Ser, or Thr
  SITE (183)..(183): Xaa at position 183 is Cys, Ala, Val, Gly, Ser, or Thr
MQSLMQAPLLIALGLLLAAPAQAHLKKPSQLSSFSWDNCDEGKDPAVIRSLTLEPDPIIVPGNVTLSVMGSTSVPLSSPXKVDLVLEKEVAGLWIKIPCTDYIGSXTFEHFCDVLDMLIPTGEPCPEPLRTYGLPXHCPFKEGTYSLPKSEFVVPDLELPSWLTTGNYRIESVLSSSGKRLGXIKIAASLKGI

SEQ ID NO: 362 - protein, 2039 aa, Homo sapiens
  SITE (43)..(43): Xaa at position 43 is Cys, Ala, Val, Gly, Ser, or Thr
  SITE (52)..(52): Xaa at position 52 is Ala, Gly, or Pro
  SITE (69)..(69): Xaa at position 69 is Leu, Ala, Val, Gly, or Ile
  SITE (84)..(84): Xaa at position 84 is Ile, Ala, Val, Leu, or Gly
  SITE (86)..(86): Xaa at position 86 is Cys, Ala, Val, Gly, Ser, or Thr
  SITE (99)..(99): Xaa at position 99 is Cys, Ala, Val, Gly, Ser, or Thr
  SITE (121)..(121): Xaa at position 121 is Ile, Ala, Val, Leu, or Gly
  SITE (127)..(127): Xaa at position 127 is Ile, Ala, Val, Leu, or Gly
  SITE (129)..(129): Xaa at position 129 is Tyr, Phe, Met, His, Ile, Leu, Val Ala, or Gly
  SITE (143)..(143): Xaa at position 143 is Ala, Gly, or Pro
  SITE (145)..(145): Xaa at position 145 is Cys, Ala, Val, Gly, Ser, or Thr
  SITE (152)..(152): Xaa at position 152 is Val, Ala, Gly, Leu, or Ile
  SITE (164)..(164): Xaa at position 164 is Ile, Ala, Val, Leu, or Gly
  SITE (166)..(166): Xaa at position 166 is Cys, Ala, Val, Gly, Ser, or Thr
  SITE (191)..(191): Xaa at position 191 is Val, Ala, Gly, Leu, or Ile
  SITE (193)..(193): Xaa at position 193 is Tyr, Phe, Met, His, Ile, Leu, Val Ala, or Gly
  SITE (213)..(213): Xaa at position 213 is Ile, Ala, Val, Leu, or Gly
  SITE (215)..(215): Xaa at position 215 is Cys, Ala, Val, Gly, Ser, or Thr
  SITE (238)..(238): Xaa at position 238 is Cys, Ala, Val, Gly, Ser, or Thr
  SITE (256)..(256): Xaa at position 256 is Phe, Tyr, Met, His, Ile, Leu, Val Ala, or Gly
  SITE (262)..(262): Xaa at position 262 is Val, Ala, Gly, Leu, or Ile
  SITE (278)..(278): Xaa at position 278 is Val, Ala, Gly, Leu, or Ile
  SITE (280)..(280): Xaa at position 280 is Cys, Ala, Val, Gly, Ser, or Thr
  SITE (493)..(493): Xaa at position 493 is Cys, Ala, Val, Gly, Ser, or Thr
  SITE (534)..(534): Xaa at position 534 is Ile, Ala, Val, Leu, or Gly
  SITE (571)..(571): Xaa at position 571 is Ile, Ala, Val, Leu, or Gly
  SITE (577)..(577): Xaa at position 577 is Ile, Ala, Val, Leu, or Gly
  SITE (595)..(595): Xaa at position 595 is Cys, Ala, Val, Gly, Ser, or Thr
  SITE (641)..(641): Xaa at position 641 is Val, Ala, Gly, Leu, or Ile
  SITE (665)..(665): Xaa at position 665 is Cys, Ala, Val, Gly, Ser, or Thr
  SITE (688)..(688): Xaa at position 688 is Cys, Ala, Val, Gly, Ser, or Thr
  SITE (706)..(706): Xaa at position 706 is Phe, Tyr, Met, His, Ile, Leu, Val Ala, or Gly
  SITE (712)..(712): Xaa at position 712 is Val, Ala, Gly, Leu, or Ile
  SITE (728)..(728): Xaa at position 728 is Val, Ala, Gly, Leu, or Ile
  SITE (730)..(730): Xaa at position 730 is Cys, Ala, Val, Gly, Ser, or Thr
  SITE (943)..(943): Xaa at position 943 is Cys, Ala, Val, Gly, Ser, or Thr
  SITE (984)..(984): Xaa at position 984 is Ile, Ala, Val, Leu, or Gly
  SITE (986)..(986): Xaa at position 986 is Cys, Ala, Val, Gly, Ser, or Thr
  SITE (1004)..(1004): Xaa at position 1004 is Cys, Ala, Val, Gly, Ser, or Thr
  SITE (1021)..(1021): Xaa at position 1021 is Ile, Ala, Val, Leu, or Gly
  SITE (1027)..(1027): Xaa at position 1027 is Ile, Ala, Val, Leu, or Gly
  SITE (1043)..(1043): Xaa at position 1043 is Ala, Gly, or Pro
  SITE (1045)..(1045): Xaa at position 1045 is Cys, Ala, Val, Gly, Ser, or Thr
  SITE (1052)..(1052): Xaa at position 1052 is Ala, Gly, or Pro
  SITE (1064)..(1064): Xaa at position 1064 is Ile, Ala, Val, Leu, or Gly
  SITE (1066)..(1066): Xaa at position 1066 is Cys, Ala, Val, Gly, Ser, or Thr
  SITE (1091)..(1091): Xaa at position 1091 is Val, Ala, Gly, Leu, or Ile
  SITE (1093)..(1093): Xaa at position 1093 is Tyr, Phe, Met, His, Ile, Leu Val, Ala, or Gly
  SITE (1095)..(1095): Xaa at position 1095 is Cys, Ala, Val, Gly, Ser, or Thr
  SITE (1113)..(1113): Xaa at position 1113 is Ile, Ala, Val, Leu, or Gly
  SITE (1115)..(1115): Xaa at position 1115 is Cys, Ala, Val, Gly, Ser, or Thr
  SITE (1138)..(1138): Xaa at position 1138 is Cys, Ala, Val, Gly, Ser, or Thr
  SITE (1156)..(1156): Xaa at position 1156 is Phe, Tyr, Met, His, Ile, Leu Val, Ala, or Gly
  SITE (1162)..(1162): Xaa at position 1162 is Val, Ala, Gly, Leu, or Ile
  SITE (1178)..(1178): Xaa at position 1178 is Val, Ala, Gly, Leu, or Ile
  SITE (1180)..(1180): Xaa at position 1180 is Cys, Ala, Val, Gly, Ser, or Thr
  SITE (1396)..(1396): Xaa at position 1396 is Cys, Ala, Val, Gly, Ser, or Thr
  SITE (1437)..(1437): Xaa at position 1437 is Ile, Ala, Val, Leu, or Gly
  SITE (1480)..(1480): Xaa at position 1480 is Val, Ala, Gly, Leu, or Ile
  SITE (1498)..(1498): Xaa at position 1498 is Cys, Ala, Val, Gly, Ser, or Thr
  SITE (1544)..(1544): Xaa at position 1544 is Val, Ala, Gly, Leu, or Ile
  SITE (1568)..(1568): Xaa at position 1568 is Cys, Ala, Val, Gly, Ser, or Thr
  SITE (1591)..(1591): Xaa at position 1591 is Cys, Ala, Val, Gly, Ser, or Thr
  SITE (1609)..(1609): Xaa at position 1609 is Phe, Tyr, Met, His, Ile, Leu Val, Ala, or Gly
  SITE (1615)..(1615): Xaa at position 1615 is Ile, Ala, Val, Leu, or Gly
  SITE (1631)..(1631): Xaa at position 1631 is Val, Ala, Gly, Leu, or Ile
  SITE (1633)..(1633): Xaa at position 1633 is Cys, Ala, Val, Gly, Ser, or Thr
MGASSPRSPEPVGPPAPGLPFCCGGSLLAVVVLLALPVAWGQXNAPEWLPFXRPTNLTDEFEFPIGTYXNYECRPGYSGRPFSXIXLKNSVWTGAKDRXRRKSCRNPPDPVNGMVHVIKGXQFGSQXKXSCTKGYRLIGSSSXTXIISGDTXIWDNETPICDRXPXGLPPTITNGDFISTNRENFHYGSVXTXRCNPGSGGRKVFELVGEPSXYXTSNDDQVGIWSGPAPQCIIPNKXTPPNVENGILVSDNRSLXSLNEVXEFRCQPGFVMKGPRRXKXQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHXQAPDHFLFAKLKTQTNASDFPIGTSLKYECRPEYYGRPFSXTCLDNLVWSSPKDVCKRKSCKTPPDPVNGMVHVITDXQVGSRXNYSCTTGHRLIGHSSAEXILSGNAAHWSTKPPICQRIPCGLPPTIANGDFISTNRENFHYGSVXTYRCNPGSGGRKVFELVGEPSIYXTSNDDQVGIWSGPAPQCIIPNKXTPPNVENGILVSDNRSLXSLNEVXEFRCQPGFVMKGPRRXKXQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHXQAPDHFLFAKLKTQTNASDFPIGTSLKYECRPEYYGRPFSXTXLDNLVWSSPKDVCKRKSXKTPPDPVNGMVHVITDXQVGSRXNYSCTTGHRLIGHSSXEXILSGNTXHWSTKPPICQRXPXGLPPTIANGDFISTNRENFHYGSVXTXRXNLGSRGRKVFELVGEPSXYXTSNDDQVGIWSGPAPQCIIPNKXTPPNVENGILVSDNRSLXSLNEVXEFRCQPGFVMKGPRRXKXQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHXKTPEQFPFASPTIPINDFEFPVGTSLNYECRPGYFGKMFSXSCLENLVWSSVEDNCRRKSCGPPPEPFNGMVHINTDTQFGSTXNYSCNEGFRLIGSPSTTXLVSGNNVTWDKKAPICEIISCEPPPTISNGDFYSNNRTSFHNGTVXTYQCHTGPDGEQLFELVGERSIYXTSKDDQVGVWSSPPPRCISTNKXTAPEVENAIRVPGNRSFXSLTEIXRFRCQPGFVMVGSHTXQXQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 363 - protein, 1338 aa, Homo sapiens
  SITE (135)..(135): Xaa at position 135 is Phe, Tyr, Met, His, Ile, Leu, Val Ala, or Gly
  SITE (148)..(148): Xaa at position 148 is Met, Ile, Leu, Val, Ala, or Gly
  SITE (154)..(154): Xaa at position 154 is Leu, Ala, Val, Gly, or Ile
  SITE (156)..(156): Xaa at position 156 is Ile, Ala, Val, Leu, or Gly
  SITE (158)..(158): Xaa at position 158 is Cys, Ala, Val, Gly, Ser, or Thr
  SITE (160)..(160): Xaa at position 160 is Val, Ala, Gly, Leu, or Ile
  SITE (167)..(167): Xaa at position 167 is Val, Ala, Gly, Leu, or Ile
  SITE (169)..(169): Xaa at position 169 is Leu, Ala, Val, Gly, or Ile
  SITE (192)..(192): Xaa at position 192 is Phe, Tyr, Met, His, Ile, Leu, Val Ala, or Gly
  SITE (194)..(194): Xaa at position 194 is Ile, Ala, Val, Leu, or Gly
  SITE (197)..(197): Xaa at position 197 is Ala, Gly, or Pro
  SITE (205)..(205): Xaa at position 205 is Leu, Ala, Val, Gly, or Ile
  SITE (207)..(207): Xaa at position 207 is Cys, Ala, Val, Gly, Ser, or Thr
  SITE (209)..(209): Xaa at position 209 is Ala, Gly, or Pro
  SITE (220)..(220): Xaa at position 220 is Tyr, Phe, Met, His, Ile, Leu, Val Ala, or Gly
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPXVEMYSEIPEIIHXTEGREXVXPXRXTSPNITXTXKKFPLDTLIPDGKRIIWDSRKGXIXSNXTYKEIGLXTXEXTVNGHLYKTNXLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 364 - protein, 760 aa, Homo sapiens
  SITE (40)..(40): Xaa at position 40 is Leu, Ala, Val, Gly, or Ile
  SITE (42)..(42): Xaa at position 42 is Met, Ile, Leu, Val, Ala, or Gly
  SITE (53)..(53): Xaa at position 53 is Leu, Ala, Val, Gly, or Ile
  SITE (54)..(54): Xaa at position 54 is Ala, Gly, or Pro
  SITE (57)..(57): Xaa at position 57 is Met, Ile, Leu, Val, Ala, or Gly
  SITE (58)..(58): Xaa at position 58 is Ala, Gly, or Pro
  SITE (70)..(70): Xaa at position 70 is Leu, Ala, Val, Gly, or Ile
  SITE (72)..(72): Xaa at position 72 is Tyr, Phe, Met, His, Ile, Leu, Val Ala, or Gly
  SITE (73)..(73): Xaa at position 73 is Cys, Ala, Val, Gly, Ser, or Thr
  SITE (80)..(80): Xaa at position 80 is Ile, Ala, Val, Leu, or Gly
  SITE (83)..(83): Xaa at position 83 is Val, Ala, Gly, Leu, or Ile
  SITE (84)..(84): Xaa at position 84 is Ile, Ala, Val, Leu, or Gly
  SITE (87)..(87): Xaa at position 87 is Leu, Ala, Val, Gly, or Ile
  SITE (102)..(102): Xaa at position 102 is Leu, Ala, Val, Gly, or Ile
  SITE (107)..(107): Xaa at position 107 is Leu, Ala, Val, Gly, or Ile
  SITE (108)..(108): Xaa at position 108 is Ala, Gly, or Pro
  SITE (109)..(109): Xaa at position 109 is Leu, Ala, Val, Gly, or Ile
  SITE (115)..(115): Xaa at position 115 is Leu, Ala, Val, Gly, or Ile
  SITE (139)..(139): Xaa at position 139 is Ala, Gly, or Pro
  SITE (170)..(170): Xaa at position 170 is Leu, Ala, Val, Gly, or Ile
  SITE (177)..(177): Xaa at position 177 is Leu, Ala, Val, Gly, or Ile
  SITE (190)..(190): Xaa at position 190 is Cys, Ala, Val, Gly, Ser, or Thr
  SITE (192)..(192): Xaa at position 192 is Tyr, Phe, Met, His, Ile, Leu, Val Ala, or Gly
  SITE (194)..(194): Xaa at position 194 is Leu, Ala, Val, Gly, or Ile
  SITE (195)..(195): Xaa at position 195 is Ala, Gly, or Pro
  SITE (202)..(202): Xaa at position 202 is Ala, Gly, or Pro
  SITE (209)..(209): Xaa at position 209 is Tyr, Phe, Met, His, Ile, Leu, Val Ala, or Gly
  SITE (231)..(231): Xaa at position 231 is Val, Ala, Gly, Leu, or Ile
  SITE (232)..(232): Xaa at position 232 is Val, Ala, Gly, Leu, or Ile
  SITE (236)..(236): Xaa at position 236 is Ala, Gly, or Pro
  SITE (239)..(239): Xaa at position 239 is Ile, Ala, Val, Leu, or Gly
  SITE (243)..(243): Xaa at position 243 is Cys, Ala, Val, Gly, Ser, or Thr
  SITE (251)..(251): Xaa at position 251 is Leu, Ala, Val, Gly, or Ile
  SITE (256)..(256): Xaa at position 256 is Leu, Ala, Val, Gly, or Ile
  SITE (259)..(259): Xaa at position 259 is Cys, Ala, Val, Gly, Ser, or Thr
  SITE (263)..(263): Xaa at position 263 is Leu, Ala, Val, Gly, or Ile
  SITE (298)..(298): Xaa at position 298 is Ala, Gly, or Pro
  SITE (309)..(309): Xaa at position 309 is Val, Ala, Gly, Leu, or Ile
  SITE (375)..(375): Xaa at position 375 is Cys, Ala, Val, Gly, Ser, or Thr
  SITE (382)..(382): Xaa at position 382 is Leu, Ala, Val, Gly, or Ile
  SITE (404)..(404): Xaa at position 404 is Ala, Gly, or Pro
  SITE (406)..(406): Xaa at position 406 is Leu, Ala, Val, Gly, or Ile
  SITE (437)..(437): Xaa at position 437 is Cys, Ala, Val, Gly, Ser, or Thr
  SITE (443)..(443): Xaa at position 443 is Ala, Gly, or Pro
  SITE (444)..(444): Xaa at position 444 is Ile, Ala, Val, Leu, or Gly
  SITE (455)..(455): Xaa at position 455 is Ile, Ala, Val, Leu, or Gly
  SITE (456)..(456): Xaa at position 456 is Ile, Ala, Val, Leu, or Gly
  SITE (461)..(461): Xaa at position 461 is Leu, Ala, Val, Gly, or Ile
  SITE (471)..(471): Xaa at position 471 is Leu, Ala, Val, Gly, or Ile
  SITE (473)..(473): Xaa at position 473 is Phe, Tyr, Met, His, Ile, Leu, Val Ala, or Gly
  SITE (493)..(493): Xaa at position 493 is Met, Ile, Leu, Val, Ala, or Gly
  SITE (494)..(494): Xaa at position 494 is Ile, Ala, Val, Leu, or Gly
  SITE (520)..(520): Xaa at position 520 is Tyr, Phe, Met, His, Ile, Leu, Val Ala, or Gly
  SITE (537)..(537): Xaa at position 537 is Ala, Gly, or Pro
  SITE (539)..(539): Xaa at position 539 is Phe, Tyr, Met, His, Ile, Leu, Val Ala, or Gly
  SITE (561)..(561): Xaa at position 561 is Ile, Ala, Val, Leu, or Gly
  SITE (584)..(584): Xaa at position 584 is Tyr, Phe, Met, His, Ile, Leu, Val Ala, or Gly
  SITE (594)..(594): Xaa at position 594 is Ala, Gly, or Pro
  SITE (596)..(596): Xaa at position 596 is Leu, Ala, Val, Gly, or Ile
  SITE (597)..(597): Xaa at position 597 is Leu, Ala, Val, Gly, or Ile
  SITE (599)..(599): Xaa at position 599 is Val, Ala, Gly, Leu, or Ile
  SITE (617)..(617): Xaa at position 617 is Ala, Gly, or Pro
  SITE (619)..(619): Xaa at position 619 is Ile, Ala, Val, Leu, or Gly
  SITE (620)..(620): Xaa at position 620 is Met, Ile, Leu, Val, Ala, or Gly
  SITE (621)..(621): Xaa at position 621 is Phe, Tyr, Met, His, Ile, Leu, Val Ala, or Gly
  SITE (623)..(623): Xaa at position 623 is Val, Ala, Gly, Leu, or Ile
  SITE (635)..(635): Xaa at position 635 is Ala, Gly, or Pro
  SITE (656)..(656): Xaa at position 656 is Ala, Gly, or Pro
  SITE (660)..(660): Xaa at position 660 is Ala, Gly, or Pro
  SITE (664)..(664): Xaa at position 664 is Val, Ala, Gly, Leu, or Ile
  SITE (667)..(667): Xaa at position 667 is Ala, Gly, or Pro
  SITE (677)..(677): Xaa at position 677 is Met, Ile, Leu, Val, Ala, or Gly
  SITE (678)..(678): Xaa at position 678 is Val, Ala, Gly, Leu, or Ile
  SITE (684)..(684): Xaa at position 684 is Phe, Tyr, Met, His, Ile, Leu, Val Ala, or Gly
  SITE (696)..(696): Xaa at position 696 is Trp, Tyr, Phe, Met, His, Ile, Leu Val, Ala, or Gly
  SITE (704)..(704): Xaa at position 704 is Ala, Gly, or Pro
MKLNVDGLLVYFPYDYIYPEQFSYMRELKRTLDAKGHGVXEXPSGTGKTVSLXXLIXXYQRAYPLEVTKXIXXSRTVPEXEKXXEEXRKLLNFYEKQEGEKXPFLGXXXSSRKNXCIHPEVTPLRFGKDVDGKCHSLTXSYVRAQYQHDTSLPHCRFYEEFDAHGREVPXPAGIYNXDDLKALGRRQGWXPXFXXRYSILHXNVVVYSXHYLLDPKIADLVSKELARKAVXXFDEXHNXDNVXIDSMSVNXTRRTXDRXQGNXETLQKTVLRIKETDEQRLRDEYRRLVEGLREASAXRETDAHLANPXLPDEVLQEAVPGSIRTAEHFLGFLRRLLEYVKWRLRVQHVVQESPPAFLSGLAQRVCIQRKPLRFXAERLRSXLHTLEITDLADFSPLTLLANFXTXVSTYAKGFTIIIEPFDDRTPTIANPILHFSXMDASLXXKPVFERFQSVXXTSGTXSPLDIYPKIXDXHPVTMATFTMTLARVCLCPXXIGRGNDQVAISSKFETREDIAVIRNXGNLLLEMSAVVPDGIVXFXTSYQYMESTVASWYEQGILENXQRNKLLFIETQDGAETSVALEKXQEACENGRGXIXXSXARGKVSEGIDFVHHYGRXVXXXGXPYVYTQSRILKXRLEYLRDQFQIRENDFLTFDXMRHXAQCXGRXIRGKTDYGLXXFADKRXARGDKRGKLPRXIQEHLTDXNLNLTVDEGVQVAKYFLRQMAQPFHREDQLGLSLLSLEQLESEETLKRIEQIAQQL

SEQ ID NO: 365 - protein, 2366 aa, Peptoclostridium difficile
  SITE (9)..(9): Xaa at position 9 is Leu, Ala, Val, Gly, or Ile
  SITE (13)..(13): Xaa at position 13 is Ala, Gly, or Pro
  SITE (24)..(24): Xaa at position 24 is Tyr, Phe, Met, His, Ile, Leu, Val Ala, or Gly
  SITE (27)..(27): Xaa at position 27 is Ile, Ala, Val, Leu, or Gly
  SITE (28)..(28): Xaa at position 28 is Leu, Ala, Val, Gly, or Ile
  SITE (31)..(31): Xaa at position 31 is Leu, Ala, Val, Gly, or Ile
  SITE (37)..(37): Xaa at position 37 is Met, Ile, Leu, Val, Ala, or Gly
  SITE (46)..(46): Xaa at position 46 is Tyr, Phe, Met, His, Ile, Leu, Val Ala, or Gly
  SITE (49)..(49): Xaa at position 49 is Leu, Ala, Val, Gly, or Ile
  SITE (52)..(52): Xaa at position 52 is Ile, Ala, Val, Leu, or Gly
  SITE (59)..(59): Xaa at position 59 is Tyr, Phe, Met, His, Ile, Leu, Val Ala, or Gly
  SITE (72)..(72): Xaa at position 72 is Leu, Ala, Val, Gly, or Ile
  SITE (75)..(75): Xaa at position 75 is Phe, Tyr, Met, His, Ile, Leu, Val Ala, or Gly
  SITE (79)..(79): Xaa at position 79 is Leu, Ala, Val, Gly, or Ile
  SITE (83)..(83): Xaa at position 83 is Val, Ala, Gly, Leu, or Ile
  SITE (98)..(98): Xaa at position 98 is Leu, Ala, Val, Gly, or Ile
  SITE (99)..(99): Xaa at position 99 is His, Phe, Tyr, Lys, Arg, Gly, Ser Thr, Ala, Val, Leu, Ile, Asn, Met, or Gln
  SITE (100)..(100): Xaa at position 100 is Phe, Tyr, Met, His, Ile, Leu, Val Ala, or Gly
  SITE (107)..(107): Xaa at position 107 is Ile, Ala, Val, Leu, or Gly
  SITE (114)..(114): Xaa at position 114 is Tyr, Phe, Met, His, Ile, Leu, Val Ala, or Gly
  SITE (118)..(118): Xaa at position 118 is Trp, Tyr, Phe, Met, His, Ile, Leu Val, Ala, or Gly
  SITE (129)..(129): Xaa at position 129 is Val, Ala, Gly, Leu, or Ile
  SITE (130)..(130): Xaa at position 130 is Phe, Tyr, Met, His, Ile, Leu, Val Ala, or Gly
  SITE (135)..(135): Xaa at position 135 is Ala, Gly, or Pro
  SITE (136)..(136): Xaa at position 136 is Phe, Tyr, Met, His, Ile, Leu, Val Ala, or Gly
  SITE (137)..(137): Xaa at position 137 is Leu, Ala, Val, Gly, or Ile
  SITE (138)..(138): Xaa at position 138 is Ile, Ala, Val, Leu, or Gly
  SITE (141)..(141): Xaa at position 141 is Leu, Ala, Val, Gly, or Ile
  SITE (145)..(145): Xaa at position 145 is Val, Ala, Gly, Leu, or Ile
  SITE (149)..(149): Xaa at position 149 is Ala, Gly, or Pro
  SITE (171)..(171): Xaa at position 171 is Phe, Tyr, Met, His, Ile, Leu, Val Ala, or Gly
  SITE (172)..(172): Xaa at position 172 is Phe, Tyr, Met, His, Ile, Leu, Val Ala, or Gly
  SITE (176)..(176): Xaa at position 176 is Met, Ile, Leu, Val, Ala, or Gly
  SITE (179)..(179): Xaa at position 179 is Ile, Ala, Val, Leu, or Gly
  SITE (186)..(186): Xaa at position 186 is Phe, Tyr, Met, His, Ile, Leu, Val Ala, or Gly
  SITE (202)..(202): Xaa at position 202 is Ile, Ala, Val, Leu, or Gly
  SITE (205)..(205): Xaa at position 205 is Ile, Ala, Val, Leu, or Gly
  SITE (206)..(206): Xaa at position 206 is Val, Ala, Gly, Leu, or Ile
  SITE (210)..(210): Xaa at position 210 is Leu, Ala, Val, Gly, or Ile
  SITE (232)..(232): Xaa at position 232 is Ile, Ala, Val, Leu, or Gly
  SITE (240)..(240): Xaa at position 240 is Val, Ala, Gly, Leu, or Ile
  SITE (246)..(246): Xaa at position 246 is Phe, Tyr, Met, His, Ile, Leu, Val Ala, or Gly
  SITE (254)..(254): Xaa at position 254 is Leu, Ala, Val, Gly, or Ile
  SITE (255)..(255): Xaa at position 255 is Tyr, Phe, Met, His, Ile, Leu, Val Ala, or Gly
  SITE (259)..(259): Xaa at position 259 is Leu, Ala, Val, Gly, or Ile
  SITE (260)..(260): Xaa at position 260 is Val, Ala, Gly, Leu, or Ile
  SITE (263)..(263): Xaa at position 263 is Trp, Tyr, Phe, Met, His, Ile, Leu Val, Ala, or Gly
  SITE (267)..(267): Xaa at position 267 is Ala, Gly, or Pro
  SITE (268)..(268): Xaa at position 268 is Ala, Gly, or Pro
  SITE (271)..(271): Xaa at position 271 is Ile, Ala, Val, Leu, or Gly
  SITE (272)..(272): Xaa at position 272 is Leu, Ala, Val, Gly, or Ile
  SITE (274)..(274): Xaa at position 274 is Ile, Ala, Val, Leu, or Gly
  SITE (276)..(276): Xaa at position 276 is Ala, Gly, or Pro
  SITE (277)..(277): Xaa at position 277 is Leu, Ala, Val, Gly, or Ile
  SITE (283)..(283): Xaa at position 283 is Met, Ile, Leu, Val, Ala, or Gly
  SITE (284)..(284): Xaa at position 284 is Tyr, Phe, Met, His, Ile, Leu, Val Ala, or Gly
  SITE (285)..(285): Xaa at position 285 is Leu, Ala, Val, Gly, or Ile
  SITE (289)..(289): Xaa at position 289 is Met, Ile, Leu, Val, Ala, or Gly
  SITE (290)..(290): Xaa at position 290 is Leu, Ala, Val, Gly, or Ile
  SITE (317)..(317): Xaa at position 317 is Leu, Ala, Val, Gly, or Ile
  SITE (319)..(319): Xaa at position 319 is Ala, Gly, or Pro
  SITE (320)..(320): Xaa at position 320 is Ile, Ala, Val, Leu, or Gly
  SITE (335)..(335): Xaa at position 335 is Phe, Tyr, Met, His, Ile, Leu, Val Ala, or Gly
  SITE (346)..(346): Xaa at position 346 is Phe, Tyr, Met, His, Ile, Leu, Val Ala, or Gly
  SITE (350)..(350): Xaa at position 350 is Leu, Ala, Val, Gly, or Ile
  SITE (359)..(359): Xaa at position 359 is Ile, Ala, Val, Leu, or Gly
  SITE (360)..(360): Xaa at position 360 is Phe, Tyr, Met, His, Ile, Leu, Val Ala, or Gly
  SITE (363)..(363): Xaa at position 363 is Leu, Ala, Val, Gly, or Ile
  SITE (368)..(368): Xaa at position 368 is Ala, Gly, or Pro
  SITE (371)..(371): Xaa at position 371 is Leu, Ala, Val, Gly, or Ile
  SITE (373)..(373): Xaa at position 373 is Val, Ala, Gly, Leu, or Ile
  SITE (375)..(375): Xaa at position 375 is Ile, Ala, Val, Leu, or Gly
  SITE (376)..(376): Xaa at position 376 is Ala, Gly, or Pro
  SITE (387)..(387): Xaa at position 387 is Leu, Ala, Val, Gly, or Ile
  SITE (388)..(388): Xaa at position 388 is Ile, Ala, Val, Leu, or Gly
  SITE (395)..(395): Xaa at position 395 is Cys, Ala, Val, Gly, Ser, or Thr
  SITE (399)..(399): Xaa at position 399 is Ile, Ala, Val, Leu, or Gly
  SITE (403)..(403): Xaa at position 403 is Ile, Ala, Val, Leu, or Gly
  SITE (407)..(407): Xaa at position 407 is Tyr, Phe, Met, His, Ile, Leu, Val Ala, or Gly
  SITE (410)..(410): Xaa at position 410 is Leu, Ala, Val, Gly, or Ile
  SITE (414)..(414): Xaa at position 414 is Leu, Ala, Val, Gly, or Ile
  SITE (417)..(417): Xaa at position 417 is Ala, Gly, or Pro
  SITE (431)..(431): Xaa at position 431 is Phe, Tyr, Met, His, Ile, Leu, Val Ala, or Gly
  SITE (435)..(435): Xaa at position 435 is Ile, Ala, Val, Leu, or Gly
  SITE (447)..(447): Xaa at position 447 is Met, Ile, Leu, Val, Ala, or Gly
  SITE (450)..(450): Xaa at position 450 is Leu, Ala, Val, Gly, or Ile
  SITE (454)..(454): Xaa at position 454 is Leu, Ala, Val, Gly, or Ile
  SITE (458)..(458): Xaa at position 458 is Phe, Tyr, Met, His, Ile, Leu, Val Ala, or Gly
  SITE (462)..(462): Xaa at position 462 is Val, Ala, Gly, Leu, or Ile
  SITE (468)..(468): Xaa at position 468 is Leu, Ala, Val, Gly, or Ile
  SITE (473)..(473): Xaa at position 473 is Ala, Gly, or Pro
  SITE (474)..(474): Xaa at position 474 is Tyr, Phe, Met, His, Ile, Leu, Val Ala, or Gly
  SITE (476)..(476): Xaa at position 476 is Ala, Gly, or Pro
  SITE (477)..(477): Xaa at position 477 is Ala, Gly, or Pro
  SITE (478)..(478): Xaa at position 478 is Tyr, Phe, Met, His, Ile, Leu, Val Ala, or Gly
  SITE (481)..(481): Xaa at position 481 is Leu, Ala, Val, Gly, or Ile
  SITE (484)..(484): Xaa at position 484 is Phe, Tyr, Met, His, Ile, Leu, Val Ala, or Gly
  SITE (498)..(498): Xaa at position 498 is Leu, Ala, Val, Gly, or Ile
  SITE (501)..(501): Xaa at position 501 is Phe, Tyr, Met, His, Ile, Leu, Val Ala, or Gly
  SITE (527)..(527): Xaa at position 527 is Ala, Gly, or Pro
  SITE (562)..(562): Xaa at position 562 is Leu, Ala, Val, Gly, or Ile
  SITE (578)..(578): Xaa at position 578 is Ile, Ala, Val, Leu, or Gly
  SITE (580)..(580): Xaa at position 580 is Tyr, Phe, Met, His, Ile, Leu, Val Ala, or Gly
  SITE (581)..(581): Xaa at position 581 is Ile, Ala, Val, Leu, or Gly
  SITE (582)..(582): Xaa at position 582 is Val, Ala, Gly, Leu, or Ile
  SITE (594)..(594): Xaa at position 594 is Ala, Gly, or Pro
  SITE (595)..(595): Xaa at position 595 is Cys, Ala, Val, Gly, Ser, or Thr
  SITE (598)..(598): Xaa at position 598 is Phe, Tyr, Met, His, Ile, Leu, Val Ala, or Gly
  SITE (599)..(599): Xaa at position 599 is Ala, Gly, or Pro
  SITE (606)..(606): Xaa at position 606 is Val, Ala, Gly, Leu, or Ile
  SITE (607)..(607): Xaa at position 607 is Leu, Ala, Val, Gly, or Ile
  SITE (608)..(608): Xaa at position 608 is Phe, Tyr, Met, His, Ile, Leu, Val Ala, or Gly
  SITE (618)..(618): Xaa at position 618 is Ala, Gly, or Pro
  SITE (634)..(634): Xaa at position 634 is Tyr, Phe, Met, His, Ile, Leu, Val Ala, or Gly
  SITE (640)..(640): Xaa at position 640 is Ile, Ala, Val, Leu, or Gly
  SITE (646)..(646): Xaa at position 646 is Ile, Ala, Val, Leu, or Gly
  SITE (648)..(648): Xaa at position 648 is Leu, Ala, Val, Gly, or Ile
  SITE (650)..(650): Xaa at position 650 is Phe, Tyr, Met, His, Ile, Leu, Val Ala, or Gly
  SITE (663)..(663): Xaa at position 663 is Phe, Tyr, Met, His, Ile, Leu, Val Ala, or Gly
  SITE (671)..(671): Xaa at position 671 is Leu, Ala, Val, Gly, or Ile
  SITE (675)..(675): Xaa at position 675 is Ile, Ala, Val, Leu, or Gly
  SITE (678)..(678): Xaa at position 678 is Ala, Gly, or Pro
  SITE (682)..(682): Xaa at position 682 is Ala, Gly, or Pro
  SITE (686)..(686): Xaa at position 686 is Ile, Ala, Val, Leu, or Gly
  SITE (691)..(691): Xaa at position 691 is Ile, Ala, Val, Leu, or Gly
  SITE (693)..(693): Xaa at position 693 is Ile, Ala, Val, Leu, or Gly
  SITE (695)..(695): Xaa at position 695 is Leu, Ala, Val, Gly, or Ile
  SITE (700)..(700): Xaa at position 700 is Met, Ile, Leu, Val, Ala, or Gly
  SITE (701)..(701): Xaa at position 701 is Phe, Tyr, Met, His, Ile, Leu, Val Ala, or Gly
  SITE (711)..(711): Xaa at position 711 is Tyr, Phe, Met, His, Ile, Leu, Val Ala, or Gly
  SITE (715)..(715): Xaa at position 715 is Leu, Ala, Val, Gly, or Ile
  SITE (716)..(716): Xaa at position 716 is Leu, Ala, Val, Gly, or Ile
  SITE (719)..(719): Xaa at position 719 is Val, Ala, Gly, Leu, or Ile
  SITE (723)..(723): Xaa at position 723 is Ile, Ala, Val, Leu, or Gly
  SITE (727)..(727): Xaa at position 727 is Met, Ile, Leu, Val, Ala, or Gly
  SITE (730)..(730): Xaa at position 730 is Ile, Ala, Val, Leu, or Gly
  SITE (735)..(735): Xaa at position 735 is Ile, Ala, Val, Leu, or Gly
  SITE (737)..(737): Xaa at position 737 is Val, Ala, Gly, Leu, or Ile
  SITE (739)..(739): Xaa at position 739 is Ala, Gly, or Pro
  SITE (754)..(754): Xaa at position 754 is Leu, Ala, Val, Gly, or Ile
  SITE (762)..(762): Xaa at position 762 is Ile, Ala, Val, Leu, or Gly
  SITE (778)..(778): Xaa at position 778 is Ile, Ala, Val, Leu, or Gly
  SITE (789)..(789): Xaa at position 789 is Val, Ala, Gly, Leu, or Ile
  SITE (1866)..(1866): Xaa at position 1866 is Phe, Tyr, Met, His, Ile, Leu Val, Ala, or Gly
  SITE (1888)..(1888): Xaa at position 1888 is Phe, Tyr, Met, His, Ile, Leu Val, Ala, or Gly
  SITE (1908)..(1908): Xaa at position 1908 is Phe, Tyr, Met, His, Ile, Leu Val, Ala, or Gly
  SITE (1909)..(1909): Xaa at position 1909 is Ala, Gly, or Pro
  SITE (1938)..(1938): Xaa at position 1938 is Phe, Tyr, Met, His, Ile, Leu Val, Ala, or Gly
  SITE (1956)..(1956): Xaa at position 1956 is His, Phe, Tyr, Lys, Arg, Gly Ser, Thr, Ala, Val, Leu, Ile, Asn, Met, or Gln
  SITE (1958)..(1958): Xaa at position 1958 is Phe, Tyr, Met, His, Ile, Leu Val, Ala, or Gly
  SITE (1979)..(1979): Xaa at position 1979 is Phe, Tyr, Met, His, Ile, Leu Val, Ala, or Gly
  SITE (1999)..(1999): Xaa at position 1999 is Phe, Tyr, Met, His, Ile, Leu Val, Ala, or Gly
  SITE (2019)..(2019): Xaa at position 2019 is Phe, Tyr, Met, His, Ile, Leu Val, Ala, or Gly
  SITE (2039)..(2039): Xaa at position 2039 is Phe, Tyr, Met, His, Ile, Leu Val, Ala, or Gly
  SITE (2040)..(2040): Xaa at position 2040 is Ala, Gly, or Pro
  SITE (2069)..(2069): Xaa at position 2069 is Phe, Tyr, Met, His, Ile, Leu Val, Ala, or Gly
  SITE (2090)..(2090): Xaa at position 2090 is Phe, Tyr, Met, His, Ile, Leu Val, Ala, or Gly
  SITE (2095)..(2095): Xaa at position 2095 is Ala, Gly, or Pro
  SITE (2305)..(2305): Xaa at position 2305 is Phe, Tyr, Met, His, Ile, Leu Val, Ala, or Gly
  SITE (2306)..(2306): Xaa at position 2306 is Ala, Gly, or Pro
  SITE (2335)..(2335): Xaa at position 2335 is Phe, Tyr, Met, His, Ile, Leu Val, Ala, or Gly
  SITE (2355)..(2355): Xaa at position 2355 is Phe, Tyr, Met, His, Ile, Leu Val, Ala, or Gly
  SITE (2360)..(2360): Xaa at position 2360 is Ala, Gly, or Pro
MSLVNRKQXEKMXNVRFRTQEDEXVAXXDAXEEYHNXSENTVVEKXLKXKDXNSLTDIXIDTYKKSGRNKAXKKXKEYXVTEXLELKNNNLTPVEKNXXXVWIGGQXNDTAINXINQXKDVNSDYNVNXXYDSNXXXXNTXKKTXVESXINDTLESFRENLNDPRFDYNKXXRKRXEIXYDKQKNXINYYKAQREENPELIXDDXXKTYXSNEYSKEIDELNTYIEESLNKXTQNSGNDXRNFEEXKNGESFNXXEQEXXERXNLAXXSDXXRXSXXKEIGGXXXDVDXXPGIQPDLFESIEKPSSVTVDFWEMTKXEXXMKYKEYIPEYTSEHXDMLDEEVQSSXESVXASKSDKSEXXSSXGDMEXSPXEXKXXFNSKGIINQGXXSVKDSYXSNLXVKQXENRXKIXNNSXNPXISEDNDFNTTTNTXIDSXMAEANADNGRFXMEXGKYXRVGXFPDXKTTINXSGPEXXAXXXQDXLMXKEGSMNIHLIEADXRNXEISKTNISQSTEQEMASLWSFDDARXKAQFEEYKRNYFEGSLGEDDNLDFSQNIVVDKEYXLEKISSLARSSERGYXHXXXQLQGDKISYEAXXNLXXKTPYDSXXXQKNIEDSEIXYYYNPGDGEIQEIDKXKIPSIXSDRPKXKXTXIGHGKDEFNTDIXAGFDVDSXSTEXEAXIDLXKEDXSPKSXEXNXLGCNXXSYSINVEETXPGKXXLKXKDKXSELXPSXSQDSXIXSXNQYEVRINSEGRREXLDHSGEWXNKEESIIKDISSKEYXSFNPKENKITXKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYXNPINGGAASIGETIIDDKNYYXNQSGVLQTGVFSTEDGFKYXXPANTLDENLEGEAIDFTGKLIIDENIYYXDDNYRGAVEWKELDGEMXYXSPETGKAFKGLNQIGDYKYYXNSDGVMQKGFVSINDNKHYXDDSGVMKVGYTEIDGKHFYXAENGEMQIGVFNTEDGFKYXXHHNEDLGNEEGEEISYSGILNFNNKIYYXDDSFTAVVGWKDLEDGSKYYXDEDTXEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYXXHQNTLDENFEGESINYTGWLDLDEKRYYXTDEYIAATGSVIIDGEEYYXDPDTXQLVISE

SEQ ID NO: 366 - protein, 1134 aa, Homo sapiens
  SITE (4)..(4): Xaa at position 4 is Phe, Tyr, Met, His, Ile, Leu, Val Ala, or Gly
  SITE (5)..(5): Xaa at position 5 is His, Phe, Tyr, Lys, Arg, Gly, Ser Thr, Ala, Val, Leu, Ile, Asn, Met, or Gln
  SITE (9)..(9): Xaa at position 9 is Ile, Ala, Val, Leu, or Gly
  SITE (13)..(13): Xaa at position 13 is Leu, Ala, Val, Gly, or Ile
  SITE (17)..(17): Xaa at position 17 is Ala, Gly, or Pro
  SITE (20)..(20): Xaa at position 20 is Ile, Ala, Val, Leu, or Gly
  SITE (70)..(70): Xaa at position 70 is Leu, Ala, Val, Gly, or Ile
  SITE (74)..(74): Xaa at position 74 is Met, Ile, Leu, Val, Ala, or Gly
  SITE (77)..(77): Xaa at position 77 is Ala, Gly, or Pro
  SITE (81)..(81): Xaa at position 81 is Val, Ala, Gly, Leu, or Ile
  SITE (85)..(85): Xaa at position 85 is Cys, Ala, Val, Gly, Ser, or Thr
  SITE (91)..(91): Xaa at position 91 is Ala, Gly, or Pro
  SITE (92)..(92): Xaa at position 92 is Ala, Gly, or Pro
  SITE (95)..(95): Xaa at position 95 is Leu, Ala, Val, Gly, or Ile
  SITE (104)..(104): Xaa at position 104 is Ala, Gly, or Pro
  SITE (109)..(109): Xaa at position 109 is Ile, Ala, Val, Leu, or Gly
  SITE (116)..(116): Xaa at position 116 is Leu, Ala, Val, Gly, or Ile
  SITE (124)..(124): Xaa at position 124 is Leu, Ala, Val, Gly, or Ile
  SITE (129)..(129): Xaa at position 129 is Ala, Gly, or Pro
  SITE (131)..(131): Xaa at position 131 is Val, Ala, Gly, Leu, or Ile
  SITE (134)..(134): Xaa at position 134 is Ile, Ala, Val, Leu, or Gly
  SITE (138)..(138): Xaa at position 138 is Cys, Ala, Val, Gly, Ser, or Thr
  SITE (145)..(145): Xaa at position 145 is Leu, Ala, Val, Gly, or Ile
  SITE (148)..(148): Xaa at position 148 is Ala, Gly, or Pro
  SITE (160)..(160): Xaa at position 160 is Tyr, Phe, Met, His, Ile, Leu, Val Ala, or Gly
  SITE (164)..(164): Xaa at position 164 is Leu, Ala, Val, Gly, or Ile
  SITE (171)..(171): Xaa at position 171 is Met, Ile, Leu, Val, Ala, or Gly
  SITE (175)..(175): Xaa at position 175 is Ile, Ala, Val, Leu, or Gly
  SITE (182)..(182): Xaa at position 182 is Leu, Ala, Val, Gly, or Ile
  SITE (191)..(191): Xaa at position 191 is Leu, Ala, Val, Gly, or Ile
  SITE (192)..(192): Xaa at position 192 is Val, Ala, Gly, Leu, or Ile
  SITE (198)..(198): Xaa at position 198 is Val, Ala, Gly, Leu, or Ile
  SITE (201)..(201): Xaa at position 201 is Leu, Ala, Val, Gly, or Ile
  SITE (205)..(205): Xaa at position 205 is Leu, Ala, Val, Gly, or Ile
  SITE (208)..(208): Xaa at position 208 is Ala, Gly, or Pro
  SITE (209)..(209): Xaa at position 209 is Met, Ile, Leu, Val, Ala, or Gly
  SITE (213)..(213): Xaa at position 213 is Val, Ala, Gly, Leu, or Ile
  SITE (223)..(223): Xaa at position 223 is Ile, Ala, Val, Leu, or Gly
  SITE (226)..(226): Xaa at position 226 is Ala, Gly, or Pro
  SITE (237)..(237): Xaa at position 237 is Met, Ile, Leu, Val, Ala, or Gly
  SITE (241)..(241): Xaa at position 241 is Ile, Ala, Val, Leu, or Gly
  SITE (244)..(244): Xaa at position 244 is Ile, Ala, Val, Leu, or Gly
  SITE (247)..(247): Xaa at position 247 is Val, Ala, Gly, Leu, or Ile
  SITE (248)..(248): Xaa at position 248 is Leu, Ala, Val, Gly, or Ile
  SITE (269)..(269): Xaa at position 269 is Ala, Gly, or Pro
  SITE (273)..(273): Xaa at position 273 is Ile, Ala, Val, Leu, or Gly
  SITE (280)..(280): Xaa at position 280 is Ala, Gly, or Pro
  SITE (283)..(283): Xaa at position 283 is Trp, Tyr, Phe, Met, His, Ile, Leu Val, Ala, or Gly
  SITE (298)..(298): Xaa at position 298 is Ala, Gly, or Pro
  SITE (299)..(299): Xaa at position 299 is Ile, Ala, Val, Leu, or Gly
  SITE (302)..(302): Xaa at position 302 is Ile, Ala, Val, Leu, or Gly
  SITE (306)..(306): Xaa at position 306 is Ala, Gly, or Pro
  SITE (321)..(321): Xaa at position 321 is Ile, Ala, Val, Leu, or Gly
  SITE (335)..(335): Xaa at position 335 is Val, Ala, Gly, Leu, or Ile
  SITE (353)..(353): Xaa at position 353 is Ala, Gly, or Pro
  SITE (360)..(360): Xaa at position 360 is Leu, Ala, Val, Gly, or Ile
  SITE (363)..(363): Xaa at position 363 is Leu, Ala, Val, Gly, or Ile
  SITE (367)..(367): Xaa at position 367 is Val, Ala, Gly, Leu, or Ile
  SITE (384)..(384): Xaa at position 384 is Ile, Ala, Val, Leu, or Gly
  SITE (388)..(388): Xaa at position 388 is Ile, Ala, Val, Leu, or Gly
  SITE (391)..(391): Xaa at position 391 is Ala, Gly, or Pro
  SITE (408)..(408): Xaa at position 408 is Ile, Ala, Val, Leu, or Gly
  SITE (411)..(411): Xaa at position 411 is Ala, Gly, or Pro
  SITE (415)..(415): Xaa at position 415 is Ala, Gly, or Pro
  SITE (419)..(419): Xaa at position 419 is Ala, Gly, or Pro
  SITE (431)..(431): Xaa at position 431 is Ile, Ala, Val, Leu, or Gly
  SITE (438)..(438): Xaa at position 438 is Ile, Ala, Val, Leu, or Gly
  SITE (445)..(445): Xaa at position 445 is Leu, Ala, Val, Gly, or Ile
  SITE (466)..(466): Xaa at position 466 is Val, Ala, Gly, Leu, or Ile
  SITE (470)..(470): Xaa at position 470 is Leu, Ala, Val, Gly, or Ile
  SITE (473)..(473): Xaa at position 473 is Leu, Ala, Val, Gly, or Ile
  SITE (480)..(480): Xaa at position 480 is Ala, Gly, or Pro
  SITE (500)..(500): Xaa at position 500 is Ala, Gly, or Pro
  SITE (518)..(518): Xaa at position 518 is Ala, Gly, or Pro
  SITE (545)..(545): Xaa at position 545 is Cys, Ala, Val, Gly, Ser, or Thr
  SITE (548)..(548): Xaa at position 548 is Val, Ala, Gly, Leu, or Ile
  SITE (551)..(551): Xaa at position 551 is Leu, Ala, Val, Gly, or Ile
  SITE (576)..(576): Xaa at position 576 is Leu, Ala, Val, Gly, or Ile
  SITE (580)..(580): Xaa at position 580 is Leu, Ala, Val, Gly, or Ile
  SITE (609)..(609): Xaa at position 609 is Leu, Ala, Val, Gly, or Ile
  SITE (613)..(613): Xaa at position 613 is Ala, Gly, or Pro
  SITE (626)..(626): Xaa at position 626 is Phe, Tyr, Met, His, Ile, Leu, Val Ala, or Gly
  SITE (633)..(633): Xaa at position 633 is Phe, Tyr, Met, His, Ile, Leu, Val Ala, or Gly
  SITE (644)..(644): Xaa at position 644 is Ala, Gly, or Pro
  SITE (679)..(679): Xaa at position 679 is Ala, Gly, or Pro
  SITE (683)..(683): Xaa at position 683 is Leu, Ala, Val, Gly, or Ile
  SITE (695)..(695): Xaa at position 695 is Phe, Tyr, Met, His, Ile, Leu, Val Ala, or Gly
  SITE (734)..(734): Xaa at position 734 is Leu, Ala, Val, Gly, or Ile
  SITE (760)..(760): Xaa at position 760 is Ala, Gly, or Pro
  SITE (763)..(763): Xaa at position 763 is Ile, Ala, Val, Leu, or Gly
  SITE (766)..(766): Xaa at position 766 is Val, Ala, Gly, Leu, or Ile
  SITE (783)..(783): Xaa at position 783 is Val, Ala, Gly, Leu, or Ile
  SITE (786)..(786): Xaa at position 786 is Ala, Gly, or Pro
  SITE (790)..(790): Xaa at position 790 is Leu, Ala, Val, Gly, or Ile
  SITE (828)..(828): Xaa at position 828 is Val, Ala, Gly, Leu, or Ile
  SITE (831)..(831): Xaa at position 831 is Val, Ala, Gly, Leu, or Ile
  SITE (909)..(909): Xaa at position 909 is Ala, Gly, or Pro
  SITE (956)..(956): Xaa at position 956 is Met, Ile, Leu, Val, Ala, or Gly
  SITE (966)..(966): Xaa at position 966 is Ile, Ala, Val, Leu, or Gly
  SITE (970)..(970): Xaa at position 970 is Ala, Gly, or Pro
  SITE (973)..(973): Xaa at position 973 is Leu, Ala, Val, Gly, or Ile
  SITE (977)..(977): Xaa at position 977 is Ala, Gly, or Pro
  SITE (987)..(987): Xaa at position 987 is Ile, Ala, Val, Leu, or Gly
  SITE (988)..(988): Xaa at position 988 is Ile, Ala, Val, Leu, or Gly
  SITE (990)..(990): Xaa at position 990 is Ala, Gly, or Pro
  SITE (991)..(991): Xaa at position 991 is Ala, Gly, or Pro
  SITE (994)..(994): Xaa at position 994 is Met, Ile, Leu, Val, Ala, or Gly
  SITE (995)..(995): Xaa at position 995 is Ala, Gly, or Pro
  SITE (998)..(998): Xaa at position 998 is Met, Ile, Leu, Val, Ala, or Gly
  SITE (1001)..(1001): Xaa at position 1001 is Met, Ile, Leu, Val, Ala, or Gly
  SITE (1015)..(1015): Xaa at position 1015 is Leu, Ala, Val, Gly, or Ile
  SITE (1018)..(1018): Xaa at position 1018 is Cys, Ala, Val, Gly, Ser, or Thr
  SITE (1019)..(1019): Xaa at position 1019 is Ala, Gly, or Pro
  SITE (1022)..(1022): Xaa at position 1022 is Ile, Ala, Val, Leu, or Gly
  SITE (1023)..(1023): Xaa at position 1023 is Ala, Gly, or Pro
  SITE (1025)..(1025): Xaa at position 1025 is Ala, Gly, or Pro
  SITE (1029)..(1029): Xaa at position 1029 is Val, Ala, Gly, Leu, or Ile
  SITE (1033)..(1033): Xaa at position 1033 is Ala, Gly, or Pro
  SITE (1037)..(1037): Xaa at position 1037 is Ala, Gly, or Pro
  SITE (1040)..(1040): Xaa at position 1040 is Cys, Ala, Val, Gly, Ser, or Thr
  SITE (1049)..(1049): Xaa at position 1049 is Leu, Ala, Val, Gly, or Ile
  SITE (1052)..(1052): Xaa at position 1052 is Val, Ala, Gly, Leu, or Ile
  SITE (1053)..(1053): Xaa at position 1053 is Cys, Ala, Val, Gly, Ser, or Thr
  SITE (1056)..(1056): Xaa at position 1056 is Ile, Ala, Val, Leu, or Gly
  SITE (1063)..(1063): Xaa at position 1063 is Leu, Ala, Val, Gly, or Ile
  SITE (1071)..(1071): Xaa at position 1071 is Ala, Gly, or Pro
  SITE (1087)..(1087): Xaa at position 1087 is Ala, Gly, or Pro
  SITE (1091)..(1091): Xaa at position 1091 is Leu, Ala, Val, Gly, or Ile
  SITE (1095)..(1095): Xaa at position 1095 is Ala, Gly, or Pro
  SITE (1098)..(1098): Xaa at position 1098 is Leu, Ala, Val, Gly, or Ile
  SITE (1099)..(1099): Xaa at position 1099 is Met, Ile, Leu, Val, Ala, or Gly
  SITE (1102)..(1102): Xaa at position 1102 is Val, Ala, Gly, Leu, or Ile
  SITE (1106)..(1106): Xaa at position 1106 is Val, Ala, Gly, Leu, or Ile
  SITE (1109)..(1109): Xaa at position 1109 is Ala, Gly, or Pro
  SITE (1112)..(1112): Xaa at position 1112 is Ala, Gly, or Pro
MPVXXTRTXESIXEPVXQQXSHLVIMHEEGEVDGKAIPDLTAPVAAVQAAVSNLVRVGKETVQTTEDQIXKRDXPPXFIKXENAXTKLVQXXQMXQSDPYSVPXRDYLXDGSRGIXSGTSDLLXTFDEXEXRKXIRVXKGILEYXTVXEVVETMEDLVTXTKNXGPGMTKXAKMXDERQQEXTHQEHRVMXXNSMNTXKEXLPVXISXXKIFXTTKNSKNQGXEEXLKNRNFTVEKXSAEXNEXIRXXQLTSWDEDAWASKDTEAMKRXLASXDSKLNQXKGXLRDPSASPGDAGEQXXRQXLDEXGKVGELCAGKERREXLGTCKMLGQMTDQXADLRARGQGSSPVAMQKXQQVSQGXDVXTAKXENAARKLEAMTNSKQSXAKKXDAXQNWLADPNGGPEGEEQXRGXLAEXRKIXELCDDPKERDDXLRSLGEXSALTSKXADLRRQGKGDSPEARALAKQXATAXQNXQTKTNRXVANSRPAKAAVHLEGKIEQXQRWIDNPTVDDRGVGQAXIRGLVAEGHRLANVMMGPYRQDLLAKXDRXDQXTAQLADLAARGEGESPQARALASQXQDSXKDLKARMQEAMTQEVSDVFSDTTTPIKLXAVAXTAPPDAPNREEVXDERAANXENHSGKLGATXEKAAAVGTANKSTVEGIQASVKTARELTPQVVSAXRILXRNPGNQAAYEHXETMKNQWIDNVEKMTGLVDEAIDTKSLLDASEEAIKKDXDKCKVAMANIQPQMLVAGATSIARRXNRXLLXAKREVENSEDPKFREAXKAXSDEXSKTISPMVMDAKAVAGNISDPGLQKSFLDSGYRILGAXAKXREAFQPQEPDFPPPPPDLEQLRLTDELAPPKPPLPEGEVPPPRPPPPEEKDEEFPEQKAGEVINQPMMMAARQLHDEXRKWSSKPGIPAAEVGIGVVAEADAADAAGFPVPPDMEDDYEPELLLXPSNQPVNQPXLAAXQSXHREXTKWSSKGNDXXAXXKRXXLLXAEXSRLVRGGSGTKRAXIQXXKDXXKXSDEXTRLXKEVXKQXTDKRIRTNXLQXXERXPTISTQXKILSTVKXTMLGRTNISDEESEQXTEMXVHNXQNXXQSXKETXREXEAXSIKIRTDAGFTLRWVRKTPWYQ

SEQ ID NO: 367 - protein, 177 aa, Homo sapiens
  SITE (38)..(38): Xaa at position 38 is Phe, Tyr, Met, His, Ile, Leu, Val Ala, or Gly
  SITE (40)..(40): Xaa at position 40 is Ile, Ala, Val, Leu, or Gly
  SITE (56)..(56): Xaa at position 56 is Val, Ala, Gly, Leu, or Ile
  SITE (57)..(57): Xaa at position 57 is Ala, Gly, or Pro
  SITE (73)..(73): Xaa at position 73 is Val, Ala, Gly, Leu, or Ile
  SITE (80)..(80): Xaa at position 80 is Ala, Gly, or Pro
  SITE (81)..(81): Xaa at position 81 is Leu, Ala, Val, Gly, or Ile
  SITE (82)..(82): Xaa at position 82 is Phe, Tyr, Met, His, Ile, Leu, Val Ala, or Gly
  SITE (83)..(83): Xaa at position 83 is Leu, Ala, Val, Gly, or Ile
  SITE (91)..(91): Xaa at position 91 is Cys, Ala, Val, Gly, Ser, or Thr
  SITE (92)..(92): Xaa at position 92 is Leu, Ala, Val, Gly, or Ile
  SITE (94)..(94): Xaa at position 94 is Cys, Ala, Val, Gly, Ser, or Thr
  SITE (103)..(103): Xaa at position 103 is Leu, Ala, Val, Gly, or Ile
  SITE (123)..(123): Xaa at position 123 is Phe, Tyr, Met, His, Ile, Leu, Val Ala, or Gly
  SITE (125)..(125): Xaa at position 125 is Phe, Tyr, Met, His, Ile, Leu, Val Ala, or Gly
  SITE (136)..(136): Xaa at position 136 is Phe, Tyr, Met, His, Ile, Leu, Val Ala, or Gly
  SITE (147)..(147): Xaa at position 147 is Cys, Ala, Val, Gly, Ser, or Thr
  SITE (149)..(149): Xaa at position 149 is Ala, Gly, or Pro
  SITE (156)..(156): Xaa at position 156 is Val, Ala, Gly, Leu, or Ile
  SITE (158)..(158): Xaa at position 158 is Leu, Ala, Val, Gly, or Ile
  SITE (171)..(171): Xaa at position 171 is Phe, Tyr, Met, His, Ile, Leu, Val Ala, or Gly
MEICRGLRSHLITLLLFLFHSETICRPSGRKSSKMQAXRXWDVNQKTFYLRNNQLXXGYLQGPNVNLEEKIDXVPIEPHXXXXGIHGGKMXXSXVKSGDETRXQLEAVNITDLSENRKQDKRXAXIRSDSGPTTSXESAACPGWFLXTXMEADQPXSXTNMPDEGVMVTKXYFQEDE

SEQ ID NO: 368 - protein, 136 aa, Bacillus subtilis
  strain 168
  SITE (6)..(6): Xaa at position 6 is Leu, Ala, Val, Gly, or Ile
  SITE (10)..(10): Xaa at position 10 is Ala, Gly, or Pro
  SITE (13)..(13): Xaa at position 13 is Ala, Gly, or Pro
  SITE (28)..(28): Xaa at position 28 is Ala, Gly, or Pro
  SITE (29)..(29): Xaa at position 29 is Ala, Gly, or Pro
  SITE (30)..(30): Xaa at position 30 is Leu, Ala, Val, Gly, or Ile
  SITE (31)..(31): Xaa at position 31 is Leu, Ala, Val, Gly, or Ile
  SITE (54)..(54): Xaa at position 54 is Ala, Gly, or Pro
  SITE (58)..(58): Xaa at position 58 is Ala, Gly, or Pro
  SITE (59)..(59): Xaa at position 59 is Leu, Ala, Val, Gly, or Ile
  SITE (62)..(62): Xaa at position 62 is Ala, Gly, or Pro
  SITE (73)..(73): Xaa at position 73 is Leu, Ala, Val, Gly, or Ile
  SITE (74)..(74): Xaa at position 74 is Ala, Gly, or Pro
  SITE (75)..(75): Xaa at position 75 is Val, Ala, Gly, Leu, or Ile
  SITE (76)..(76): Xaa at position 76 is Ala, Gly, or Pro
  SITE (77)..(77): Xaa at position 77 is Ala, Gly, or Pro
  SITE (89)..(89): Xaa at position 89 is Cys, Ala, Val, Gly, Ser, or Thr
  SITE (93)..(93): Xaa at position 93 is Ile, Ala, Val, Leu, or Gly
  SITE (101)..(101): Xaa at position 101 is Val, Ala, Gly, Leu, or Ile
  SITE (103)..(103): Xaa at position 103 is Val, Ala, Gly, Leu, or Ile
  SITE (104)..(104): Xaa at position 104 is Val, Ala, Gly, Leu, or Ile
  SITE (117)..(117): Xaa at position 117 is Val, Ala, Gly, Leu, or Ile
MNRQEXITEXLKXRDMAYAPYSKFQVGXXXXTKDGKVYRGCNIENAAYSMCNCXERTXXFKXVSEGDTEFQMXXXXXDTPGPVSPCGAXRQVXSELCTKDXIXXLTNLQGQIKEMTXEELLPGAFSSEDLHDERKL

SEQ ID NO: 369 - protein, 508 aa, Homo sapiens
  SITE (39)..(39): Xaa at position 39 is Ala, Gly, or Pro
  SITE (41)..(41): Xaa at position 41 is Leu, Ala, Val, Gly, or Ile
  SITE (42)..(42): Xaa at position 42 is Leu, Ala, Val, Gly, or Ile
  SITE (50)..(50): Xaa at position 50 is Leu, Ala, Val, Gly, or Ile
  SITE (52)..(52): Xaa at position 52 is Cys, Ala, Val, Gly, Ser, or Thr
  SITE (53)..(53): Xaa at position 53 is Phe, Tyr, Met, His, Ile, Leu, Val Ala, or Gly
  SITE (60)..(60): Xaa at position 60 is Leu, Ala, Val, Gly, or Ile
  SITE (62)..(62): Xaa at position 62 is Cys, Ala, Val, Gly, Ser, or Thr
  SITE (63)..(63): Xaa at position 63 is Phe, Tyr, Met, His, Ile, Leu, Val Ala, or Gly
  SITE (64)..(64): Xaa at position 64 is Trp, Tyr, Phe, Met, His, Ile, Leu Val, Ala, or Gly
  SITE (79)..(79): Xaa at position 79 is Phe, Tyr, Met, His, Ile, Leu, Val Ala, or Gly
  SITE (81)..(81): Xaa at position 81 is Tyr, Phe, Met, His, Ile, Leu, Val Ala, or Gly
  SITE (83)..(83): Xaa at position 83 is Leu, Ala, Val, Gly, or Ile
  SITE (105)..(105): Xaa at position 105 is Phe, Tyr, Met, His, Ile, Leu, Val Ala, or Gly
  SITE (107)..(107): Xaa at position 107 is Cys, Ala, Val, Gly, Ser, or Thr
  SITE (120)..(120): Xaa at position 120 is Leu, Ala, Val, Gly, or Ile
  SITE (122)..(122): Xaa at position 122 is Leu, Ala, Val, Gly, or Ile
  SITE (124)..(124): Xaa at position 124 is Val, Ala, Gly, Leu, or Ile
  SITE (139)..(139): Xaa at position 139 is Ile, Ala, Val, Leu, or Gly
  SITE (142)..(142): Xaa at position 142 is Val, Ala, Gly, Leu, or Ile
  SITE (143)..(143): Xaa at position 143 is Val, Ala, Gly, Leu, or Ile
  SITE (144)..(144): Xaa at position 144 is Leu, Ala, Val, Gly, or Ile
  SITE (145)..(145): Xaa at position 145 is Leu, Ala, Val, Gly, or Ile
  SITE (152)..(152): Xaa at position 152 is Val, Ala, Gly, Leu, or Ile
  SITE (162)..(162): Xaa at position 162 is Val, Ala, Gly, Leu, or Ile
  SITE (164)..(164): Xaa at position 164 is Leu, Ala, Val, Gly, or Ile
  SITE (166)..(166): Xaa at position 166 is Trp, Tyr, Phe, Met, His, Ile, Leu Val, Ala, or Gly
  SITE (178)..(178): Xaa at position 178 is Ile, Ala, Val, Leu, or Gly
  SITE (180)..(180): Xaa at position 180 is Tyr, Phe, Met, His, Ile, Leu, Val Ala, or Gly
  SITE (182)..(182): Xaa at position 182 is Val, Ala, Gly, Leu, or Ile
  SITE (184)..(184): Xaa at position 184 is Val, Ala, Gly, Leu, or Ile
  SITE (207)..(207): Xaa at position 207 is Leu, Ala, Val, Gly, or Ile
  SITE (218)..(218): Xaa at position 218 is Phe, Tyr, Met, His, Ile, Leu, Val Ala, or Gly
  SITE (219)..(219): Xaa at position 219 is Ala, Gly, or Pro
  SITE (220)..(220): Xaa at position 220 is Val, Ala, Gly, Leu, or Ile
  SITE (222)..(222): Xaa at position 222 is Ala, Gly, or Pro
  SITE (224)..(224): Xaa at position 224 is Met, Ile, Leu, Val, Ala, or Gly
MDHLGASLWPQVGSLCLLLAGAAWAPPPNLPDPKFESKXAXXAARGPEEXLXXTERLEDXVXXXEEAASAGVGPGNYSXSXQXEDEPWKLCRLHQAPTARGAVRXWXSLPTADTSSFVPXEXRXTAASGAPRYHRVIHXNEXXXXDAPVGLXARLADESGHXVXRXLPPPETPMTSHXRXEXDXSAGNGAGSVQRVEILEGRTECVXSNLRGRTRYTXXXRXRXAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 370 - protein, 250 aa, Homo sapiens
  SITE (43)..(43): Xaa at position 43 is Phe, Tyr, Met, His, Ile, Leu, Val Ala, or Gly
  SITE (54)..(54): Xaa at position 54 is Val, Ala, Gly, Leu, or Ile
  SITE (56)..(56): Xaa at position 56 is Trp, Tyr, Phe, Met, His, Ile, Leu Val, Ala, or Gly
  SITE (63)..(63): Xaa at position 63 is Val, Ala, Gly, Leu, or Ile
  SITE (64)..(64): Xaa at position 64 is Ala, Gly, or Pro
  SITE (90)..(90): Xaa at position 90 is Leu, Ala, Val, Gly, or Ile
  SITE (92)..(92): Xaa at position 92 is Ile, Ala, Val, Leu, or Gly
  SITE (95)..(95): Xaa at position 95 is Leu, Ala, Val, Gly, or Ile
  SITE (103)..(103): Xaa at position 103 is Tyr, Phe, Met, His, Ile, Leu, Val Ala, or Gly
  SITE (116)..(116): Xaa at position 116 is Phe, Tyr, Met, His, Ile, Leu, Val Ala, or Gly
  SITE (118)..(118): Xaa at position 118 is Leu, Ala, Val, Gly, or Ile
  SITE (121)..(121): Xaa at position 121 is Leu, Ala, Val, Gly, or Ile
  SITE (129)..(129): Xaa at position 129 is Leu, Ala, Val, Gly, or Ile
  SITE (131)..(131): Xaa at position 131 is Cys, Ala, Val, Gly, Ser, or Thr
  SITE (140)..(140): Xaa at position 140 is Val, Ala, Gly, Leu, or Ile
  SITE (156)..(156): Xaa at position 156 is Met, Ile, Leu, Val, Ala, or Gly
  SITE (163)..(163): Xaa at position 163 is Met, Ile, Leu, Val, Ala, or Gly
  SITE (166)..(166): Xaa at position 166 is Cys, Ala, Val, Gly, Ser, or Thr
MVAGSDAGRALGVLSVVCLLHCFGFISCFSQQIYGVVYGNVTXHVPSNVPLKEXLXKKQKDKXXELENSEFRAFSSFKNRVYLDTVSGSXTXYNXTSSDEDEXEMESPNITDTMKXFXYVXESLPSPTXTXALTNGSIEXQCMIPEHYNSHRGLIXYSWDCPXEQXKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 371 - protein, 739 aa, Homo sapiens
  SITE (37)..(37): Xaa at position 37 is Ala, Gly, or Pro
  SITE (43)..(43): Xaa at position 43 is Val, Ala, Gly, Leu, or Ile
  SITE (45)..(45): Xaa at position 45 is Leu, Ala, Val, Gly, or Ile
  SITE (47)..(47): Xaa at position 47 is Cys, Ala, Val, Gly, Ser, or Thr
  SITE (80)..(80): Xaa at position 80 is Leu, Ala, Val, Gly, or Ile
  SITE (82)..(82): Xaa at position 82 is Met, Ile, Leu, Val, Ala, or Gly
  SITE (85)..(85): Xaa at position 85 is Val, Ala, Gly, Leu, or Ile
  SITE (93)..(93): Xaa at position 93 is Tyr, Phe, Met, His, Ile, Leu, Val Ala, or Gly
  SITE (95)..(95): Xaa at position 95 is Cys, Ala, Val, Gly, Ser, or Thr
  SITE (97)..(97): Xaa at position 97 is Ala, Gly, or Pro
  SITE (108)..(108): Xaa at position 108 is Ile, Ala, Val, Leu, or Gly
  SITE (115)..(115): Xaa at position 115 is Phe, Tyr, Met, His, Ile, Leu, Val Ala, or Gly
  SITE (133)..(133): Xaa at position 133 is Ile, Ala, Val, Leu, or Gly
  SITE (135)..(135): Xaa at position 135 is Val, Ala, Gly, Leu, or Ile
  SITE (137)..(137): Xaa at position 137 is Cys, Ala, Val, Gly, Ser, or Thr
  SITE (139)..(139): Xaa at position 139 is Val, Ala, Gly, Leu, or Ile
  SITE (142)..(142): Xaa at position 142 is Val, Ala, Gly, Leu, or Ile
  SITE (145)..(145): Xaa at position 145 is Phe, Tyr, Met, His, Ile, Leu, Val Ala, or Gly
  SITE (150)..(150): Xaa at position 150 is Ile, Ala, Val, Leu, or Gly
  SITE (152)..(152): Xaa at position 152 is Leu, Ala, Val, Gly, or Ile
  SITE (178)..(178): Xaa at position 178 is Leu, Ala, Val, Gly, or Ile
  SITE (193)..(193): Xaa at position 193 is Leu, Ala, Val, Gly, or Ile
  SITE (195)..(195): Xaa at position 195 is Cys, Ala, Val, Gly, Ser, or Thr
  SITE (197)..(197): Xaa at position 197 is Ala, Gly, or Pro
  SITE (199)..(199): Xaa at position 199 is Leu, Ala, Val, Gly, or Ile
  SITE (325)..(325): Xaa at position 325 is Ala, Gly, or Pro
  SITE (331)..(331): Xaa at position 331 is Val, Ala, Gly, Leu, or Ile
  SITE (333)..(333): Xaa at position 333 is Leu, Ala, Val, Gly, or Ile
  SITE (335)..(335): Xaa at position 335 is Cys, Ala, Val, Gly, Ser, or Thr
  SITE (368)..(368): Xaa at position 368 is Leu, Ala, Val, Gly, or Ile
  SITE (370)..(370): Xaa at position 370 is Leu, Ala, Val, Gly, or Ile
  SITE (373)..(373): Xaa at position 373 is Val, Ala, Gly, Leu, or Ile
  SITE (381)..(381): Xaa at position 381 is Tyr, Phe, Met, His, Ile, Leu, Val Ala, or Gly
  SITE (383)..(383): Xaa at position 383 is Cys, Ala, Val, Gly, Ser, or Thr
  SITE (385)..(385): Xaa at position 385 is Val, Ala, Gly, Leu, or Ile
  SITE (396)..(396): Xaa at position 396 is Ile, Ala, Val, Leu, or Gly
  SITE (403)..(403): Xaa at position 403 is Phe, Tyr, Met, His, Ile, Leu, Val Ala, or Gly
  SITE (421)..(421): Xaa at position 421 is Val, Ala, Gly, Leu, or Ile
  SITE (423)..(423): Xaa at position 423 is Val, Ala, Gly, Leu, or Ile
  SITE (425)..(425): Xaa at position 425 is Cys, Ala, Val, Gly, Ser, or Thr
  SITE (427)..(427): Xaa at position 427 is Val, Ala, Gly, Leu, or Ile
  SITE (430)..(430): Xaa at position 430 is Val, Ala, Gly, Leu, or Ile
  SITE (433)..(433): Xaa at position 433 is Leu, Ala, Val, Gly, or Ile
  SITE (438)..(438): Xaa at position 438 is Ile, Ala, Val, Leu, or Gly
  SITE (440)..(440): Xaa at position 440 is Leu, Ala, Val, Gly, or Ile
  SITE (466)..(466): Xaa at position 466 is Leu, Ala, Val, Gly, or Ile
  SITE (481)..(481): Xaa at position 481 is Leu, Ala, Val, Gly, or Ile
  SITE (483)..(483): Xaa at position 483 is Cys, Ala, Val, Gly, Ser, or Thr
  SITE (485)..(485): Xaa at position 485 is Ala, Gly, or Pro
  SITE (487)..(487): Xaa at position 487 is Leu, Ala, Val, Gly, or Ile
MPGKMVVILGASNILWIMFAASQAFKIETTPESRYLXQIGDSXSXTXSTTGCESPFFSWRTQIDSPLNGKVTNEGTTSTXTXNPXSFGNEHSXLXTXTCESRKLEKGXQVEIYSXPKDPEIHLSGPLEAGKPXTXKXSXADXYPXDRLEXDXLKGDHLMKSQEFLEDADRKSLETKSXEVTFTPVIEDIGKVXVXRXKXHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAXQIGDSXMXTXSVMGCESPSFSWRTQIDSPLSGKVRSEGTNSTXTXSPXSFENEHSXLXTXTCGHKKLEKGXQVELYSXPRDPEIEMSGGLVNGSSXTXSXKXPSXYPXDRLEXEXLKGETILENIEFLEDTDMKSLENKSXEMTFIPTIEDTGKAXVXQXKXHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 372 - protein, 455 aa, Homo sapiens
  SITE (59)..(59): Xaa at position 59 is Cys, Ala, Val, Gly, Ser, or Thr
  SITE (62)..(62): Xaa at position 62 is Cys, Ala, Val, Gly, Ser, or Thr
  SITE (72)..(72): Xaa at position 72 is Cys, Ala, Val, Gly, Ser, or Thr
MGLSTVPDLLLPLVLLELLVGIYPSGVIGLVPHLGDREKRDSVCPQGKYIHPQNNSICXTKXHKGTYLYNDXPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 373 - protein, 564 aa, Influenza A virus
  strain A/Budgerigar/Hokkaido/1/1977 H4N6
  SITE (25)..(25): Xaa at position 25 is Ile, Ala, Val, Leu, or Gly
  SITE (26)..(26): Xaa at position 26 is Cys, Ala, Val, Gly, Ser, or Thr
  SITE (27)..(27): Xaa at position 27 is Met, Ile, Leu, Val, Ala, or Gly
  SITE (38)..(38): Xaa at position 38 is Val, Ala, Gly, Leu, or Ile
  SITE (48)..(48): Xaa at position 48 is Val, Ala, Gly, Leu, or Ile
  SITE (54)..(54): Xaa at position 54 is Leu, Ala, Val, Gly, or Ile
  SITE (55)..(55): Xaa at position 55 is Val, Ala, Gly, Leu, or Ile
  SITE (63)..(63): Xaa at position 63 is Leu, Ala, Val, Gly, or Ile
  SITE (64)..(64): Xaa at position 64 is Cys, Ala, Val, Gly, Ser, or Thr
  SITE (70)..(70): Xaa at position 70 is Leu, Ala, Val, Gly, or Ile
  SITE (76)..(76): Xaa at position 76 is Cys, Ala, Val, Gly, Ser, or Thr
  SITE (78)..(78): Xaa at position 78 is Ile, Ala, Val, Leu, or Gly
  SITE (79)..(79): Xaa at position 79 is Ile, Ala, Val, Leu, or Gly
  SITE (82)..(82): Xaa at position 82 is Ala, Gly, or Pro
  SITE (83)..(83): Xaa at position 83 is Leu, Ala, Val, Gly, or Ile
  SITE (88)..(88): Xaa at position 88 is Cys, Ala, Val, Gly, Ser, or Thr
  SITE (91)..(91): Xaa at position 91 is Leu, Ala, Val, Gly, or Ile
  SITE (98)..(98): Xaa at position 98 is Val, Ala, Gly, Leu, or Ile
  SITE (99)..(99): Xaa at position 99 is Phe, Tyr, Met, His, Ile, Leu, Val Ala, or Gly
  SITE (100)..(100): Xaa at position 100 is Ile, Ala, Val, Leu, or Gly
  SITE (106)..(106): Xaa at position 106 is Val, Ala, Gly, Leu, or Ile
  SITE (109)..(109): Xaa at position 109 is Cys, Ala, Val, Gly, Ser, or Thr
  SITE (110)..(110): Xaa at position 110 is Tyr, Phe, Met, His, Ile, Leu, Val Ala, or Gly
  SITE (112)..(112): Xaa at position 112 is Phe, Tyr, Met, His, Ile, Leu, Val Ala, or Gly
  SITE (117)..(117): Xaa at position 117 is Tyr, Phe, Met, His, Ile, Leu, Val Ala, or Gly
  SITE (120)..(120): Xaa at position 120 is Leu, Ala, Val, Gly, or Ile
  SITE (124)..(124): Xaa at position 124 is Leu, Ala, Val, Gly, or Ile
  SITE (125)..(125): Xaa at position 125 is Ala, Gly, or Pro
  SITE (130)..(130): Xaa at position 130 is Phe, Tyr, Met, His, Ile, Leu, Val Ala, or Gly
  SITE (137)..(137): Xaa at position 137 is Phe, Tyr, Met, His, Ile, Leu, Val Ala, or Gly
  SITE (150)..(150): Xaa at position 150 is Ala, Gly, or Pro
  SITE (151)..(151): Xaa at position 151 is Cys, Ala, Val, Gly, Ser, or Thr
  SITE (159)..(159): Xaa at position 159 is Phe, Tyr, Met, His, Ile, Leu, Val Ala, or Gly
  SITE (160)..(160): Xaa at position 160 is Phe, Tyr, Met, His, Ile, Leu, Val Ala, or Gly
  SITE (163)..(163): Xaa at position 163 is Leu, Ala, Val, Gly, or Ile
  SITE (166)..(166): Xaa at position 166 is Leu, Ala, Val, Gly, or Ile
  SITE (191)..(191): Xaa at position 191 is Tyr, Phe, Met, His, Ile, Leu, Val Ala, or Gly
  SITE (193)..(193): Xaa at position 193 is Trp, Tyr, Phe, Met, His, Ile, Leu Val, Ala, or Gly
  SITE (195)..(195): Xaa at position 195 is Val, Ala, Gly, Leu, or Ile
  SITE (196)..(196): Xaa at position 196 is His, Phe, Tyr, Lys, Arg, Gly, Ser Thr, Ala, Val, Leu, Ile, Asn, Met, or Gln
  SITE (197)..(197): Xaa at position 197 is His, Phe, Tyr, Lys, Arg, Gly, Ser Thr, Ala, Val, Leu, Ile, Asn, Met, or Gln
  SITE (208)..(208): Xaa at position 208 is Tyr, Phe, Met, His, Ile, Leu, Val Ala, or Gly
  SITE (215)..(215): Xaa at position 215 is Val, Ala, Gly, Leu, or Ile
  SITE (217)..(217): Xaa at position 217 is Val, Ala, Gly, Leu, or Ile
  SITE (243)..(243): Xaa at position 243 is Ile, Ala, Val, Leu, or Gly
  SITE (245)..(245): Xaa at position 245 is Phe, Tyr, Met, His, Ile, Leu, Val Ala, or Gly
  SITE (246)..(246): Xaa at position 246 is Tyr, Phe, Met, His, Ile, Leu, Val Ala, or Gly
  SITE (249)..(249): Xaa at position 249 is Ile, Ala, Val, Leu, or Gly
  SITE (250)..(250): Xaa at position 250 is Val, Ala, Gly, Leu, or Ile
  SITE (255)..(255): Xaa at position 255 is Leu, Ala, Val, Gly, or Ile
  SITE (256)..(256): Xaa at position 256 is Ile, Ala, Val, Leu, or Gly
  SITE (258)..(258): Xaa at position 258 is Phe, Tyr, Met, His, Ile, Leu, Val Ala, or Gly
  SITE (264)..(264): Xaa at position 264 is Leu, Ala, Val, Gly, or Ile
  SITE (265)..(265): Xaa at position 265 is Ile, Ala, Val, Leu, or Gly
  SITE (266)..(266): Xaa at position 266 is Ala, Gly, or Pro
  SITE (271)..(271): Xaa at position 271 is Tyr, Phe, Met, His, Ile, Leu, Val Ala, or Gly
  SITE (288)..(288): Xaa at position 288 is Ile, Ala, Val, Leu, or Gly
  SITE (295)..(295): Xaa at position 295 is Cys, Ala, Val, Gly, Ser, or Thr
  SITE (296)..(296): Xaa at position 296 is His, Phe, Tyr, Lys, Arg, Gly, Ser Thr, Ala, Val, Leu, Ile, Asn, Met, or Gln
  SITE (302)..(302): Xaa at position 302 is Val, Ala, Gly, Leu, or Ile
  SITE (323)..(323): Xaa at position 323 is Val, Ala, Gly, Leu, or Ile
  SITE (330)..(330): Xaa at position 330 is Leu, Ala, Val, Gly, or Ile
  SITE (331)..(331): Xaa at position 331 is Ala, Gly, or Pro
  SITE (348)..(348): Xaa at position 348 is Ala, Gly, or Pro
  SITE (357)..(357): Xaa at position 357 is Trp, Tyr, Phe, Met, His, Ile, Leu Val, Ala, or Gly
  SITE (365)..(365): Xaa at position 365 is Tyr, Phe, Met, His, Ile, Leu, Val Ala, or Gly
  SITE (387)..(387): Xaa at position 387 is Ala, Gly, or Pro
  SITE (439)..(439): Xaa at position 439 is Ala, Gly, or Pro
  SITE (461)..(461): Xaa at position 461 is Leu, Ala, Val, Gly, or Ile
  SITE (469)..(469): Xaa at position 469 is Leu, Ala, Val, Gly, or Ile
  SITE (480)..(480): Xaa at position 480 is Cys, Ala, Val, Gly, Ser, or Thr
  SITE (481)..(481): Xaa at position 481 is Phe, Tyr, Met, His, Ile, Leu, Val Ala, or Gly
  SITE (483)..(483): Xaa at position 483 is Ile, Ala, Val, Leu, or Gly
  SITE (485)..(485): Xaa at position 485 is His, Phe, Tyr, Lys, Arg, Gly, Ser Thr, Ala, Val, Leu, Ile, Asn, Met, or Gln
  SITE (487)..(487): Xaa at position 487 is Cys, Ala, Val, Gly, Ser, or Thr
  SITE (491)..(491): Xaa at position 491 is Cys, Ala, Val, Gly, Ser, or Thr
  SITE (492)..(492): Xaa at position 492 is Ile, Ala, Val, Leu, or Gly
  SITE (495)..(495): Xaa at position 495 is Ile, Ala, Val, Leu, or Gly
  SITE (509)..(509): Xaa at position 509 is Ala, Gly, or Pro
MLSVVILFLLVAENSSQSYTGNPVXXXGHHSVANGTMXKTLTDDQVEXVTAREXXESQTLPEXXPSPLRXVDGQTXDXXNGXXGSPGXDHXNGAEWDXXXERPNAXDTXXPXDVPDXQSXRSIXXNNGKXEFIAEEXQWNTVIQNGKSSXXKRANVNDXXNRXNWXVKSTGNAYPLQNLTKVNNGDYARLXIXGXXXPSTDTEQTNLXKNNPGRXTXSTKTSQTSVVPNIGSRPLVRGQSGRXSXXWTXXEPGDXXVXNTIGNXXXPRGHXKLNNQKKSTILNTPIPXGSCVSKXXTDKGSXSTTNPFQNISRIAIGECPKYXKQGSLKXXTGMRNVPEKASRGLFGXIAGFIENGXQGLIDGWXGFRHQNAEGTGTAADLKSTQAXIDKINGKLNRLIEKTNEKYHQIEKEFNKIEGRVQDLEKYVEDTKIDLWSYNXELLVALENQHTIDVTDSEMNKXFERVRRQXRENAEDQGNGXXEXFXKXDNNXXESXRNGTYDHDIYRDEXINNRFQIQGVKLIQGYKDIILWISFSISCFLLVALLLAFILWACQNGNIRCQICI

SEQ ID NO: 374 - protein, 968 aa, Homo sapiens
  SITE (57)..(57): Xaa at position 57 is Phe, Tyr, Met, His, Ile, Leu, Val Ala, or Gly
  SITE (69)..(69): Xaa at position 69 is Leu, Ala, Val, Gly, or Ile
  SITE (84)..(84): Xaa at position 84 is Val, Ala, Gly, Leu, or Ile
  SITE (93)..(93): Xaa at position 93 is Ala, Gly, or Pro
  SITE (95)..(95): Xaa at position 95 is Val, Ala, Gly, Leu, or Ile
  SITE (96)..(96): Xaa at position 96 is Ile, Ala, Val, Leu, or Gly
  SITE (97)..(97): Xaa at position 97 is Val, Ala, Gly, Leu, or Ile
  SITE (99)..(99): Xaa at position 99 is Leu, Ala, Val, Gly, or Ile
  SITE (100)..(100): Xaa at position 100 is Val, Ala, Gly, Leu, or Ile
  SITE (109)..(109): Xaa at position 109 is His, Phe, Tyr, Lys, Arg, Gly, Ser Thr, Ala, Val, Leu, Ile, Asn, Met, or Gln
  SITE (110)..(110): Xaa at position 110 is Ala, Gly, or Pro
  SITE (111)..(111): Xaa at position 111 is His, Phe, Tyr, Lys, Arg, Gly, Ser Thr, Ala, Val, Leu, Ile, Asn, Met, or Gln
  SITE (113)..(113): Xaa at position 113 is Leu, Ala, Val, Gly, or Ile
  SITE (122)..(122): Xaa at position 122 is Ile, Ala, Val, Leu, or Gly
  SITE (123)..(123): Xaa at position 123 is Cys, Ala, Val, Gly, Ser, or Thr
  SITE (127)..(127): Xaa at position 127 is Ala, Gly, or Pro
  SITE (133)..(133): Xaa at position 133 is Val, Ala, Gly, Leu, or Ile
  SITE (134)..(134): Xaa at position 134 is Val, Ala, Gly, Leu, or Ile
  SITE (139)..(139): Xaa at position 139 is Leu, Ala, Val, Gly, or Ile
  SITE (153)..(153): Xaa at position 153 is Leu, Ala, Val, Gly, or Ile
  SITE (157)..(157): Xaa at position 157 is Met, Ile, Leu, Val, Ala, or Gly
  SITE (160)..(160): Xaa at position 160 is Ala, Gly, or Pro
  SITE (161)..(161): Xaa at position 161 is Cys, Ala, Val, Gly, Ser, or Thr
  SITE (170)..(170): Xaa at position 170 is Leu, Ala, Val, Gly, or Ile
  SITE (175)..(175): Xaa at position 175 is Leu, Ala, Val, Gly, or Ile
  SITE (196)..(196): Xaa at position 196 is Ile, Ala, Val, Leu, or Gly
  SITE (199)..(199): Xaa at position 199 is Ala, Gly, or Pro
  SITE (200)..(200): Xaa at position 200 is Ala, Gly, or Pro
  SITE (212)..(212): Xaa at position 212 is Val, Ala, Gly, Leu, or Ile
  SITE (214)..(214): Xaa at position 214 is Leu, Ala, Val, Gly, or Ile
  SITE (216)..(216): Xaa at position 216 is Phe, Tyr, Met, His, Ile, Leu, Val Ala, or Gly
  SITE (218)..(218): Xaa at position 218 is Ala, Gly, or Pro
  SITE (238)..(238): Xaa at position 238 is Ala, Gly, or Pro
  SITE (239)..(239): Xaa at position 239 is Ile, Ala, Val, Leu, or Gly
  SITE (247)..(247): Xaa at position 247 is Ala, Gly, or Pro
  SITE (250)..(250): Xaa at position 250 is Leu, Ala, Val, Gly, or Ile
  SITE (262)..(262): Xaa at position 262 is Val, Ala, Gly, Leu, or Ile
  SITE (268)..(268): Xaa at position 268 is Ile, Ala, Val, Leu, or Gly
  SITE (270)..(270): Xaa at position 270 is Leu, Ala, Val, Gly, or Ile
  SITE (271)..(271): Xaa at position 271 is Leu, Ala, Val, Gly, or Ile
  SITE (282)..(282): Xaa at position 282 is Ile, Ala, Val, Leu, or Gly
  SITE (284)..(284): Xaa at position 284 is Phe, Tyr, Met, His, Ile, Leu, Val Ala, or Gly
  SITE (311)..(311): Xaa at position 311 is Ile, Ala, Val, Leu, or Gly
  SITE (312)..(312): Xaa at position 312 is Val, Ala, Gly, Leu, or Ile
  SITE (313)..(313): Xaa at position 313 is Phe, Tyr, Met, His, Ile, Leu, Val Ala, or Gly
  SITE (329)..(329): Xaa at position 329 is Val, Ala, Gly, Leu, or Ile
  SITE (331)..(331): Xaa at position 331 is Val, Ala, Gly, Leu, or Ile
  SITE (333)..(333): Xaa at position 333 is Leu, Ala, Val, Gly, or Ile
  SITE (347)..(347): Xaa at position 347 is Phe, Tyr, Met, His, Ile, Leu, Val Ala, or Gly
  SITE (349)..(349): Xaa at position 349 is Tyr, Phe, Met, His, Ile, Leu, Val Ala, or Gly
  SITE (350)..(350): Xaa at position 350 is Tyr, Phe, Met, His, Ile, Leu, Val Ala, or Gly
  SITE (808)..(808): Xaa at position 808 is Met, Ile, Leu, Val, Ala, or Gly
  SITE (819)..(819): Xaa at position 819 is Leu, Ala, Val, Gly, or Ile
  SITE (820)..(820): Xaa at position 820 is Tyr, Phe, Met, His, Ile, Leu, Val Ala, or Gly
  SITE (823)..(823): Xaa at position 823 is Leu, Ala, Val, Gly, or Ile
  SITE (835)..(835): Xaa at position 835 is Leu, Ala, Val, Gly, or Ile
  SITE (836)..(836): Xaa at position 836 is Ala, Gly, or Pro
  SITE (848)..(848): Xaa at position 848 is Phe, Tyr, Met, His, Ile, Leu, Val Ala, or Gly
  SITE (858)..(858): Xaa at position 858 is Leu, Ala, Val, Gly, or Ile
  SITE (859)..(859): Xaa at position 859 is Met, Ile, Leu, Val, Ala, or Gly
  SITE (872)..(872): Xaa at position 872 is Leu, Ala, Val, Gly, or Ile
  SITE (875)..(875): Xaa at position 875 is Ala, Gly, or Pro
  SITE (876)..(876): Xaa at position 876 is Leu, Ala, Val, Gly, or Ile
  SITE (884)..(884): Xaa at position 884 is Ala, Gly, or Pro
  SITE (888)..(888): Xaa at position 888 is Ile, Ala, Val, Leu, or Gly
MAEDDPYLGRPEQMFHLDPSLTHTIFNPEVFQPQMALPTDGPYLQILEQPKQRGFRXRYVCEGPSHGGXPGASSEKNKKSYPQXKICNYVGPXKXXXQXXTNGKNIHLXXXSXVGKHCEDGXXTVTXGPKDMXXGFANXGILHVTKKKVFETXEARXTEXXIRGYNPGLXVHPDXAYLQAEGGGDRQLGDREKELXRQXXLQQTKEMDLSVXRXMXTXFLPDSTGSFTRRLEPVVSDXXYDSKAPNXSNXKIVRMDRTAGCXTGGEEXYXXCDKVQKDDIQXRXYEEEENGGVWEGFGDFSPTDVHRQFAXXXKTPKYKDINITKPASXFXQXRRKSDLETSEPKPXLXXPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDXKQLAEDVKLQXXKLXEIPDPDKNWATXXQKLGLGILNNAXRLSPAPSKTXXDNYEVSGGTVREXVEXXRQMGYTEXIEVXQAASSPVKTTSQAHSLPLSPASTRQQIDELRDSDSVCDSGVETSFRKLSFTESLTSGASLLTLNKMPHDYGQEGPLEGKI

SEQ ID NO: 375 - protein, 107 aa, Homo sapiens
  SITE (45)..(45): Xaa at position 45 is Cys, Ala, Val, Gly, Ser, or Thr
  SITE (52)..(52): Xaa at position 52 is Ile, Ala, Val, Leu, or Gly
  SITE (69)..(69): Xaa at position 69 is Cys, Ala, Val, Gly, Ser, or Thr
  SITE (74)..(74): Xaa at position 74 is Val, Ala, Gly, Leu, or Ile
  SITE (76)..(76): Xaa at position 76 is Ala, Gly, or Pro
  SITE (78)..(78): Xaa at position 78 is Leu, Ala, Val, Gly, or Ile
  SITE (85)..(85): Xaa at position 85 is Cys, Ala, Val, Gly, Ser, or Thr
  SITE (86)..(86): Xaa at position 86 is Leu, Ala, Val, Gly, or Ile
  SITE (93)..(93): Xaa at position 93 is Val, Ala, Gly, Leu, or Ile
  SITE (96)..(96): Xaa at position 96 is Ile, Ala, Val, Leu, or Gly
  SITE (101)..(101): Xaa at position 101 is Leu, Ala, Val, Gly, or Ile
MAHATLSAAPSNPRLLRVALLLLLLVAASRRAAGASVVTELRCQXLQTLQGXHLKNIQSVNVRSPGPHXAQTEXIXTXKNGKKAXXNPASPMXQKXIEKIXNKGSTN

SEQ ID NO: 376 - protein, 1033 aa, Homo sapiens
  SITE (47)..(47): Xaa at position 47 is Ile, Ala, Val, Leu, or Gly
  SITE (58)..(58): Xaa at position 58 is Ile, Ala, Val, Leu, or Gly
  SITE (63)..(63): Xaa at position 63 is Leu, Ala, Val, Gly, or Ile
  SITE (65)..(65): Xaa at position 65 is Cys, Ala, Val, Gly, Ser, or Thr
  SITE (96)..(96): Xaa at position 96 is Val, Ala, Gly, Leu, or Ile
  SITE (108)..(108): Xaa at position 108 is Tyr, Phe, Met, His, Ile, Leu, Val Ala, or Gly
  SITE (114)..(114): Xaa at position 114 is Val, Ala, Gly, Leu, or Ile
  SITE (130)..(130): Xaa at position 130 is Val, Ala, Gly, Leu, or Ile
  SITE (132)..(132): Xaa at position 132 is Cys, Ala, Val, Gly, Ser, or Thr
MGAAGLLGVFLALVAPGVLGISCGSPPPILNGRISYYSTPIAVGTVXRYSCSGTFRLXGEKSXLXITKDKVDGTWDKPAPKCEYFNKYSSCPEPIXPGGYKIRGSTPXRHGDSXTFACKTNFSMNGNKSXWXQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 377 - protein, 260 aa, Homo sapiens
  SITE (54)..(54): Xaa at position 54 is Met, Ile, Leu, Val, Ala, or Gly
  SITE (55)..(55): Xaa at position 55 is Phe, Tyr, Met, His, Ile, Leu, Val Ala, or Gly
  SITE (63)..(63): Xaa at position 63 is Phe, Tyr, Met, His, Ile, Leu, Val Ala, or Gly
  SITE (65)..(65): Xaa at position 65 is Val, Ala, Gly, Leu, or Ile
  SITE (83)..(83): Xaa at position 83 is Phe, Tyr, Met, His, Ile, Leu, Val Ala, or Gly
  SITE (87)..(87): Xaa at position 87 is Ala, Gly, or Pro
  SITE (92)..(92): Xaa at position 92 is Ala, Gly, or Pro
  SITE (94)..(94): Xaa at position 94 is Ile, Ala, Val, Leu, or Gly
  SITE (136)..(136): Xaa at position 136 is Leu, Ala, Val, Gly, or Ile
  SITE (137)..(137): Xaa at position 137 is Ile, Ala, Val, Leu, or Gly
  SITE (138)..(138): Xaa at position 138 is Cys, Ala, Val, Gly, Ser, or Thr
  SITE (140)..(140): Xaa at position 140 is Ile, Ala, Val, Leu, or Gly
  SITE (143)..(143): Xaa at position 143 is Phe, Tyr, Met, His, Ile, Leu, Val Ala, or Gly
  SITE (152)..(152): Xaa at position 152 is Trp, Tyr, Phe, Met, His, Ile, Leu Val, Ala, or Gly
  SITE (179)..(179): Xaa at position 179 is Phe, Tyr, Met, His, Ile, Leu, Val Ala, or Gly
  SITE (182)..(182): Xaa at position 182 is Leu, Ala, Val, Gly, or Ile
  SITE (185)..(185): Xaa at position 185 is Val, Ala, Gly, Leu, or Ile
  SITE (192)..(192): Xaa at position 192 is Tyr, Phe, Met, His, Ile, Leu, Val Ala, or Gly
  SITE (194)..(194): Xaa at position 194 is Cys, Ala, Val, Gly, Ser, or Thr
  SITE (196)..(196): Xaa at position 196 is Val, Ala, Gly, Leu, or Ile
  SITE (198)..(198): Xaa at position 198 is His, Phe, Tyr, Lys, Arg, Gly, Ser Thr, Ala, Val, Leu, Ile, Asn, Met, or Gln
MRPEDRMFHIRAVILRALSLAFLLSLRGAGAIKADHVSTYAAFVQTHRPTGEFXXEFDEDEMXYXDLDKKETVWHLEEFGQAXSFEXQGGLXNXAILNNNLNTLIQRSNHTQATNDPPEVTVFPKEPVELGQPNTXXXHXDKXFPPVLNVTXLCNGELVTEGVAESLFLPRTDYSFHKXHYXTFXPSAEDFXDXRXEXWGLDQPLLKHWEAQEPIQMPETTETVLCALGLVLGLVGIIVGTVLIIKSLRSGHDPRAQGTL

SEQ ID NO: 378 - protein, 364 aa, Homo sapiens
  SITE (82)..(82): Xaa at position 82 is Val, Ala, Gly, Leu, or Ile
MPLLLLLPLLWAGALAMDPNFWLQVQESVTVQEGLCVLVPCTFFHPIPYYDKNSPVHGYWFREGAIISRDSPVATNKLDQEXQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 379 - protein, 261 aa, Homo sapiens
  SITE (25)..(25): Xaa at position 25 is Ile, Ala, Val, Leu, or Gly
  SITE (31)..(31): Xaa at position 31 is Cys, Ala, Val, Gly, Ser, or Thr
  SITE (40)..(40): Xaa at position 40 is Val, Ala, Gly, Leu, or Ile
  SITE (41)..(41): Xaa at position 41 is Ala, Gly, or Pro
  SITE (53)..(53): Xaa at position 53 is Val, Ala, Gly, Leu, or Ile
  SITE (54)..(54): Xaa at position 54 is Leu, Ala, Val, Gly, or Ile
  SITE (55)..(55): Xaa at position 55 is Val, Ala, Gly, Leu, or Ile
  SITE (60)..(60): Xaa at position 60 is Val, Ala, Gly, Leu, or Ile
  SITE (61)..(61): Xaa at position 61 is Leu, Ala, Val, Gly, or Ile
  SITE (63)..(63): Xaa at position 63 is Ala, Gly, or Pro
  SITE (64)..(64): Xaa at position 64 is Ala, Gly, or Pro
  SITE (66)..(66): Xaa at position 66 is Cys, Ala, Val, Gly, Ser, or Thr
  SITE (73)..(73): Xaa at position 73 is Val, Ala, Gly, Leu, or Ile
  SITE (75)..(75): Xaa at position 75 is Leu, Ala, Val, Gly, or Ile
  SITE (90)..(90): Xaa at position 90 is Val, Ala, Gly, Leu, or Ile
  SITE (92)..(92): Xaa at position 92 is Val, Ala, Gly, Leu, or Ile
  SITE (121)..(121): Xaa at position 121 is Leu, Ala, Val, Gly, or Ile
  SITE (123)..(123): Xaa at position 123 is Leu, Ala, Val, Gly, or Ile
  SITE (124)..(124): Xaa at position 124 is Leu, Ala, Val, Gly, or Ile
  SITE (126)..(126): Xaa at position 126 is Leu, Ala, Val, Gly, or Ile
  SITE (132)..(132): Xaa at position 132 is Ile, Ala, Val, Leu, or Gly
  SITE (135)..(135): Xaa at position 135 is Val, Ala, Gly, Leu, or Ile
  SITE (136)..(136): Xaa at position 136 is Val, Ala, Gly, Leu, or Ile
  SITE (152)..(152): Xaa at position 152 is Cys, Ala, Val, Gly, Ser, or Thr
  SITE (154)..(154): Xaa at position 154 is Ala, Gly, or Pro
  SITE (165)..(165): Xaa at position 165 is Phe, Tyr, Met, His, Ile, Leu, Val Ala, or Gly
  SITE (173)..(173): Xaa at position 173 is Cys, Ala, Val, Gly, Ser, or Thr
  SITE (174)..(174): Xaa at position 174 is Val, Ala, Gly, Leu, or Ile
  SITE (176)..(176): Xaa at position 176 is Leu, Ala, Val, Gly, or Ile
  SITE (184)..(184): Xaa at position 184 is Cys, Ala, Val, Gly, Ser, or Thr
  SITE (198)..(198): Xaa at position 198 is Cys, Ala, Val, Gly, Ser, or Thr
  SITE (199)..(199): Xaa at position 199 is Ala, Gly, or Pro
  SITE (217)..(217): Xaa at position 217 is Leu, Ala, Val, Gly, or Ile
  SITE (219)..(219): Xaa at position 219 is Cys, Ala, Val, Gly, Ser, or Thr
  SITE (223)..(223): Xaa at position 223 is Leu, Ala, Val, Gly, or Ile
  SITE (226)..(226): Xaa at position 226 is Ile, Ala, Val, Leu, or Gly
  SITE (241)..(241): Xaa at position 241 is Ala, Gly, or Pro
  SITE (242)..(242): Xaa at position 242 is Val, Ala, Gly, Leu, or Ile
  SITE (243)..(243): Xaa at position 243 is Tyr, Phe, Met, His, Ile, Leu, Val Ala, or Gly
  SITE (246)..(246): Xaa at position 246 is Val, Ala, Gly, Leu, or Ile
  SITE (253)..(253): Xaa at position 253 is Ile, Ala, Val, Leu, or Gly
MWDLVLSIALSVGCTGAVPLIQSRXVGGWEXEKHSQPWQXXVYSHGWAHCGGXXXHPQWXXTXXHXLKKNSQXWXGRHNLFEPEDTGQRXPXSHSFPHPLYNMSLLKHQSLRPDEDSSHDXMXXRXSEPAKXTDXXKVLGLPTQEPALGTTXYXSGWGSIEPEEXLRPRSLQXXSXHLLSNDMXARAYSEKVTEFMLXXGLWTGGKDTCGGDSGGPXVXNGVXQGXTSWGPEPCALPEKPXXXTKXVHYRKWXKDTIAANP

SEQ ID NO: 380 - protein, 847 aa, Homo sapiens
  SITE (24)..(24): Xaa at position 24 is Trp, Tyr, Phe, Met, His, Ile, Leu Val, Ala, or Gly
  SITE (35)..(35): Xaa at position 35 is Trp, Tyr, Phe, Met, His, Ile, Leu Val, Ala, or Gly
  SITE (39)..(39): Xaa at position 39 is Cys, Ala, Val, Gly, Ser, or Thr
  SITE (40)..(40): Xaa at position 40 is Val, Ala, Gly, Leu, or Ile
  SITE (42)..(42): Xaa at position 42 is Ile, Ala, Val, Leu, or Gly
  SITE (44)..(44): Xaa at position 44 is Cys, Ala, Val, Gly, Ser, or Thr
  SITE (53)..(53): Xaa at position 53 is Leu, Ala, Val, Gly, or Ile
  SITE (76)..(76): Xaa at position 76 is Leu, Ala, Val, Gly, or Ile
  SITE (94)..(94): Xaa at position 94 is Phe, Tyr, Met, His, Ile, Leu, Val Ala, or Gly
  SITE (95)..(95): Xaa at position 95 is Leu, Ala, Val, Gly, or Ile
  SITE (102)..(102): Xaa at position 102 is Cys, Ala, Val, Gly, Ser, or Thr
  SITE (117)..(117): Xaa at position 117 is Leu, Ala, Val, Gly, or Ile
  SITE (119)..(119): Xaa at position 119 is Leu, Ala, Val, Gly, or Ile
  SITE (128)..(128): Xaa at position 128 is Trp, Tyr, Phe, Met, His, Ile, Leu Val, Ala, or Gly
  SITE (129)..(129): Xaa at position 129 is Met, Ile, Leu, Val, Ala, or Gly
  SITE (134)..(134): Xaa at position 134 is Leu, Ala, Val, Gly, or Ile
  SITE (136)..(136): Xaa at position 136 is Val, Ala, Gly, Leu, or Ile
  SITE (145)..(145): Xaa at position 145 is Ile, Ala, Val, Leu, or Gly
  SITE (161)..(161): Xaa at position 161 is Cys, Ala, Val, Gly, Ser, or Thr
  SITE (167)..(167): Xaa at position 167 is Cys, Ala, Val, Gly, Ser, or Thr
  SITE (170)..(170): Xaa at position 170 is Tyr, Phe, Met, His, Ile, Leu, Val Ala, or Gly
  SITE (172)..(172): Xaa at position 172 is Ile, Ala, Val, Leu, or Gly
  SITE (176)..(176): Xaa at position 176 is Trp, Tyr, Phe, Met, His, Ile, Leu Val, Ala, or Gly
  SITE (198)..(198): Xaa at position 198 is Val, Ala, Gly, Leu, or Ile
  SITE (204)..(204): Xaa at position 204 is Leu, Ala, Val, Gly, or Ile
  SITE (206)..(206): Xaa at position 206 is Phe, Tyr, Met, His, Ile, Leu, Val Ala, or Gly
  SITE (210)..(210): Xaa at position 210 is Trp, Tyr, Phe, Met, His, Ile, Leu Val, Ala, or Gly
  SITE (219)..(219): Xaa at position 219 is Cys, Ala, Val, Gly, Ser, or Thr
  SITE (229)..(229): Xaa at position 229 is Leu, Ala, Val, Gly, or Ile
  SITE (236)..(236): Xaa at position 236 is Leu, Ala, Val, Gly, or Ile
  SITE (238)..(238): Xaa at position 238 is Val, Ala, Gly, Leu, or Ile
  SITE (255)..(255): Xaa at position 255 is Val, Ala, Gly, Leu, or Ile
  SITE (265)..(265): Xaa at position 265 is Cys, Ala, Val, Gly, Ser, or Thr
  SITE (279)..(279): Xaa at position 279 is Trp, Tyr, Phe, Met, His, Ile, Leu Val, Ala, or Gly
  SITE (294)..(294): Xaa at position 294 is Leu, Ala, Val, Gly, or Ile
  SITE (296)..(296): Xaa at position 296 is Leu, Ala, Val, Gly, or Ile
  SITE (307)..(307): Xaa at position 307 is Tyr, Phe, Met, His, Ile, Leu, Val Ala, or Gly
  SITE (309)..(309): Xaa at position 309 is Cys, Ala, Val, Gly, Ser, or Thr
  SITE (325)..(325): Xaa at position 325 is Leu, Ala, Val, Gly, or Ile
  SITE (327)..(327): Xaa at position 327 is Val, Ala, Gly, Leu, or Ile
  SITE (329)..(329): Xaa at position 329 is Tyr, Phe, Met, His, Ile, Leu, Val Ala, or Gly
  SITE (349)..(349): Xaa at position 349 is Val, Ala, Gly, Leu, or Ile
  SITE (353)..(353): Xaa at position 353 is Cys, Ala, Val, Gly, Ser, or Thr
  SITE (357)..(357): Xaa at position 357 is Ala, Gly, or Pro
  SITE (366)..(366): Xaa at position 366 is Trp, Tyr, Phe, Met, His, Ile, Leu Val, Ala, or Gly
  SITE (394)..(394): Xaa at position 394 is Tyr, Phe, Met, His, Ile, Leu, Val Ala, or Gly
  SITE (396)..(396): Xaa at position 396 is Cys, Ala, Val, Gly, Ser, or Thr
  SITE (413)..(413): Xaa at position 413 is Leu, Ala, Val, Gly, or Ile
  SITE (415)..(415): Xaa at position 415 is Val, Ala, Gly, Leu, or Ile
  SITE (422)..(422): Xaa at position 422 is Val, Ala, Gly, Leu, or Ile
  SITE (426)..(426): Xaa at position 426 is Ile, Ala, Val, Leu, or Gly
  SITE (432)..(432): Xaa at position 432 is Ile, Ala, Val, Leu, or Gly
  SITE (438)..(438): Xaa at position 438 is Val, Ala, Gly, Leu, or Ile
  SITE (440)..(440): Xaa at position 440 is Leu, Ala, Val, Gly, or Ile
  SITE (442)..(442): Xaa at position 442 is Cys, Ala, Val, Gly, Ser, or Thr
  SITE (451)..(451): Xaa at position 451 is Val, Ala, Gly, Leu, or Ile
  SITE (456)..(456): Xaa at position 456 is Trp, Tyr, Phe, Met, His, Ile, Leu Val, Ala, or Gly
  SITE (470)..(470): Xaa at position 470 is Leu, Ala, Val, Gly, or Ile
  SITE (472)..(472): Xaa at position 472 is Ile, Ala, Val, Leu, or Gly
  SITE (475)..(475): Xaa at position 475 is Val, Ala, Gly, Leu, or Ile
  SITE (477)..(477): Xaa at position 477 is Trp, Tyr, Phe, Met, His, Ile, Leu Val, Ala, or Gly
  SITE (484)..(484): Xaa at position 484 is Cys, Ala, Val, Gly, Ser, or Thr
  SITE (486)..(486): Xaa at position 486 is Ala, Gly, or Pro
  SITE (491)..(491): Xaa at position 491 is Cys, Ala, Val, Gly, Ser, or Thr
  SITE (499)..(499): Xaa at position 499 is Leu, Ala, Val, Gly, or Ile
  SITE (501)..(501): Xaa at position 501 is Val, Ala, Gly, Leu, or Ile
  SITE (503)..(503): Xaa at position 503 is Tyr, Phe, Met, His, Ile, Leu, Val Ala, or Gly
  SITE (504)..(504): Xaa at position 504 is Ala, Gly, or Pro
  SITE (508)..(508): Xaa at position 508 is Val, Ala, Gly, Leu, or Ile
  SITE (510)..(510): Xaa at position 510 is Val, Ala, Gly, Leu, or Ile
  SITE (527)..(527): Xaa at position 527 is Leu, Ala, Val, Gly, or Ile
  SITE (529)..(529): Xaa at position 529 is Cys, Ala, Val, Gly, Ser, or Thr
  SITE (539)..(539): Xaa at position 539 is Val, Ala, Gly, Leu, or Ile
  SITE (543)..(543): Xaa at position 543 is Trp, Tyr, Phe, Met, His, Ile, Leu Val, Ala, or Gly
  SITE (556)..(556): Xaa at position 556 is Leu, Ala, Val, Gly, or Ile
  SITE (561)..(561): Xaa at position 561 is Ile, Ala, Val, Leu, or Gly
  SITE (569)..(569): Xaa at position 569 is Tyr, Phe, Met, His, Ile, Leu, Val Ala, or Gly
  SITE (571)..(571): Xaa at position 571 is Cys, Ala, Val, Gly, Ser, or Thr
  SITE (577)..(577): Xaa at position 577 is Ile, Ala, Val, Leu, or Gly
  SITE (589)..(589): Xaa at position 589 is Val, Ala, Gly, Leu, or Ile
  SITE (591)..(591): Xaa at position 591 is Tyr, Phe, Met, His, Ile, Leu, Val Ala, or Gly
  SITE (596)..(596): Xaa at position 596 is Leu, Ala, Val, Gly, or Ile
  SITE (598)..(598): Xaa at position 598 is Val, Ala, Gly, Leu, or Ile
  SITE (606)..(606): Xaa at position 606 is Val, Ala, Gly, Leu, or Ile
  SITE (614)..(614): Xaa at position 614 is Leu, Ala, Val, Gly, or Ile
  SITE (616)..(616): Xaa at position 616 is Cys, Ala, Val, Gly, Ser, or Thr
  SITE (620)..(620): Xaa at position 620 is Ala, Gly, or Pro
  SITE (627)..(627): Xaa at position 627 is Tyr, Phe, Met, His, Ile, Leu, Val Ala, or Gly
  SITE (629)..(629): Xaa at position 629 is Trp, Tyr, Phe, Met, His, Ile, Leu Val, Ala, or Gly
  SITE (630)..(630): Xaa at position 630 is Phe, Tyr, Met, His, Ile, Leu, Val Ala, or Gly
  SITE (644)..(644): Xaa at position 644 is Leu, Ala, Val, Gly, or Ile
  SITE (646)..(646): Xaa at position 646 is Leu, Ala, Val, Gly, or Ile
  SITE (657)..(657): Xaa at position 657 is Tyr, Phe, Met, His, Ile, Leu, Val Ala, or Gly
  SITE (659)..(659): Xaa at position 659 is Cys, Ala, Val, Gly, Ser, or Thr
  SITE (677)..(677): Xaa at position 677 is Val, Ala, Gly, Leu, or Ile
  SITE (678)..(678): Xaa at position 678 is Tyr, Phe, Met, His, Ile, Leu, Val Ala, or Gly
  SITE (679)..(679): Xaa at position 679 is Tyr, Phe, Met, His, Ile, Leu, Val Ala, or Gly
  SITE (684)..(684): Xaa at position 684 is Ile, Ala, Val, Leu, or Gly
MHLLGPWLLLLVLEYLAFSDSSKXVFEHPETLYAXEGAXXWXPXTYRALDGDXESFILFHNPEYNKNTSKFDGTRXYESTKDGKVPSEQKRVQXXGDKNKNXTLSIHPVHLNDSGQXGXRMESKTEKXXERIHXNXSERPFPPHXQLPPEIQESQEVTLTXLLNFSXYGXPXQLQXLLEGVPMRQAAVTSTSLTIKSXFTRSEXKXSPQXSHHGKIVTXQLQDADGKFXSNDTVQXNXKHTPKLEIKVTPSDAIXREGDSVTMTXEVSSSNPEYTTVSXLKDGTSLKKQNTFTXNXREVTKDQSGKXCXQVSNDVGPGRSEEVFXQXQXAPEPSTVQILHSPAVEGSQXEFLXMSLXNPLPTNYTXYHNGKEMQGRTEEKVHIPKILPWHAGTXSXVAENILGTGQRGPGAEXDXQYPPKKXTTVXQNPMPXREGDTXTXSXNYNSSNPSXTRYEXKPHGAWEEPSLGVXKXQNXGXDNTTIAXAXCNSWXSWASPVAXNXQXXPRDXRXRKIKPLSEIHSGNSVSXQXDFSSSHPKEXQFFXEKNGRLLGKESQXNFDSXSPEDAGSXSXWVNNSXGQTASKAWTLEXLXAPRRXRXSMSPGDQXMEGKSATXTXESDXNPPVSHXTXXDWNNQSLPYHSQKXRXEPVKVQHSGAXWXQGTNSVGKGRSPLSTLTXXXSPETXGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 381 - protein, 1170 aa, Homo sapiens
  SITE (45)..(45): Xaa at position 45 is Phe, Tyr, Met, His, Ile, Leu, Val Ala, or Gly
  SITE (57)..(57): Xaa at position 57 is Ile, Ala, Val, Leu, or Gly
  SITE (58)..(58): Xaa at position 58 is Val, Ala, Gly, Leu, or Ile
  SITE (70)..(70): Xaa at position 70 is Leu, Ala, Val, Gly, or Ile
  SITE (73)..(73): Xaa at position 73 is Cys, Ala, Val, Gly, Ser, or Thr
  SITE (109)..(109): Xaa at position 109 is Leu, Ala, Val, Gly, or Ile
  SITE (110)..(110): Xaa at position 110 is Ala, Gly, or Pro
  SITE (111)..(111): Xaa at position 111 is Cys, Ala, Val, Gly, Ser, or Thr
  SITE (119)..(119): Xaa at position 119 is Cys, Ala, Val, Gly, Ser, or Thr
  SITE (129)..(129): Xaa at position 129 is Cys, Ala, Val, Gly, Ser, or Thr
  SITE (130)..(130): Xaa at position 130 is Tyr, Phe, Met, His, Ile, Leu, Val Ala, or Gly
  SITE (155)..(155): Xaa at position 155 is Val, Ala, Gly, Leu, or Ile
  SITE (157)..(157): Xaa at position 157 is Leu, Ala, Val, Gly, or Ile
  SITE (158)..(158): Xaa at position 158 is Val, Ala, Gly, Leu, or Ile
  SITE (159)..(159): Xaa at position 159 is Phe, Tyr, Met, His, Ile, Leu, Val Ala, or Gly
  SITE (160)..(160): Xaa at position 160 is Leu, Ala, Val, Gly, or Ile
  SITE (161)..(161): Xaa at position 161 is Phe, Tyr, Met, His, Ile, Leu, Val Ala, or Gly
  SITE (167)..(167): Xaa at position 167 is Leu, Ala, Val, Gly, or Ile
  SITE (175)..(175): Xaa at position 175 is Ile, Ala, Val, Leu, or Gly
  SITE (178)..(178): Xaa at position 178 is Phe, Tyr, Met, His, Ile, Leu, Val Ala, or Gly
  SITE (179)..(179): Xaa at position 179 is Met, Ile, Leu, Val, Ala, or Gly
  SITE (182)..(182): Xaa at position 182 is Val, Ala, Gly, Leu, or Ile
  SITE (183)..(183): Xaa at position 183 is Met, Ile, Leu, Val, Ala, or Gly
  SITE (186)..(186): Xaa at position 186 is Leu, Ala, Val, Gly, or Ile
  SITE (191)..(191): Xaa at position 191 is Tyr, Phe, Met, His, Ile, Leu, Val Ala, or Gly
  SITE (193)..(193): Xaa at position 193 is Phe, Tyr, Met, His, Ile, Leu, Val Ala, or Gly
  SITE (194)..(194): Xaa at position 194 is Ala, Gly, or Pro
  SITE (195)..(195): Xaa at position 195 is Ala, Gly, or Pro
  SITE (196)..(196): Xaa at position 196 is Val, Ala, Gly, Leu, or Ile
  SITE (198)..(198): Xaa at position 198 is Phe, Tyr, Met, His, Ile, Leu, Val Ala, or Gly
  SITE (206)..(206): Xaa at position 206 is Phe, Tyr, Met, His, Ile, Leu, Val Ala, or Gly
  SITE (208)..(208): Xaa at position 208 is Phe, Tyr, Met, His, Ile, Leu, Val Ala, or Gly
  SITE (211)..(211): Xaa at position 211 is Tyr, Phe, Met, His, Ile, Leu, Val Ala, or Gly
  SITE (236)..(236): Xaa at position 236 is Ala, Gly, or Pro
  SITE (237)..(237): Xaa at position 237 is Ile, Ala, Val, Leu, or Gly
  SITE (240)..(240): Xaa at position 240 is Val, Ala, Gly, Leu, or Ile
  SITE (244)..(244): Xaa at position 244 is Val, Ala, Gly, Leu, or Ile
  SITE (258)..(258): Xaa at position 258 is Val, Ala, Gly, Leu, or Ile
  SITE (259)..(259): Xaa at position 259 is Leu, Ala, Val, Gly, or Ile
  SITE (260)..(260): Xaa at position 260 is Ile, Ala, Val, Leu, or Gly
  SITE (261)..(261): Xaa at position 261 is Ile, Ala, Val, Leu, or Gly
  SITE (262)..(262): Xaa at position 262 is Ile, Ala, Val, Leu, or Gly
  SITE (273)..(273): Xaa at position 273 is Ile, Ala, Val, Leu, or Gly
  SITE (276)..(276): Xaa at position 276 is Ala, Gly, or Pro
  SITE (279)..(279): Xaa at position 279 is Ile, Ala, Val, Leu, or Gly
  SITE (282)..(282): Xaa at position 282 is Tyr, Phe, Met, His, Ile, Leu, Val Ala, or Gly
  SITE (283)..(283): Xaa at position 283 is Ile, Ala, Val, Leu, or Gly
  SITE (284)..(284): Xaa at position 284 is Ile, Ala, Val, Leu, or Gly
  SITE (286)..(286): Xaa at position 286 is Ile, Ala, Val, Leu, or Gly
  SITE (290)..(290): Xaa at position 290 is Phe, Tyr, Met, His, Ile, Leu, Val Ala, or Gly
  SITE (299)..(299): Xaa at position 299 is Leu, Ala, Val, Gly, or Ile
  SITE (302)..(302): Xaa at position 302 is Phe, Tyr, Met, His, Ile, Leu, Val Ala, or Gly
  SITE (303)..(303): Xaa at position 303 is Ala, Gly, or Pro
  SITE (310)..(310): Xaa at position 310 is Phe, Tyr, Met, His, Ile, Leu, Val Ala, or Gly
  SITE (317)..(317): Xaa at position 317 is Phe, Tyr, Met, His, Ile, Leu, Val Ala, or Gly
  SITE (320)..(320): Xaa at position 320 is Leu, Ala, Val, Gly, or Ile
  SITE (323)..(323): Xaa at position 323 is Leu, Ala, Val, Gly, or Ile
  SITE (324)..(324): Xaa at position 324 is Phe, Tyr, Met, His, Ile, Leu, Val Ala, or Gly
  SITE (327)..(327): Xaa at position 327 is Leu, Ala, Val, Gly, or Ile
  SITE (364)..(364): Xaa at position 364 is Val, Ala, Gly, Leu, or Ile
  SITE (365)..(365): Xaa at position 365 is Val, Ala, Gly, Leu, or Ile
  SITE (367)..(367): Xaa at position 367 is Ala, Gly, or Pro
  SITE (370)..(370): Xaa at position 370 is Ala, Gly, or Pro
  SITE (374)..(374): Xaa at position 374 is Ala, Gly, or Pro
  SITE (377)..(377): Xaa at position 377 is Phe, Tyr, Met, His, Ile, Leu, Val Ala, or Gly
  SITE (378)..(378): Xaa at position 378 is Leu, Ala, Val, Gly, or Ile
  SITE (404)..(404): Xaa at position 404 is Leu, Ala, Val, Gly, or Ile
  SITE (411)..(411): Xaa at position 411 is Leu, Ala, Val, Gly, or Ile
  SITE (420)..(420): Xaa at position 420 is Leu, Ala, Val, Gly, or Ile
  SITE (421)..(421): Xaa at position 421 is Ala, Gly, or Pro
  SITE (433)..(433): Xaa at position 433 is Val, Ala, Gly, Leu, or Ile
  SITE (434)..(434): Xaa at position 434 is Leu, Ala, Val, Gly, or Ile
  SITE (435)..(435): Xaa at position 435 is Leu, Ala, Val, Gly, or Ile
  SITE (467)..(467): Xaa at position 467 is Val, Ala, Gly, Leu, or Ile
  SITE (477)..(477): Xaa at position 477 is Leu, Ala, Val, Gly, or Ile
  SITE (478)..(478): Xaa at position 478 is Leu, Ala, Val, Gly, or Ile
  SITE (479)..(479): Xaa at position 479 is Leu, Ala, Val, Gly, or Ile
  SITE (480)..(480): Xaa at position 480 is Ile, Ala, Val, Leu, or Gly
  SITE (482)..(482): Xaa at position 482 is Ala, Gly, or Pro
  SITE (494)..(494): Xaa at position 494 is Val, Ala, Gly, Leu, or Ile
  SITE (510)..(510): Xaa at position 510 is Leu, Ala, Val, Gly, or Ile
  SITE (521)..(521): Xaa at position 521 is Phe, Tyr, Met, His, Ile, Leu, Val Ala, or Gly
  SITE (528)..(528): Xaa at position 528 is Leu, Ala, Val, Gly, or Ile
  SITE (531)..(531): Xaa at position 531 is Ile, Ala, Val, Leu, or Gly
  SITE (539)..(539): Xaa at position 539 is Val, Ala, Gly, Leu, or Ile
  SITE (540)..(540): Xaa at position 540 is Ala, Gly, or Pro
  SITE (541)..(541): Xaa at position 541 is Val, Ala, Gly, Leu, or Ile
  SITE (543)..(543): Xaa at position 543 is Ala, Gly, or Pro
  SITE (550)..(550): Xaa at position 550 is Ala, Gly, or Pro
  SITE (552)..(552): Xaa at position 552 is Tyr, Phe, Met, His, Ile, Leu, Val Ala, or Gly
  SITE (553)..(553): Xaa at position 553 is Ile, Ala, Val, Leu, or Gly
  SITE (554)..(554): Xaa at position 554 is Phe, Tyr, Met, His, Ile, Leu, Val Ala, or Gly
  SITE (561)..(561): Xaa at position 561 is Leu, Ala, Val, Gly, or Ile
  SITE (569)..(569): Xaa at position 569 is Ile, Ala, Val, Leu, or Gly
  SITE (578)..(578): Xaa at position 578 is Ile, Ala, Val, Leu, or Gly
  SITE (581)..(581): Xaa at position 581 is Phe, Tyr, Met, His, Ile, Leu, Val Ala, or Gly
  SITE (597)..(597): Xaa at position 597 is Ala, Gly, or Pro
  SITE (600)..(600): Xaa at position 600 is Ala, Gly, or Pro
  SITE (603)..(603): Xaa at position 603 is Ala, Gly, or Pro
  SITE (607)..(607): Xaa at position 607 is Met, Ile, Leu, Val, Ala, or Gly
  SITE (608)..(608): Xaa at position 608 is Ile, Ala, Val, Leu, or Gly
MKDSCITVMAMALLSGFFFFAPASSYNLDVRGARSFSPPRAGRHXGYRVLQVGNGVXXGAPGEGNSTGSXYQXQSGTGHCLPVTLRGSNYTSKYLGMTLATDPTDGSIXXXDPGLSRTXDQNTYLSGLXXLFRQNLQGPMLQGRPGFQECIKGNXDXXXXXDGSMSXQPDEFQKXLDXXKDXXKKXSNTSXQXXXXQXSTSYKTEXDXSDXVKRKDPDALLKHVKHMLLLTNTFGXXNYXATEXFREELGARPDATKXXXXXTDGEATDSGNXDAXKDXIRXXXGXGKHXQTKESQETXHKXXSKPASEXVKILDTXEKXKDXXTEXQKKIYVIEGTSKQDLTSFNMELSSSGISADLSRGHAXXGXVGXKDWXGGXXDLKADLQDDTFIGNEPLTPEVRAGYXGYTVTWXPSRQKTSLXXSGAPRYQHMGRXXXFQEPQGGGHWSQVQTIHGTQIGSYFGGELCGXDVDQDGETEXXXXGXPLFYGEQRGGRXFIYQRRQLGFEEVSEXQGDPGYPLGRXGEAITAXTDXNGDGLVDXXXGXPLEEQGXVXXXNGRHGGXSPQPSQRXEGTQVLSGXQWXGRSIHGVKDLEGDGLXDVXVGXESQXXVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 382 - protein, 1163 aa, Homo sapiens
  SITE (30)..(30): Xaa at position 30 is Phe, Tyr, Met, His, Ile, Leu, Val Ala, or Gly
  SITE (37)..(37): Xaa at position 37 is Phe, Tyr, Met, His, Ile, Leu, Val Ala, or Gly
  SITE (49)..(49): Xaa at position 49 is Val, Ala, Gly, Leu, or Ile
  SITE (50)..(50): Xaa at position 50 is Val, Ala, Gly, Leu, or Ile
  SITE (51)..(51): Xaa at position 51 is Val, Ala, Gly, Leu, or Ile
  SITE (53)..(53): Xaa at position 53 is Ala, Gly, or Pro
  SITE (66)..(66): Xaa at position 66 is Leu, Ala, Val, Gly, or Ile
  SITE (69)..(69): Xaa at position 69 is Cys, Ala, Val, Gly, Ser, or Thr
  SITE (87)..(87): Xaa at position 87 is Ala, Gly, or Pro
  SITE (90)..(90): Xaa at position 90 is Met, Ile, Leu, Val, Ala, or Gly
  SITE (92)..(92): Xaa at position 92 is Leu, Ala, Val, Gly, or Ile
  SITE (105)..(105): Xaa at position 105 is Leu, Ala, Val, Gly, or Ile
  SITE (106)..(106): Xaa at position 106 is Leu, Ala, Val, Gly, or Ile
  SITE (107)..(107): Xaa at position 107 is Ala, Gly, or Pro
  SITE (108)..(108): Xaa at position 108 is Cys, Ala, Val, Gly, Ser, or Thr
  SITE (126)..(126): Xaa at position 126 is Cys, Ala, Val, Gly, Ser, or Thr
  SITE (127)..(127): Xaa at position 127 is Phe, Tyr, Met, His, Ile, Leu, Val Ala, or Gly
  SITE (152)..(152): Xaa at position 152 is Ile, Ala, Val, Leu, or Gly
  SITE (153)..(153): Xaa at position 153 is Val, Ala, Gly, Leu, or Ile
  SITE (154)..(154): Xaa at position 154 is Phe, Tyr, Met, His, Ile, Leu, Val Ala, or Gly
  SITE (155)..(155): Xaa at position 155 is Leu, Ala, Val, Gly, or Ile
  SITE (156)..(156): Xaa at position 156 is Ile, Ala, Val, Leu, or Gly
  SITE (170)..(170): Xaa at position 170 is Met, Ile, Leu, Val, Ala, or Gly
  SITE (173)..(173): Xaa at position 173 is Phe, Tyr, Met, His, Ile, Leu, Val Ala, or Gly
  SITE (174)..(174): Xaa at position 174 is Val, Ala, Gly, Leu, or Ile
  SITE (177)..(177): Xaa at position 177 is Val, Ala, Gly, Leu, or Ile
  SITE (188)..(188): Xaa at position 188 is Phe, Tyr, Met, His, Ile, Leu, Val Ala, or Gly
  SITE (190)..(190): Xaa at position 190 is Leu, Ala, Val, Gly, or Ile
  SITE (191)..(191): Xaa at position 191 is Met, Ile, Leu, Val, Ala, or Gly
  SITE (193)..(193): Xaa at position 193 is Phe, Tyr, Met, His, Ile, Leu, Val Ala, or Gly
  SITE (201)..(201): Xaa at position 201 is Phe, Tyr, Met, His, Ile, Leu, Val Ala, or Gly
  SITE (203)..(203): Xaa at position 203 is Phe, Tyr, Met, His, Ile, Leu, Val Ala, or Gly
  SITE (206)..(206): Xaa at position 206 is Phe, Tyr, Met, His, Ile, Leu, Val Ala, or Gly
  SITE (216)..(216): Xaa at position 216 is Leu, Ala, Val, Gly, or Ile
  SITE (229)..(229): Xaa at position 229 is Ala, Gly, or Pro
  SITE (231)..(231): Xaa at position 231 is Ala, Gly, or Pro
  SITE (232)..(232): Xaa at position 232 is Ile, Ala, Val, Leu, or Gly
  SITE (235)..(235): Xaa at position 235 is Val, Ala, Gly, Leu, or Ile
  SITE (239)..(239): Xaa at position 239 is Leu, Ala, Val, Gly, or Ile
  SITE (253)..(253): Xaa at position 253 is Ile, Ala, Val, Leu, or Gly
  SITE (254)..(254): Xaa at position 254 is Leu, Ala, Val, Gly, or Ile
  SITE (255)..(255): Xaa at position 255 is Ile, Ala, Val, Leu, or Gly
  SITE (256)..(256): Xaa at position 256 is Val, Ala, Gly, Leu, or Ile
  SITE (257)..(257): Xaa at position 257 is Ile, Ala, Val, Leu, or Gly
  SITE (272)..(272): Xaa at position 272 is Val, Ala, Gly, Leu, or Ile
  SITE (273)..(273): Xaa at position 273 is Ile, Ala, Val, Leu, or Gly
  SITE (276)..(276): Xaa at position 276 is Ala, Gly, or Pro
  SITE (282)..(282): Xaa at position 282 is Ile, Ala, Val, Leu, or Gly
  SITE (285)..(285): Xaa at position 285 is Ala, Gly, or Pro
  SITE (286)..(286): Xaa at position 286 is Ile, Ala, Val, Leu, or Gly
  SITE (288)..(288): Xaa at position 288 is Val, Ala, Gly, Leu, or Ile
  SITE (291)..(291): Xaa at position 291 is Ala, Gly, or Pro
  SITE (292)..(292): Xaa at position 292 is Phe, Tyr, Met, His, Ile, Leu, Val Ala, or Gly
  SITE (301)..(301): Xaa at position 301 is Leu, Ala, Val, Gly, or Ile
  SITE (304)..(304): Xaa at position 304 is Ile, Ala, Val, Leu, or Gly
  SITE (305)..(305): Xaa at position 305 is Ala, Gly, or Pro
  SITE (314)..(314): Xaa at position 314 is Phe, Tyr, Met, His, Ile, Leu, Val Ala, or Gly
  SITE (316)..(316): Xaa at position 316 is Val, Ala, Gly, Leu, or Ile
  SITE (319)..(319): Xaa at position 319 is Phe, Tyr, Met, His, Ile, Leu, Val Ala, or Gly
  SITE (322)..(322): Xaa at position 322 is Leu, Ala, Val, Gly, or Ile
  SITE (329)..(329): Xaa at position 329 is Leu, Ala, Val, Gly, or Ile
  SITE (333)..(333): Xaa at position 333 is Ile, Ala, Val, Leu, or Gly
  SITE (334)..(334): Xaa at position 334 is Phe, Tyr, Met, His, Ile, Leu, Val Ala, or Gly
  SITE (352)..(352): Xaa at position 352 is Ala, Gly, or Pro
  SITE (366)..(366): Xaa at position 366 is Val, Ala, Gly, Leu, or Ile
  SITE (367)..(367): Xaa at position 367 is Leu, Ala, Val, Gly, or Ile
  SITE (369)..(369): Xaa at position 369 is Ala, Gly, or Pro
  SITE (379)..(379): Xaa at position 379 is Ala, Gly, or Pro
  SITE (391)..(391): Xaa at position 391 is Ile, Ala, Val, Leu, or Gly
  SITE (400)..(400): Xaa at position 400 is Met, Ile, Leu, Val, Ala, or Gly
  SITE (405)..(405): Xaa at position 405 is Leu, Ala, Val, Gly, or Ile
  SITE (412)..(412): Xaa at position 412 is Ala, Gly, or Pro
  SITE (420)..(420): Xaa at position 420 is Leu, Ala, Val, Gly, or Ile
  SITE (421)..(421): Xaa at position 421 is Val, Ala, Gly, Leu, or Ile
  SITE (422)..(422): Xaa at position 422 is Leu, Ala, Val, Gly, or Ile
  SITE (424)..(424): Xaa at position 424 is Ala, Gly, or Pro
  SITE (433)..(433): Xaa at position 433 is Ala, Gly, or Pro
  SITE (434)..(434): Xaa at position 434 is Val, Ala, Gly, Leu, or Ile
  SITE (435)..(435): Xaa at position 435 is Ile, Ala, Val, Leu, or Gly
  SITE (436)..(436): Xaa at position 436 is Phe, Tyr, Met, His, Ile, Leu, Val Ala, or Gly
  SITE (465)..(465): Xaa at position 465 is Val, Ala, Gly, Leu, or Ile
  SITE (467)..(467): Xaa at position 467 is Val, Ala, Gly, Leu, or Ile
  SITE (475)..(475): Xaa at position 475 is Leu, Ala, Val, Gly, or Ile
  SITE (476)..(476): Xaa at position 476 is Val, Ala, Gly, Leu, or Ile
  SITE (477)..(477): Xaa at position 477 is Leu, Ala, Val, Gly, or Ile
  SITE (478)..(478): Xaa at position 478 is Ile, Ala, Val, Leu, or Gly
  SITE (480)..(480): Xaa at position 480 is Ala, Gly, or Pro
  SITE (492)..(492): Xaa at position 492 is Val, Ala, Gly, Leu, or Ile
  SITE (494)..(494): Xaa at position 494 is Val, Ala, Gly, Leu, or Ile
  SITE (495)..(495): Xaa at position 495 is Cys, Ala, Val, Gly, Ser, or Thr
  SITE (510)..(510): Xaa at position 510 is Leu, Ala, Val, Gly, or Ile
  SITE (521)..(521): Xaa at position 521 is Phe, Tyr, Met, His, Ile, Leu, Val Ala, or Gly
  SITE (528)..(528): Xaa at position 528 is Leu, Ala, Val, Gly, or Ile
  SITE (531)..(531): Xaa at position 531 is Val, Ala, Gly, Leu, or Ile
  SITE (539)..(539): Xaa at position 539 is Val, Ala, Gly, Leu, or Ile
  SITE (540)..(540): Xaa at position 540 is Val, Ala, Gly, Leu, or Ile
  SITE (541)..(541): Xaa at position 541 is Ile, Ala, Val, Leu, or Gly
  SITE (543)..(543): Xaa at position 543 is Ala, Gly, or Pro
  SITE (552)..(552): Xaa at position 552 is Ala, Gly, or Pro
  SITE (553)..(553): Xaa at position 553 is Val, Ala, Gly, Leu, or Ile
  SITE (554)..(554): Xaa at position 554 is Tyr, Phe, Met, His, Ile, Leu, Val Ala, or Gly
  SITE (555)..(555): Xaa at position 555 is Leu, Ala, Val, Gly, or Ile
  SITE (556)..(556): Xaa at position 556 is Phe, Tyr, Met, His, Ile, Leu, Val Ala, or Gly
  SITE (572)..(572): Xaa at position 572 is Ile, Ala, Val, Leu, or Gly
  SITE (573)..(573): Xaa at position 573 is Ala, Gly, or Pro
  SITE (581)..(581): Xaa at position 581 is Leu, Ala, Val, Gly, or Ile
  SITE (584)..(584): Xaa at position 584 is Phe, Tyr, Met, His, Ile, Leu, Val Ala, or Gly
  SITE (602)..(602): Xaa at position 602 is Leu, Ala, Val, Gly, or Ile
  SITE (603)..(603): Xaa at position 603 is Ala, Gly, or Pro
  SITE (604)..(604): Xaa at position 604 is Val, Ala, Gly, Leu, or Ile
  SITE (606)..(606): Xaa at position 606 is Ala, Gly, or Pro
  SITE (610)..(610): Xaa at position 610 is Val, Ala, Gly, Leu, or Ile
  SITE (613)..(613): Xaa at position 613 is Leu, Ala, Val, Gly, or Ile
  SITE (618)..(618): Xaa at position 618 is Val, Ala, Gly, Leu, or Ile
  SITE (619)..(619): Xaa at position 619 is Leu, Ala, Val, Gly, or Ile
  SITE (632)..(632): Xaa at position 632 is Ile, Ala, Val, Leu, or Gly
  SITE (650)..(650): Xaa at position 650 is Val, Ala, Gly, Leu, or Ile
  SITE (658)..(658): Xaa at position 658 is Ile, Ala, Val, Leu, or Gly
  SITE (671)..(671): Xaa at position 671 is Leu, Ala, Val, Gly, or Ile
  SITE (675)..(675): Xaa at position 675 is Val, Ala, Gly, Leu, or Ile
  SITE (681)..(681): Xaa at position 681 is Leu, Ala, Val, Gly, or Ile
  SITE (690)..(690): Xaa at position 690 is Ala, Gly, or Pro
  SITE (692)..(692): Xaa at position 692 is Phe, Tyr, Met, His, Ile, Leu, Val Ala, or Gly
  SITE (700)..(700): Xaa at position 700 is Leu, Ala, Val, Gly, or Ile
  SITE (715)..(715): Xaa at position 715 is Phe, Tyr, Met, His, Ile, Leu, Val Ala, or Gly
  SITE (717)..(717): Xaa at position 717 is Leu, Ala, Val, Gly, or Ile
  SITE (719)..(719): Xaa at position 719 is Leu, Ala, Val, Gly, or Ile
  SITE (730)..(730): Xaa at position 730 is Ile, Ala, Val, Leu, or Gly
  SITE (732)..(732): Xaa at position 732 is Leu, Ala, Val, Gly, or Ile
  SITE (734)..(734): Xaa at position 734 is Leu, Ala, Val, Gly, or Ile
  SITE (749)..(749): Xaa at position 749 is Leu, Ala, Val, Gly, or Ile
  SITE (765)..(765): Xaa at position 765 is Leu, Ala, Val, Gly, or Ile
  SITE (793)..(793): Xaa at position 793 is Leu, Ala, Val, Gly, or Ile
  SITE (795)..(795): Xaa at position 795 is Val, Ala, Gly, Leu, or Ile
  SITE (801)..(801): Xaa at position 801 is Leu, Ala, Val, Gly, or Ile
  SITE (803)..(803): Xaa at position 803 is Ala, Gly, or Pro
  SITE (805)..(805): Xaa at position 805 is Val, Ala, Gly, Leu, or Ile
  SITE (807)..(807): Xaa at position 807 is Val, Ala, Gly, Leu, or Ile
  SITE (819)..(819): Xaa at position 819 is Ile, Ala, Val, Leu, or Gly
  SITE (821)..(821): Xaa at position 821 is Phe, Tyr, Met, His, Ile, Leu, Val Ala, or Gly
  SITE (823)..(823): Xaa at position 823 is His, Phe, Tyr, Lys, Arg, Gly, Ser Thr, Ala, Val, Leu, Ile, Asn, Met, or Gln
  SITE (863)..(863): Xaa at position 863 is Cys, Ala, Val, Gly, Ser, or Thr
  SITE (880)..(880): Xaa at position 880 is Ala, Gly, or Pro
  SITE (882)..(882): Xaa at position 882 is Phe, Tyr, Met, His, Ile, Leu, Val Ala, or Gly
  SITE (888)..(888): Xaa at position 888 is Ala, Gly, or Pro
  SITE (894)..(894): Xaa at position 894 is Leu, Ala, Val, Gly, or Ile
  SITE (896)..(896): Xaa at position 896 is Leu, Ala, Val, Gly, or Ile
  SITE (898)..(898): Xaa at position 898 is Ala, Gly, or Pro
  SITE (924)..(924): Xaa at position 924 is Val, Ala, Gly, Leu, or Ile
  SITE (951)..(951): Xaa at position 951 is Ala, Gly, or Pro
  SITE (953)..(953): Xaa at position 953 is His, Phe, Tyr, Lys, Arg, Gly, Ser Thr, Ala, Val, Leu, Ile, Asn, Met, or Gln
  SITE (955)..(955): Xaa at position 955 is Tyr, Phe, Met, His, Ile, Leu, Val Ala, or Gly
  SITE (957)..(957): Xaa at position 957 is Val, Ala, Gly, Leu, or Ile
  SITE (965)..(965): Xaa at position 965 is Leu, Ala, Val, Gly, or Ile
  SITE (967)..(967): Xaa at position 967 is Val, Ala, Gly, Leu, or Ile
  SITE (969)..(969): Xaa at position 969 is Ile, Ala, Val, Leu, or Gly
  SITE (971)..(971): Xaa at position 971 is Phe, Tyr, Met, His, Ile, Leu, Val Ala, or Gly
  SITE (973)..(973): Xaa at position 973 is Val, Ala, Gly, Leu, or Ile
  SITE (977)..(977): Xaa at position 977 is Leu, Ala, Val, Gly, or Ile
  SITE (982)..(982): Xaa at position 982 is Val, Ala, Gly, Leu, or Ile
  SITE (983)..(983): Xaa at position 983 is Trp, Tyr, Phe, Met, His, Ile, Leu Val, Ala, or Gly
  SITE (1014)..(1014): Xaa at position 1014 is Ile, Ala, Val, Leu, or Gly
  SITE (1020)..(1020): Xaa at position 1020 is Leu, Ala, Val, Gly, or Ile
  SITE (1025)..(1025): Xaa at position 1025 is Ala, Gly, or Pro
  SITE (1027)..(1027): Xaa at position 1027 is Cys, Ala, Val, Gly, Ser, or Thr
  SITE (1032)..(1032): Xaa at position 1032 is Cys, Ala, Val, Gly, Ser, or Thr
  SITE (1037)..(1037): Xaa at position 1037 is Phe, Tyr, Met, His, Ile, Leu Val, Ala, or Gly
  SITE (1039)..(1039): Xaa at position 1039 is Val, Ala, Gly, Leu, or Ile
  SITE (1043)..(1043): Xaa at position 1043 is Leu, Ala, Val, Gly, or Ile
  SITE (1045)..(1045): Xaa at position 1045 is Phe, Tyr, Met, His, Ile, Leu Val, Ala, or Gly
  SITE (1047)..(1047): Xaa at position 1047 is Leu, Ala, Val, Gly, or Ile
  SITE (1051)..(1051): Xaa at position 1051 is Leu, Ala, Val, Gly, or Ile
  SITE (1055)..(1055): Xaa at position 1055 is Trp, Tyr, Phe, Met, His, Ile Leu, Val, Ala, or Gly
  SITE (1059)..(1059): Xaa at position 1059 is Ile, Ala, Val, Leu, or Gly
  SITE (1064)..(1064): Xaa at position 1064 is Val, Ala, Gly, Leu, or Ile
  SITE (1066)..(1066): Xaa at position 1066 is Val, Ala, Gly, Leu, or Ile
  SITE (1070)..(1070): Xaa at position 1070 is Ala, Gly, or Pro
  SITE (1072)..(1072): Xaa at position 1072 is Ile, Ala, Val, Leu, or Gly
  SITE (1097)..(1097): Xaa at position 1097 is Leu, Ala, Val, Gly, or Ile
MTRTRAALLLFTALATSLGFNLDTEELTAXRVDSAGXGDSVVQYANSWXXXGXPQKITAANQTGGXYQXGYSTGACEPIGLQVPPEXVNXSXGLSLASTTSPSQXXXXGPTVHHECGRNMYLTGLXXLLGPTQLTQRLPVSRQECPRQEQDXXXXXDGSGSISSRNFATXMNXXRAXISQFQRPSTQXSXXQXSNKFQTHXTXEEXRRSSNPLSLXASVHQLQGFTYTXTXXQNXVHRXFHASYGARRDAAKXXXXXTDGKKEGDSLDYKDXXPMXDAAGIXRYXXGXGLXXQNRNSWKEXNDXXSKPSQEHIXKXEDXDAXKDIQNQXKEKXXAIEGTETTSSSSFELEMXQEGFSAVFTPDGPXXGXVGSFTWSGGXFLYPPNMSPTFXNMSQENVDXRDSYXGYSTELXLWKGVQSXXXGXPRYQHTGKXXXXTQVSRQWRMKAEVTGTQIGSYFGASLCSXDXDSDGSTDXXXXGXPHYYEQTRGGQXSXXPLPRGWRRWWCDAVXYGEQGHPWGRXGAALTVXGDXNGDKLTDXXXGXPGEEENRGXXXXXHGVLGPSISPSHSQRXXGSQLSSRXQYXGQALSGGQDLTQDGLVDXXXGXRGQXLLXRTRPXXWVGVSMQFIPAEXPRSAFECREQVVSEQTLXQSNICLYXDKRSKNLLGSRDXQSSXTLDLAXDPGRLSPRXTXQETKNRSXSRVRVLGLKAHCENXNXLXPSCVEDSVTPXTXRXNFTLVGKPLLAFRNXRPMLAADAQRYFTASXPFEKNCGADHICQDNLGISFSFPGLKSXLXGSNLEXNXEXMXWNDGEDSYGTTXTXSXPAGLSYRYVAEGQKQGQLRSLHLTCDSAPVGSQGTWSTSXRINHLIFRGGAQITFLXTXDVSPKXVLGDRXLXTXNVSSENNTPRTSKTTFQLELPVKYAXYTVVSSHEQFTKYLNFSESEEKESHVXMXRXQXNNLGQRDXPXSXNXWXPVEXNQEAXXMDVEVSHPQNPSLRCSSEKIAPPASDFLAHXQKNPVXDCSIXGXLRFRXDVPSXSXQEEXDXTXKGNXSFGXVRQXLQKKXSXVSVXEXTFDTSVYSQLPGQEAFMRAQTTTVXEKYKVHNPTPLIVGSSIGGLLLLALITAVLYKVGFFKRQYKEMMEEANGQIAPENGTQTPSPPSEK

SEQ ID NO: 383 - protein, 454 aa, Homo sapiens
  SITE (139)..(139): Xaa at position 139 is Leu, Ala, Val, Gly, or Ile
  SITE (143)..(143): Xaa at position 143 is Val, Ala, Gly, Leu, or Ile
  SITE (151)..(151): Xaa at position 151 is Val, Ala, Gly, Leu, or Ile
  SITE (158)..(158): Xaa at position 158 is Phe, Tyr, Met, His, Ile, Leu, Val Ala, or Gly
  SITE (176)..(176): Xaa at position 176 is Leu, Ala, Val, Gly, or Ile
  SITE (177)..(177): Xaa at position 177 is His, Phe, Tyr, Lys, Arg, Gly, Ser Thr, Ala, Val, Leu, Ile, Asn, Met, or Gln
  SITE (179)..(179): Xaa at position 179 is Ala, Gly, or Pro
  SITE (180)..(180): Xaa at position 180 is Val, Ala, Gly, Leu, or Ile
  SITE (188)..(188): Xaa at position 188 is Val, Ala, Gly, Leu, or Ile
  SITE (191)..(191): Xaa at position 191 is Leu, Ala, Val, Gly, or Ile
  SITE (208)..(208): Xaa at position 208 is Ala, Gly, or Pro
  SITE (210)..(210): Xaa at position 210 is His, Phe, Tyr, Lys, Arg, Gly, Ser Thr, Ala, Val, Leu, Ile, Asn, Met, or Gln
  SITE (212)..(212): Xaa at position 212 is Ala, Gly, or Pro
  SITE (213)..(213): Xaa at position 213 is Cys, Ala, Val, Gly, Ser, or Thr
  SITE (220)..(220): Xaa at position 220 is Cys, Ala, Val, Gly, Ser, or Thr
  SITE (221)..(221): Xaa at position 221 is Leu, Ala, Val, Gly, or Ile
  SITE (223)..(223): Xaa at position 223 is Ala, Gly, or Pro
  SITE (224)..(224): Xaa at position 224 is Leu, Ala, Val, Gly, or Ile
  SITE (245)..(245): Xaa at position 245 is Ala, Gly, or Pro
  SITE (246)..(246): Xaa at position 246 is Leu, Ala, Val, Gly, or Ile
  SITE (247)..(247): Xaa at position 247 is His, Phe, Tyr, Lys, Arg, Gly, Ser Thr, Ala, Val, Leu, Ile, Asn, Met, or Gln
  SITE (249)..(249): Xaa at position 249 is Ala, Gly, or Pro
  SITE (250)..(250): Xaa at position 250 is Val, Ala, Gly, Leu, or Ile
  SITE (258)..(258): Xaa at position 258 is Val, Ala, Gly, Leu, or Ile
  SITE (260)..(260): Xaa at position 260 is Leu, Ala, Val, Gly, or Ile
  SITE (261)..(261): Xaa at position 261 is Leu, Ala, Val, Gly, or Ile
  SITE (280)..(280): Xaa at position 280 is Leu, Ala, Val, Gly, or Ile
  SITE (281)..(281): Xaa at position 281 is Ile, Ala, Val, Leu, or Gly
  SITE (283)..(283): Xaa at position 283 is Ala, Gly, or Pro
  SITE (284)..(284): Xaa at position 284 is Val, Ala, Gly, Leu, or Ile
  SITE (291)..(291): Xaa at position 291 is Met, Ile, Leu, Val, Ala, or Gly
  SITE (292)..(292): Xaa at position 292 is Val, Ala, Gly, Leu, or Ile
  SITE (294)..(294): Xaa at position 294 is Leu, Ala, Val, Gly, or Ile
  SITE (295)..(295): Xaa at position 295 is Leu, Ala, Val, Gly, or Ile
  SITE (312)..(312): Xaa at position 312 is Ala, Gly, or Pro
  SITE (313)..(313): Xaa at position 313 is Leu, Ala, Val, Gly, or Ile
  SITE (316)..(316): Xaa at position 316 is Ala, Gly, or Pro
  SITE (325)..(325): Xaa at position 325 is Val, Ala, Gly, Leu, or Ile
  SITE (328)..(328): Xaa at position 328 is Leu, Ala, Val, Gly, or Ile
  SITE (354)..(354): Xaa at position 354 is Val, Ala, Gly, Leu, or Ile
MPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPXHIAXVQGNLPAXHRLVNLXQQGGRELDIYNNLRQTPXXLXXITTLPSVXRLXVTAGASPMALDRHGQTXAXLXXEHRSPTXXRXXLDSAAPGTLDLEARNYDGLTXXXVXXNTECQETXQXXLERGADIDAVDIKSGRSPXXHXXENNSLSXXQXXLQHGANVNAQMYSGSSXXHSXSGRGLLPLXRTXVRSGADSSLKNCHNDTPLMVARSRRXIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 384 - protein, 821 aa, Homo sapiens
  SITE (138)..(138): Xaa at position 138 is Leu, Ala, Val, Gly, or Ile
  SITE (145)..(145): Xaa at position 145 is Leu, Ala, Val, Gly, or Ile
  SITE (189)..(189): Xaa at position 189 is Leu, Ala, Val, Gly, or Ile
  SITE (200)..(200): Xaa at position 200 is Phe, Tyr, Met, His, Ile, Leu, Val Ala, or Gly
  SITE (210)..(210): Xaa at position 210 is Ala, Gly, or Pro
  SITE (212)..(212): Xaa at position 212 is Leu, Ala, Val, Gly, or Ile
  SITE (216)..(216): Xaa at position 216 is Tyr, Phe, Met, His, Ile, Leu, Val Ala, or Gly
  SITE (218)..(218): Xaa at position 218 is Ala, Gly, or Pro
  SITE (239)..(239): Xaa at position 239 is Phe, Tyr, Met, His, Ile, Leu, Val Ala, or Gly
  SITE (335)..(335): Xaa at position 335 is Ala, Gly, or Pro
  SITE (363)..(363): Xaa at position 363 is Val, Ala, Gly, Leu, or Ile
  SITE (404)..(404): Xaa at position 404 is Phe, Tyr, Met, His, Ile, Leu, Val Ala, or Gly
  SITE (658)..(658): Xaa at position 658 is Phe, Tyr, Met, His, Ile, Leu, Val Ala, or Gly
  SITE (662)..(662): Xaa at position 662 is Ala, Gly, or Pro
  SITE (668)..(668): Xaa at position 668 is Ile, Ala, Val, Leu, or Gly
  SITE (673)..(673): Xaa at position 673 is Leu, Ala, Val, Gly, or Ile
  SITE (677)..(677): Xaa at position 677 is Leu, Ala, Val, Gly, or Ile
  SITE (681)..(681): Xaa at position 681 is Val, Ala, Gly, Leu, or Ile
  SITE (697)..(697): Xaa at position 697 is Cys, Ala, Val, Gly, Ser, or Thr
  SITE (700)..(700): Xaa at position 700 is Met, Ile, Leu, Val, Ala, or Gly
  SITE (704)..(704): Xaa at position 704 is Met, Ile, Leu, Val, Ala, or Gly
  SITE (712)..(712): Xaa at position 712 is Leu, Ala, Val, Gly, or Ile
  SITE (717)..(717): Xaa at position 717 is Phe, Tyr, Met, His, Ile, Leu, Val Ala, or Gly
  SITE (720)..(720): Xaa at position 720 is Leu, Ala, Val, Gly, or Ile
  SITE (724)..(724): Xaa at position 724 is Ile, Ala, Val, Leu, or Gly
  SITE (731)..(731): Xaa at position 731 is Phe, Tyr, Met, His, Ile, Leu, Val Ala, or Gly
  SITE (742)..(742): Xaa at position 742 is Ile, Ala, Val, Leu, or Gly
  SITE (747)..(747): Xaa at position 747 is Met, Ile, Leu, Val, Ala, or Gly
  SITE (750)..(750): Xaa at position 750 is Ala, Gly, or Pro
  SITE (751)..(751): Xaa at position 751 is Val, Ala, Gly, Leu, or Ile
  SITE (754)..(754): Xaa at position 754 is Ala, Gly, or Pro
  SITE (763)..(763): Xaa at position 763 is Tyr, Phe, Met, His, Ile, Leu, Val Ala, or Gly
  SITE (777)..(777): Xaa at position 777 is Ile, Ala, Val, Leu, or Gly
  SITE (779)..(779): Xaa at position 779 is Phe, Tyr, Met, His, Ile, Leu, Val Ala, or Gly
  SITE (782)..(782): Xaa at position 782 is Phe, Tyr, Met, His, Ile, Leu, Val Ala, or Gly
  SITE (783)..(783): Xaa at position 783 is Ile, Ala, Val, Leu, or Gly
  SITE (785)..(785): Xaa at position 785 is Cys, Ala, Val, Gly, Ser, or Thr
  SITE (786)..(786): Xaa at position 786 is Phe, Tyr, Met, His, Ile, Leu, Val Ala, or Gly
  SITE (815)..(815): Xaa at position 815 is Leu, Ala, Val, Gly, or Ile
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACXTLNQHLXFRVIPHDQSFIENYAGIFHFQFWRYGEWVDVVIDDCLPTYNNQXVFTKSNHRNEXWSALLEKAYXKXHGSXEXLKGGNTTEAMEDFTGGVAEFXEIRDAPSDMYKIMKKAIERGSLMGCSIDDGTNMTYGTSPSGLNMGELIARMVRNMDNSLLQDSDLDPRGSDERPTRTIIPVQYETRMACGLVRGHXYSVTGLDEVPFKGEKVKLVRLRNPWGQXEWNGSWSDRWKDWSFVDKDEKARLQHQVTEDGEFWMSYEDXIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIXKQIXGDDMEXCADEXKKVXNTVXNKHKDLKTHGFTLESXRSXIALXDTDGSGKXNLQEXHHXWNKXKAWQKIXKHYDTDQSGTXNSYEXRNXXNDXGFHLNNQLXDIITMRYADKHMNXDXDSXXCXXVRLEGMFRAFHAFDKDGDGIIKLNVLEWXQLTMYA

SEQ ID NO: 385 - protein, 921 aa, Homo sapiens
  SITE (59)..(59): Xaa at position 59 is Leu, Ala, Val, Gly, or Ile
  SITE (65)..(65): Xaa at position 65 is Val, Ala, Gly, Leu, or Ile
  SITE (86)..(86): Xaa at position 86 is Ala, Gly, or Pro
  SITE (113)..(113): Xaa at position 113 is Phe, Tyr, Met, His, Ile, Leu, Val Ala, or Gly
  SITE (114)..(114): Xaa at position 114 is Leu, Ala, Val, Gly, or Ile
  SITE (117)..(117): Xaa at position 117 is Phe, Tyr, Met, His, Ile, Leu, Val Ala, or Gly
  SITE (119)..(119): Xaa at position 119 is Met, Ile, Leu, Val, Ala, or Gly
  SITE (128)..(128): Xaa at position 128 is Trp, Tyr, Phe, Met, His, Ile, Leu Val, Ala, or Gly
  SITE (130)..(130): Xaa at position 130 is Ile, Ala, Val, Leu, or Gly
  SITE (131)..(131): Xaa at position 131 is Trp, Tyr, Phe, Met, His, Ile, Leu Val, Ala, or Gly
  SITE (133)..(133): Xaa at position 133 is Ile, Ala, Val, Leu, or Gly
  SITE (144)..(144): Xaa at position 144 is Ile, Ala, Val, Leu, or Gly
  SITE (146)..(146): Xaa at position 146 is Ile, Ala, Val, Leu, or Gly
  SITE (153)..(153): Xaa at position 153 is Val, Ala, Gly, Leu, or Ile
  SITE (155)..(155): Xaa at position 155 is Phe, Tyr, Met, His, Ile, Leu, Val Ala, or Gly
  SITE (169)..(169): Xaa at position 169 is Phe, Tyr, Met, His, Ile, Leu, Val Ala, or Gly
  SITE (183)..(183): Xaa at position 183 is Ile, Ala, Val, Leu, or Gly
  SITE (184)..(184): Xaa at position 184 is Met, Ile, Leu, Val, Ala, or Gly
  SITE (185)..(185): Xaa at position 185 is Ile, Ala, Val, Leu, or Gly
  SITE (187)..(187): Xaa at position 187 is Val, Ala, Gly, Leu, or Ile
  SITE (192)..(192): Xaa at position 192 is Ala, Gly, or Pro
  SITE (194)..(194): Xaa at position 194 is Leu, Ala, Val, Gly, or Ile
  SITE (218)..(218): Xaa at position 218 is Ala, Gly, or Pro
  SITE (219)..(219): Xaa at position 219 is Val, Ala, Gly, Leu, or Ile
  SITE (231)..(231): Xaa at position 231 is Val, Ala, Gly, Leu, or Ile
  SITE (235)..(235): Xaa at position 235 is Leu, Ala, Val, Gly, or Ile
  SITE (238)..(238): Xaa at position 238 is Met, Ile, Leu, Val, Ala, or Gly
  SITE (240)..(240): Xaa at position 240 is Ile, Ala, Val, Leu, or Gly
MKTCWKIPVFFFVCSFLEPWASAAVKRRPRFPVNSNSNGGNELCPKIRIGQDDLPGFDXISQFQXDKAASRRAIQRVVGSATLQVXYKLGNNVDFRIPTRNLYPSGLPEEYSXXTTXRXTGSTLKKNXNXXQXQDSSGKEQVGXKXNGQTQSXVXSYKGLDGSLQTAAXSNLSSLFDSQWHKXXXGXERSSXTXFVDCNRIESLPIKPRGPIDIDGFXXLGKLADNPQVSXPFEXQWXLXHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 386 - protein, 6669 aa, Homo sapiens
  SITE (6617)..(6617): Xaa at position 6617 is Ala, Gly, or Pro
  SITE (6631)..(6631): Xaa at position 6631 is Phe, Tyr, Met, His, Ile, Leu Val, Ala, or Gly
  SITE (6637)..(6637): Xaa at position 6637 is Ile, Ala, Val, Leu, or Gly
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRXMYDYMAADADEVSXKDGDAXINVQAIDEGWMYGTVQRTGRTGMLPANYVEAI

SEQ ID NO: 387 - protein, 346 aa, Homo sapiens
  SITE (91)..(91): Xaa at position 91 is Ile, Ala, Val, Leu, or Gly
  SITE (105)..(105): Xaa at position 105 is Leu, Ala, Val, Gly, or Ile
  SITE (108)..(108): Xaa at position 108 is Ile, Ala, Val, Leu, or Gly
  SITE (111)..(111): Xaa at position 111 is Ala, Gly, or Pro
  SITE (112)..(112): Xaa at position 112 is Ile, Ala, Val, Leu, or Gly
  SITE (114)..(114): Xaa at position 114 is Val, Ala, Gly, Leu, or Ile
  SITE (115)..(115): Xaa at position 115 is Ala, Gly, or Pro
  SITE (118)..(118): Xaa at position 118 is Val, Ala, Gly, Leu, or Ile
  SITE (132)..(132): Xaa at position 132 is Ala, Gly, or Pro
  SITE (136)..(136): Xaa at position 136 is Ala, Gly, or Pro
  SITE (243)..(243): Xaa at position 243 is Ala, Gly, or Pro
  SITE (253)..(253): Xaa at position 253 is Ala, Gly, or Pro
  SITE (254)..(254): Xaa at position 254 is Ala, Gly, or Pro
  SITE (256)..(256): Xaa at position 256 is Ala, Gly, or Pro
  SITE (263)..(263): Xaa at position 263 is Leu, Ala, Val, Gly, or Ile
  SITE (272)..(272): Xaa at position 272 is Ala, Gly, or Pro
  SITE (273)..(273): Xaa at position 273 is Val, Ala, Gly, Leu, or Ile
  SITE (285)..(285): Xaa at position 285 is Ala, Gly, or Pro
  SITE (286)..(286): Xaa at position 286 is Cys, Ala, Val, Gly, Ser, or Thr
  SITE (290)..(290): Xaa at position 290 is Ile, Ala, Val, Leu, or Gly
  SITE (293)..(293): Xaa at position 293 is Ile, Ala, Val, Leu, or Gly
  SITE (300)..(300): Xaa at position 300 is Phe, Tyr, Met, His, Ile, Leu, Val Ala, or Gly
  SITE (303)..(303): Xaa at position 303 is Ala, Gly, or Pro
  SITE (304)..(304): Xaa at position 304 is Val, Ala, Gly, Leu, or Ile
  SITE (306)..(306): Xaa at position 306 is Cys, Ala, Val, Gly, Ser, or Thr
  SITE (317)..(317): Xaa at position 317 is Cys, Ala, Val, Gly, Ser, or Thr
MARKSNLPVLLVPFLLCQALVRCSSPLPLVVNTWPFKNATEAAWRALASGGSALDAVESGCAMCEREQCDGSVGFGGSPDELGETTLDAMXMDGTTMDVGAVGDXRRXKNXXGXXRKXLEHTTHTLLVGESXTTFXQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGXGAYADDTAGXXAXTGNGDIXMRFLPSYQXXEYMRRGEDPTIXXQKVXSRXQKHFPEXFGXXIXANVTGSYGAAXNKLSTFTQFSFMVYNSEKNQPTEEKVDCI

SEQ ID NO: 388 - protein, 2647 aa, Homo sapiens
  SITE (49)..(49): Xaa at position 49 is Phe, Tyr, Met, His, Ile, Leu, Val Ala, or Gly
  SITE (53)..(53): Xaa at position 53 is Cys, Ala, Val, Gly, Ser, or Thr
  SITE (57)..(57): Xaa at position 57 is Leu, Ala, Val, Gly, or Ile
  SITE (64)..(64): Xaa at position 64 is Ile, Ala, Val, Leu, or Gly
  SITE (67)..(67): Xaa at position 67 is Leu, Ala, Val, Gly, or Ile
  SITE (71)..(71): Xaa at position 71 is Leu, Ala, Val, Gly, or Ile
  SITE (77)..(77): Xaa at position 77 is Leu, Ala, Val, Gly, or Ile
  SITE (78)..(78): Xaa at position 78 is Ile, Ala, Val, Leu, or Gly
  SITE (80)..(80): Xaa at position 80 is Leu, Ala, Val, Gly, or Ile
  SITE (81)..(81): Xaa at position 81 is Leu, Ala, Val, Gly, or Ile
  SITE (107)..(107): Xaa at position 107 is Val, Ala, Gly, Leu, or Ile
  SITE (109)..(109): Xaa at position 109 is Val, Ala, Gly, Leu, or Ile
  SITE (110)..(110): Xaa at position 110 is Ala, Gly, or Pro
  SITE (111)..(111): Xaa at position 111 is Leu, Ala, Val, Gly, or Ile
  SITE (113)..(113): Xaa at position 113 is Phe, Tyr, Met, His, Ile, Leu, Val Ala, or Gly
  SITE (114)..(114): Xaa at position 114 is Leu, Ala, Val, Gly, or Ile
  SITE (129)..(129): Xaa at position 129 is Ile, Ala, Val, Leu, or Gly
  SITE (137)..(137): Xaa at position 137 is Ile, Ala, Val, Leu, or Gly
  SITE (138)..(138): Xaa at position 138 is Leu, Ala, Val, Gly, or Ile
  SITE (140)..(140): Xaa at position 140 is Leu, Ala, Val, Gly, or Ile
  SITE (141)..(141): Xaa at position 141 is Ile, Ala, Val, Leu, or Gly
  SITE (144)..(144): Xaa at position 144 is Leu, Ala, Val, Gly, or Ile
  SITE (145)..(145): Xaa at position 145 is Ile, Ala, Val, Leu, or Gly
  SITE (150)..(150): Xaa at position 150 is Ile, Ala, Val, Leu, or Gly
  SITE (172)..(172): Xaa at position 172 is Leu, Ala, Val, Gly, or Ile
  SITE (176)..(176): Xaa at position 176 is Ile, Ala, Val, Leu, or Gly
  SITE (180)..(180): Xaa at position 180 is Leu, Ala, Val, Gly, or Ile
  SITE (185)..(185): Xaa at position 185 is Ile, Ala, Val, Leu, or Gly
  SITE (188)..(188): Xaa at position 188 is Phe, Tyr, Met, His, Ile, Leu, Val Ala, or Gly
  SITE (192)..(192): Xaa at position 192 is Trp, Tyr, Phe, Met, His, Ile, Leu Val, Ala, or Gly
  SITE (197)..(197): Xaa at position 197 is Ala, Gly, or Pro
  SITE (198)..(198): Xaa at position 198 is Leu, Ala, Val, Gly, or Ile
  SITE (200)..(200): Xaa at position 200 is Ala, Gly, or Pro
  SITE (201)..(201): Xaa at position 201 is Leu, Ala, Val, Gly, or Ile
  SITE (202)..(202): Xaa at position 202 is Val, Ala, Gly, Leu, or Ile
  SITE (206)..(206): Xaa at position 206 is Ala, Gly, or Pro
  SITE (210)..(210): Xaa at position 210 is Cys, Ala, Val, Gly, Ser, or Thr
  SITE (225)..(225): Xaa at position 225 is Ala, Gly, or Pro
  SITE (228)..(228): Xaa at position 228 is Ala, Gly, or Pro
  SITE (229)..(229): Xaa at position 229 is Met, Ile, Leu, Val, Ala, or Gly
  SITE (232)..(232): Xaa at position 232 is Ala, Gly, or Pro
  SITE (236)..(236): Xaa at position 236 is Leu, Ala, Val, Gly, or Ile
  SITE (238)..(238): Xaa at position 238 is Ile, Ala, Val, Leu, or Gly
  SITE (241)..(241): Xaa at position 241 is Val, Ala, Gly, Leu, or Ile
  SITE (242)..(242): Xaa at position 242 is Ile, Ala, Val, Leu, or Gly
  SITE (247)..(247): Xaa at position 247 is Ile, Ala, Val, Leu, or Gly
  SITE (257)..(257): Xaa at position 257 is Val, Ala, Gly, Leu, or Ile
  SITE (258)..(258): Xaa at position 258 is Met, Ile, Leu, Val, Ala, or Gly
  SITE (260)..(260): Xaa at position 260 is Tyr, Phe, Met, His, Ile, Leu, Val Ala, or Gly
  SITE (261)..(261): Xaa at position 261 is Leu, Ala, Val, Gly, or Ile
  SITE (264)..(264): Xaa at position 264 is Phe, Tyr, Met, His, Ile, Leu, Val Ala, or Gly
  SITE (284)..(284): Xaa at position 284 is Ala, Gly, or Pro
  SITE (302)..(302): Xaa at position 302 is Ala, Gly, or Pro
  SITE (306)..(306): Xaa at position 306 is Val, Ala, Gly, Leu, or Ile
  SITE (311)..(311): Xaa at position 311 is Ala, Gly, or Pro
  SITE (318)..(318): Xaa at position 318 is Val, Ala, Gly, Leu, or Ile
  SITE (344)..(344): Xaa at position 344 is Val, Ala, Gly, Leu, or Ile
  SITE (354)..(354): Xaa at position 354 is His, Phe, Tyr, Lys, Arg, Gly, Ser Thr, Ala, Val, Leu, Ile, Asn, Met, or Gln
  SITE (356)..(356): Xaa at position 356 is Val, Ala, Gly, Leu, or Ile
  SITE (358)..(358): Xaa at position 358 is Val, Ala, Gly, Leu, or Ile
  SITE (360)..(360): Xaa at position 360 is Phe, Tyr, Met, His, Ile, Leu, Val Ala, or Gly
  SITE (365)..(365): Xaa at position 365 is Ile, Ala, Val, Leu, or Gly
  SITE (372)..(372): Xaa at position 372 is Val, Ala, Gly, Leu, or Ile
  SITE (495)..(495): Xaa at position 495 is Val, Ala, Gly, Leu, or Ile
  SITE (501)..(501): Xaa at position 501 is Ala, Gly, or Pro
  SITE (505)..(505): Xaa at position 505 is Val, Ala, Gly, Leu, or Ile
  SITE (510)..(510): Xaa at position 510 is Ala, Gly, or Pro
  SITE (519)..(519): Xaa at position 519 is Val, Ala, Gly, Leu, or Ile
  SITE (540)..(540): Xaa at position 540 is Phe, Tyr, Met, His, Ile, Leu, Val Ala, or Gly
  SITE (542)..(542): Xaa at position 542 is Tyr, Phe, Met, His, Ile, Leu, Val Ala, or Gly
  SITE (550)..(550): Xaa at position 550 is Tyr, Phe, Met, His, Ile, Leu, Val Ala, or Gly
  SITE (552)..(552): Xaa at position 552 is Val, Ala, Gly, Leu, or Ile
  SITE (554)..(554): Xaa at position 554 is Ile, Ala, Val, Leu, or Gly
  SITE (561)..(561): Xaa at position 561 is Ile, Ala, Val, Leu, or Gly
  SITE (568)..(568): Xaa at position 568 is Val, Ala, Gly, Leu, or Ile
  SITE (595)..(595): Xaa at position 595 is Ala, Gly, or Pro
  SITE (597)..(597): Xaa at position 597 is Phe, Tyr, Met, His, Ile, Leu, Val Ala, or Gly
  SITE (598)..(598): Xaa at position 598 is Val, Ala, Gly, Leu, or Ile
  SITE (599)..(599): Xaa at position 599 is Val, Ala, Gly, Leu, or Ile
  SITE (633)..(633): Xaa at position 633 is Val, Ala, Gly, Leu, or Ile
  SITE (635)..(635): Xaa at position 635 is Tyr, Phe, Met, His, Ile, Leu, Val Ala, or Gly
  SITE (643)..(643): Xaa at position 643 is Tyr, Phe, Met, His, Ile, Leu, Val Ala, or Gly
  SITE (644)..(644): Xaa at position 644 is Ala, Gly, or Pro
  SITE (647)..(647): Xaa at position 647 is Val, Ala, Gly, Leu, or Ile
  SITE (654)..(654): Xaa at position 654 is Ile, Ala, Val, Leu, or Gly
  SITE (661)..(661): Xaa at position 661 is Ala, Gly, or Pro
  SITE (675)..(675): Xaa at position 675 is Val, Ala, Gly, Leu, or Ile
  SITE (697)..(697): Xaa at position 697 is Val, Ala, Gly, Leu, or Ile
  SITE (743)..(743): Xaa at position 743 is His, Phe, Tyr, Lys, Arg, Gly, Ser Thr, Ala, Val, Leu, Ile, Asn, Met, or Gln
  SITE (745)..(745): Xaa at position 745 is Ala, Gly, or Pro
  SITE (747)..(747): Xaa at position 747 is Val, Ala, Gly, Leu, or Ile
  SITE (761)..(761): Xaa at position 761 is Val, Ala, Gly, Leu, or Ile
  SITE (1070)..(1070): Xaa at position 1070 is Val, Ala, Gly, Leu, or Ile
  SITE (1088)..(1088): Xaa at position 1088 is Phe, Tyr, Met, His, Ile, Leu Val, Ala, or Gly
  SITE (1090)..(1090): Xaa at position 1090 is Ile, Ala, Val, Leu, or Gly
  SITE (1095)..(1095): Xaa at position 1095 is Ala, Gly, or Pro
  SITE (1124)..(1124): Xaa at position 1124 is Val, Ala, Gly, Leu, or Ile
  SITE (1126)..(1126): Xaa at position 1126 is Tyr, Phe, Met, His, Ile, Leu Val, Ala, or Gly
  SITE (1134)..(1134): Xaa at position 1134 is Tyr, Phe, Met, His, Ile, Leu Val, Ala, or Gly
  SITE (1136)..(1136): Xaa at position 1136 is Ile, Ala, Val, Leu, or Gly
  SITE (1138)..(1138): Xaa at position 1138 is Ile, Ala, Val, Leu, or Gly
  SITE (1145)..(1145): Xaa at position 1145 is Ile, Ala, Val, Leu, or Gly
  SITE (1152)..(1152): Xaa at position 1152 is Ala, Gly, or Pro
  SITE (1154)..(1154): Xaa at position 1154 is Val, Ala, Gly, Leu, or Ile
  SITE (1163)..(1163): Xaa at position 1163 is Val, Ala, Gly, Leu, or Ile
  SITE (1165)..(1165): Xaa at position 1165 is Cys, Ala, Val, Gly, Ser, or Thr
  SITE (1181)..(1181): Xaa at position 1181 is Phe, Tyr, Met, His, Ile, Leu Val, Ala, or Gly
  SITE (1183)..(1183): Xaa at position 1183 is Val, Ala, Gly, Leu, or Ile
  SITE (1188)..(1188): Xaa at position 1188 is Ala, Gly, or Pro
  SITE (1197)..(1197): Xaa at position 1197 is Ile, Ala, Val, Leu, or Gly
  SITE (1219)..(1219): Xaa at position 1219 is Ile, Ala, Val, Leu, or Gly
  SITE (1221)..(1221): Xaa at position 1221 is Tyr, Phe, Met, His, Ile, Leu Val, Ala, or Gly
  SITE (1229)..(1229): Xaa at position 1229 is Tyr, Phe, Met, His, Ile, Leu Val, Ala, or Gly
  SITE (1231)..(1231): Xaa at position 1231 is Val, Ala, Gly, Leu, or Ile
  SITE (1233)..(1233): Xaa at position 1233 is Ile, Ala, Val, Leu, or Gly
  SITE (1235)..(1235): Xaa at position 1235 is Tyr, Phe, Met, His, Ile, Leu Val, Ala, or Gly
  SITE (1247)..(1247): Xaa at position 1247 is Leu, Ala, Val, Gly, or Ile
  SITE (1258)..(1258): Xaa at position 1258 is Val, Ala, Gly, Leu, or Ile
  SITE (1270)..(1270): Xaa at position 1270 is Val, Ala, Gly, Leu, or Ile
  SITE (1278)..(1278): Xaa at position 1278 is Phe, Tyr, Met, His, Ile, Leu Val, Ala, or Gly
  SITE (1280)..(1280): Xaa at position 1280 is Val, Ala, Gly, Leu, or Ile
  SITE (1297)..(1297): Xaa at position 1297 is Val, Ala, Gly, Leu, or Ile
  SITE (1317)..(1317): Xaa at position 1317 is Tyr, Phe, Met, His, Ile, Leu Val, Ala, or Gly
  SITE (1319)..(1319): Xaa at position 1319 is Val, Ala, Gly, Leu, or Ile
  SITE (1321)..(1321): Xaa at position 1321 is Tyr, Phe, Met, His, Ile, Leu Val, Ala, or Gly
  SITE (1329)..(1329): Xaa at position 1329 is His, Phe, Tyr, Lys, Arg, Gly Ser, Thr, Ala, Val, Leu, Ile, Asn, Met, or Gln
  SITE (1331)..(1331): Xaa at position 1331 is Val, Ala, Gly, Leu, or Ile
  SITE (1333)..(1333): Xaa at position 1333 is Val, Ala, Gly, Leu, or Ile
  SITE (1347)..(1347): Xaa at position 1347 is Val, Ala, Gly, Leu, or Ile
  SITE (1358)..(1358): Xaa at position 1358 is Val, Ala, Gly, Leu, or Ile
  SITE (1376)..(1376): Xaa at position 1376 is Phe, Tyr, Met, His, Ile, Leu Val, Ala, or Gly
  SITE (1378)..(1378): Xaa at position 1378 is Val, Ala, Gly, Leu, or Ile
  SITE (1383)..(1383): Xaa at position 1383 is Ala, Gly, or Pro
  SITE (1412)..(1412): Xaa at position 1412 is Val, Ala, Gly, Leu, or Ile
  SITE (1414)..(1414): Xaa at position 1414 is Tyr, Phe, Met, His, Ile, Leu Val, Ala, or Gly
  SITE (1422)..(1422): Xaa at position 1422 is Tyr, Phe, Met, His, Ile, Leu Val, Ala, or Gly
  SITE (1424)..(1424): Xaa at position 1424 is Leu, Ala, Val, Gly, or Ile
  SITE (1426)..(1426): Xaa at position 1426 is Val, Ala, Gly, Leu, or Ile
  SITE (1433)..(1433): Xaa at position 1433 is Val, Ala, Gly, Leu, or Ile
  SITE (1440)..(1440): Xaa at position 1440 is Val, Ala, Gly, Leu, or Ile
  SITE (1451)..(1451): Xaa at position 1451 is Val, Ala, Gly, Leu, or Ile
  SITE (1463)..(1463): Xaa at position 1463 is Val, Ala, Gly, Leu, or Ile
  SITE (1473)..(1473): Xaa at position 1473 is Val, Ala, Gly, Leu, or Ile
  SITE (1478)..(1478): Xaa at position 1478 is Ala, Gly, or Pro
  SITE (1487)..(1487): Xaa at position 1487 is Val, Ala, Gly, Leu, or Ile
  SITE (1509)..(1509): Xaa at position 1509 is Val, Ala, Gly, Leu, or Ile
  SITE (1521)..(1521): Xaa at position 1521 is Ile, Ala, Val, Leu, or Gly
  SITE (1523)..(1523): Xaa at position 1523 is Val, Ala, Gly, Leu, or Ile
  SITE (1525)..(1525): Xaa at position 1525 is Tyr, Phe, Met, His, Ile, Leu Val, Ala, or Gly
  SITE (1530)..(1530): Xaa at position 1530 is Val, Ala, Gly, Leu, or Ile
  SITE (1537)..(1537): Xaa at position 1537 is Val, Ala, Gly, Leu, or Ile
  SITE (1539)..(1539): Xaa at position 1539 is Val, Ala, Gly, Leu, or Ile
  SITE (1548)..(1548): Xaa at position 1548 is Val, Ala, Gly, Leu, or Ile
  SITE (1560)..(1560): Xaa at position 1560 is Val, Ala, Gly, Leu, or Ile
  SITE (1562)..(1562): Xaa at position 1562 is Ala, Gly, or Pro
  SITE (1568)..(1568): Xaa at position 1568 is Phe, Tyr, Met, His, Ile, Leu Val, Ala, or Gly
  SITE (1570)..(1570): Xaa at position 1570 is Ile, Ala, Val, Leu, or Gly
  SITE (1572)..(1572): Xaa at position 1572 is Ala, Gly, or Pro
  SITE (1575)..(1575): Xaa at position 1575 is Ala, Gly, or Pro
  SITE (1584)..(1584): Xaa at position 1584 is Ile, Ala, Val, Leu, or Gly
  SITE (1606)..(1606): Xaa at position 1606 is Val, Ala, Gly, Leu, or Ile
  SITE (1608)..(1608): Xaa at position 1608 is Tyr, Phe, Met, His, Ile, Leu Val, Ala, or Gly
  SITE (1616)..(1616): Xaa at position 1616 is Tyr, Phe, Met, His, Ile, Leu Val, Ala, or Gly
  SITE (1618)..(1618): Xaa at position 1618 is Ile, Ala, Val, Leu, or Gly
  SITE (1620)..(1620): Xaa at position 1620 is Ile, Ala, Val, Leu, or Gly
  SITE (1622)..(1622): Xaa at position 1622 is Tyr, Phe, Met, His, Ile, Leu Val, Ala, or Gly
  SITE (1627)..(1627): Xaa at position 1627 is Ile, Ala, Val, Leu, or Gly
  SITE (1634)..(1634): Xaa at position 1634 is Val, Ala, Gly, Leu, or Ile
  SITE (1636)..(1636): Xaa at position 1636 is Ala, Gly, or Pro
  SITE (1642)..(1642): Xaa at position 1642 is Ala, Gly, or Pro
  SITE (1645)..(1645): Xaa at position 1645 is Cys, Ala, Val, Gly, Ser, or Thr
  SITE (1672)..(1672): Xaa at position 1672 is Ile, Ala, Val, Leu, or Gly
  SITE (1674)..(1674): Xaa at position 1674 is Val, Ala, Gly, Leu, or Ile
  SITE (1679)..(1679): Xaa at position 1679 is Ala, Gly, or Pro
  SITE (1684)..(1684): Xaa at position 1684 is Val, Ala, Gly, Leu, or Ile
  SITE (1688)..(1688): Xaa at position 1688 is Val, Ala, Gly, Leu, or Ile
  SITE (1710)..(1710): Xaa at position 1710 is Ile, Ala, Val, Leu, or Gly
  SITE (1714)..(1714): Xaa at position 1714 is Ala, Gly, or Pro
  SITE (1720)..(1720): Xaa at position 1720 is Tyr, Phe, Met, His, Ile, Leu Val, Ala, or Gly
  SITE (1722)..(1722): Xaa at position 1722 is Ile, Ala, Val, Leu, or Gly
  SITE (1724)..(1724): Xaa at position 1724 is Val, Ala, Gly, Leu, or Ile
  SITE (1731)..(1731): Xaa at position 1731 is Val, Ala, Gly, Leu, or Ile
  SITE (1738)..(1738): Xaa at position 1738 is Val, Ala, Gly, Leu, or Ile
  SITE (1740)..(1740): Xaa at position 1740 is Ala, Gly, or Pro
  SITE (1791)..(1791): Xaa at position 1791 is Phe, Tyr, Met, His, Ile, Leu Val, Ala, or Gly
  SITE (1795)..(1795): Xaa at position 1795 is Ile, Ala, Val, Leu, or Gly
  SITE (1799)..(1799): Xaa at position 1799 is Ile, Ala, Val, Leu, or Gly
  SITE (1808)..(1808): Xaa at position 1808 is Val, Ala, Gly, Leu, or Ile
  SITE (1828)..(1828): Xaa at position 1828 is Val, Ala, Gly, Leu, or Ile
  SITE (1830)..(1830): Xaa at position 1830 is Val, Ala, Gly, Leu, or Ile
  SITE (1840)..(1840): Xaa at position 1840 is His, Phe, Tyr, Lys, Arg, Gly Ser, Thr, Ala, Val, Leu, Ile, Asn, Met, or Gln
  SITE (1842)..(1842): Xaa at position 1842 is Met, Ile, Leu, Val, Ala, or Gly
  SITE (1844)..(1844): Xaa at position 1844 is Ile, Ala, Val, Leu, or Gly
  SITE (1851)..(1851): Xaa at position 1851 is Ile, Ala, Val, Leu, or Gly
  SITE (1856)..(1856): Xaa at position 1856 is Leu, Ala, Val, Gly, or Ile
  SITE (1858)..(1858): Xaa at position 1858 is Phe, Tyr, Met, His, Ile, Leu Val, Ala, or Gly
  SITE (1860)..(1860): Xaa at position 1860 is Val, Ala, Gly, Leu, or Ile
  SITE (1868)..(1868): Xaa at position 1868 is Val, Ala, Gly, Leu, or Ile
  SITE (1870)..(1870): Xaa at position 1870 is Ala, Gly, or Pro
  SITE (1875)..(1875): Xaa at position 1875 is Leu, Ala, Val, Gly, or Ile
  SITE (1886)..(1886): Xaa at position 1886 is Phe, Tyr, Met, His, Ile, Leu Val, Ala, or Gly
  SITE (1888)..(1888): Xaa at position 1888 is Val, Ala, Gly, Leu, or Ile
  SITE (1902)..(1902): Xaa at position 1902 is Ile, Ala, Val, Leu, or Gly
  SITE (1922)..(1922): Xaa at position 1922 is Val, Ala, Gly, Leu, or Ile
  SITE (1924)..(1924): Xaa at position 1924 is Tyr, Phe, Met, His, Ile, Leu Val, Ala, or Gly
  SITE (1932)..(1932): Xaa at position 1932 is Tyr, Phe, Met, His, Ile, Leu Val, Ala, or Gly
  SITE (1934)..(1934): Xaa at position 1934 is Ile, Ala, Val, Leu, or Gly
  SITE (1936)..(1936): Xaa at position 1936 is Val, Ala, Gly, Leu, or Ile
  SITE (1943)..(1943): Xaa at position 1943 is Val, Ala, Gly, Leu, or Ile
  SITE (1948)..(1948): Xaa at position 1948 is Phe, Tyr, Met, His, Ile, Leu Val, Ala, or Gly
  SITE (1950)..(1950): Xaa at position 1950 is Ala, Gly, or Pro
  SITE (1952)..(1952): Xaa at position 1952 is Val, Ala, Gly, Leu, or Ile
  SITE (1987)..(1987): Xaa at position 1987 is Val, Ala, Gly, Leu, or Ile
  SITE (2009)..(2009): Xaa at position 2009 is Ile, Ala, Val, Leu, or Gly
  SITE (2011)..(2011): Xaa at position 2011 is Phe, Tyr, Met, His, Ile, Leu Val, Ala, or Gly
  SITE (2019)..(2019): Xaa at position 2019 is His, Phe, Tyr, Lys, Arg, Gly Ser, Thr, Ala, Val, Leu, Ile, Asn, Met, or Gln
  SITE (2021)..(2021): Xaa at position 2021 is Val, Ala, Gly, Leu, or Ile
  SITE (2023)..(2023): Xaa at position 2023 is Val, Ala, Gly, Leu, or Ile
  SITE (2039)..(2039): Xaa at position 2039 is Ile, Ala, Val, Leu, or Gly
  SITE (2047)..(2047): Xaa at position 2047 is Ala, Gly, or Pro
  SITE (2050)..(2050): Xaa at position 2050 is Val, Ala, Gly, Leu, or Ile
  SITE (2057)..(2057): Xaa at position 2057 is Leu, Ala, Val, Gly, or Ile
  SITE (2068)..(2068): Xaa at position 2068 is Phe, Tyr, Met, His, Ile, Leu Val, Ala, or Gly
  SITE (2070)..(2070): Xaa at position 2070 is Ile, Ala, Val, Leu, or Gly
  SITE (2075)..(2075): Xaa at position 2075 is Ala, Gly, or Pro
  SITE (2080)..(2080): Xaa at position 2080 is Leu, Ala, Val, Gly, or Ile
  SITE (2082)..(2082): Xaa at position 2082 is Leu, Ala, Val, Gly, or Ile
  SITE (2084)..(2084): Xaa at position 2084 is Ile, Ala, Val, Leu, or Gly
  SITE (2104)..(2104): Xaa at position 2104 is Val, Ala, Gly, Leu, or Ile
  SITE (2106)..(2106): Xaa at position 2106 is Tyr, Phe, Met, His, Ile, Leu Val, Ala, or Gly
  SITE (2114)..(2114): Xaa at position 2114 is Tyr, Phe, Met, His, Ile, Leu Val, Ala, or Gly
  SITE (2116)..(2116): Xaa at position 2116 is Ile, Ala, Val, Leu, or Gly
  SITE (2118)..(2118): Xaa at position 2118 is Ile, Ala, Val, Leu, or Gly
  SITE (2120)..(2120): Xaa at position 2120 is Phe, Tyr, Met, His, Ile, Leu Val, Ala, or Gly
  SITE (2125)..(2125): Xaa at position 2125 is Val, Ala, Gly, Leu, or Ile
  SITE (2132)..(2132): Xaa at position 2132 is Val, Ala, Gly, Leu, or Ile
  SITE (2134)..(2134): Xaa at position 2134 is Val, Ala, Gly, Leu, or Ile
  SITE (2176)..(2176): Xaa at position 2176 is Ala, Gly, or Pro
  SITE (2178)..(2178): Xaa at position 2178 is Val, Ala, Gly, Leu, or Ile
  SITE (2198)..(2198): Xaa at position 2198 is Tyr, Phe, Met, His, Ile, Leu Val, Ala, or Gly
  SITE (2200)..(2200): Xaa at position 2200 is Ile, Ala, Val, Leu, or Gly
  SITE (2210)..(2210): Xaa at position 2210 is His, Phe, Tyr, Lys, Arg, Gly Ser, Thr, Ala, Val, Leu, Ile, Asn, Met, or Gln
  SITE (2212)..(2212): Xaa at position 2212 is Val, Ala, Gly, Leu, or Ile
  SITE (2214)..(2214): Xaa at position 2214 is Val, Ala, Gly, Leu, or Ile
  SITE (2230)..(2230): Xaa at position 2230 is Val, Ala, Gly, Leu, or Ile
  SITE (2238)..(2238): Xaa at position 2238 is Ala, Gly, or Pro
  SITE (2241)..(2241): Xaa at position 2241 is Val, Ala, Gly, Leu, or Ile
  SITE (2257)..(2257): Xaa at position 2257 is Ala, Gly, or Pro
  SITE (2259)..(2259): Xaa at position 2259 is Phe, Tyr, Met, His, Ile, Leu Val, Ala, or Gly
  SITE (2261)..(2261): Xaa at position 2261 is Ile, Ala, Val, Leu, or Gly
  SITE (2268)..(2268): Xaa at position 2268 is Ala, Gly, or Pro
  SITE (2273)..(2273): Xaa at position 2273 is Ile, Ala, Val, Leu, or Gly
  SITE (2275)..(2275): Xaa at position 2275 is Val, Ala, Gly, Leu, or Ile
  SITE (2295)..(2295): Xaa at position 2295 is Val, Ala, Gly, Leu, or Ile
  SITE (2297)..(2297): Xaa at position 2297 is Tyr, Phe, Met, His, Ile, Leu Val, Ala, or Gly
  SITE (2299)..(2299): Xaa at position 2299 is Val, Ala, Gly, Leu, or Ile
  SITE (2305)..(2305): Xaa at position 2305 is Tyr, Phe, Met, His, Ile, Leu Val, Ala, or Gly
  SITE (2307)..(2307): Xaa at position 2307 is Val, Ala, Gly, Leu, or Ile
  SITE (2309)..(2309): Xaa at position 2309 is Val, Ala, Gly, Leu, or Ile
  SITE (2311)..(2311): Xaa at position 2311 is Phe, Tyr, Met, His, Ile, Leu Val, Ala, or Gly
  SITE (2316)..(2316): Xaa at position 2316 is Ile, Ala, Val, Leu, or Gly
  SITE (2323)..(2323): Xaa at position 2323 is Val, Ala, Gly, Leu, or Ile
  SITE (2325)..(2325): Xaa at position 2325 is Val, Ala, Gly, Leu, or Ile
  SITE (2326)..(2326): Xaa at position 2326 is Ala, Gly, or Pro
  SITE (2332)..(2332): Xaa at position 2332 is Ala, Gly, or Pro
  SITE (2335)..(2335): Xaa at position 2335 is Leu, Ala, Val, Gly, or Ile
  SITE (2345)..(2345): Xaa at position 2345 is Leu, Ala, Val, Gly, or Ile
  SITE (2355)..(2355): Xaa at position 2355 is Val, Ala, Gly, Leu, or Ile
  SITE (2357)..(2357): Xaa at position 2357 is Leu, Ala, Val, Gly, or Ile
  SITE (2360)..(2360): Xaa at position 2360 is Ala, Gly, or Pro
  SITE (2364)..(2364): Xaa at position 2364 is Ile, Ala, Val, Leu, or Gly
  SITE (2368)..(2368): Xaa at position 2368 is Val, Ala, Gly, Leu, or Ile
  SITE (2390)..(2390): Xaa at position 2390 is Val, Ala, Gly, Leu, or Ile
  SITE (2400)..(2400): Xaa at position 2400 is Tyr, Phe, Met, His, Ile, Leu Val, Ala, or Gly
  SITE (2402)..(2402): Xaa at position 2402 is Ile, Ala, Val, Leu, or Gly
  SITE (2404)..(2404): Xaa at position 2404 is Val, Ala, Gly, Leu, or Ile
  SITE (2406)..(2406): Xaa at position 2406 is Phe, Tyr, Met, His, Ile, Leu Val, Ala, or Gly
  SITE (2418)..(2418): Xaa at position 2418 is Ile, Ala, Val, Leu, or Gly
  SITE (2432)..(2432): Xaa at position 2432 is Val, Ala, Gly, Leu, or Ile
  SITE (2439)..(2439): Xaa at position 2439 is Leu, Ala, Val, Gly, or Ile
  SITE (2450)..(2450): Xaa at position 2450 is Phe, Tyr, Met, His, Ile, Leu Val, Ala, or Gly
  SITE (2452)..(2452): Xaa at position 2452 is Val, Ala, Gly, Leu, or Ile
  SITE (2457)..(2457): Xaa at position 2457 is Ala, Gly, or Pro
  SITE (2485)..(2485): Xaa at position 2485 is Val, Ala, Gly, Leu, or Ile
  SITE (2487)..(2487): Xaa at position 2487 is Tyr, Phe, Met, His, Ile, Leu Val, Ala, or Gly
  SITE (2491)..(2491): Xaa at position 2491 is Ala, Gly, or Pro
  SITE (2495)..(2495): Xaa at position 2495 is Tyr, Phe, Met, His, Ile, Leu Val, Ala, or Gly
  SITE (2497)..(2497): Xaa at position 2497 is Ile, Ala, Val, Leu, or Gly
  SITE (2499)..(2499): Xaa at position 2499 is Ile, Ala, Val, Leu, or Gly
  SITE (2501)..(2501): Xaa at position 2501 is Tyr, Phe, Met, His, Ile, Leu Val, Ala, or Gly
  SITE (2507)..(2507): Xaa at position 2507 is Ile, Ala, Val, Leu, or Gly
  SITE (2514)..(2514): Xaa at position 2514 is Ala, Gly, or Pro
  SITE (2557)..(2557): Xaa at position 2557 is Ala, Gly, or Pro
  SITE (2560)..(2560): Xaa at position 2560 is Val, Ala, Gly, Leu, or Ile
  SITE (2570)..(2570): Xaa at position 2570 is Ala, Gly, or Pro
  SITE (2580)..(2580): Xaa at position 2580 is Val, Ala, Gly, Leu, or Ile
  SITE (2582)..(2582): Xaa at position 2582 is Cys, Ala, Val, Gly, Ser, or Thr
  SITE (2616)..(2616): Xaa at position 2616 is Val, Ala, Gly, Leu, or Ile
  SITE (2618)..(2618): Xaa at position 2618 is Tyr, Phe, Met, His, Ile, Leu Val, Ala, or Gly
  SITE (2620)..(2620): Xaa at position 2620 is Leu, Ala, Val, Gly, or Ile
  SITE (2628)..(2628): Xaa at position 2628 is Leu, Ala, Val, Gly, or Ile
  SITE (2630)..(2630): Xaa at position 2630 is Val, Ala, Gly, Leu, or Ile
  SITE (2632)..(2632): Xaa at position 2632 is Trp, Tyr, Phe, Met, His, Ile Leu, Val, Ala, or Gly
  SITE (2637)..(2637): Xaa at position 2637 is Ile, Ala, Val, Leu, or Gly
  SITE (2644)..(2644): Xaa at position 2644 is Val, Ala, Gly, Leu, or Ile
MSSSHSRAGQSAAGAAPGGGVDTRDAEMPATEKDLAEDAPWKKIQQNTXTRWXNEHXKCVSKRXANXQTDXSDGLRXXAXXEVLSQKKMHRKHNQRPTFRQMQLENXSXXXEXXDRESIKLVSIDSKAXVDGNLKLXXGXXWTXXLHYSXSMPMWDEEEDEEAKKQTPKQRXLGWXQNKXPQLPXTNXSRDXQSGRXXGXXXDSCXPGLXPDWDSWDASKPVTNXREXXQQXDDWXGXPQXXTPEEXVDPNVDEHSXXTXXSQXPKAKLKPGAPLRPKLNPKKXRAYGPGIEPTGNMVKKRXEFTXETRSXGQGEVLXYVEDPAGHQEEAKVTANNDKNRTFSXWYVPEVTGTXKXTXLXAGQHXAKSPFEXYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGXRVKETXDFKXYTKGXGSGELKVTXKGPKGEERVKQKDLGDGVYGXEXYPMVPGTXIXTXTWGGQNXGRSPFEXKVGTECGNQKVRAWGPGLEGGVVGKSXDXXXEAIGDDVGTLGFSVEGPSQAKIECDDKGDGSCDXRXWPQEAGEXXVHXLCNSEDXRLSPFMXDIRDAPQDFHPDRXKARGPGLEKTGVAVNKPAEFTXDAKHGGKAPLRVQVQDNEGCPVEALVKDNGNGTYSCSYVPRKPVKXTXMXSWGGVSIPNSPFRXNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKXKAFGPGLQGGSAGSPARXTXDTKGXGTGGLGLTVEGPCEAQLECLDNGDGTCSXSXVPTEPGDXNXNXLFADTHXPGSPFKXHXVPCFDASKXKXSGPGLERATAGEVGQXQXDCSSXGSAELTIEXCSEAGLPAEVYIQDHGDGTHTXTXIPLCPGAXTXTXKXGGQPVPNFPSKXQVEPAVDTSGXQCYGPGIEGQGXFREATTEXSXDARALTQTGGPHVKARXANPSGNLTETYVQDRGDGMXKXEXTPYEEGLXSXDXTYDGSPVPSSPFQXPVTEGCDPSRXRVHGPGIQSGTTNKPNKXTXETRGXGTGGLGLAVEGPSEAKMSCMDNKDGSCSXEXIPYEAGTXSXNXTYGGHQXPGSPFKXPVHDVTDASKXKCSGPGLSPGMXRANLPQSFQXDTSKXGVAPLQVKXQGPKGLVEPVDVVDNADGTQTXNYVPSREGPYSXSXLXGDEEXPRSPFKXKXLPTHDASKXKASGPGLNTTGXPXSLPVEXTXDXKDXGEGLLAVQXTDPEGKPKKTHIQDNHDGTYTXAXVPDVTGRXTXLXKXGGDEXPFSPYRXRXVPTGDXSKXTVTVSIGGHGLGAGIGPTIQIGEETVXTXDTKAXGKGKXTCTXCTPDGSEVDVDVVENEDGTFDXFYTXPQPGKXVXCXRFGGEHXPNSPFQXTXLAGDQPSVQPPLRSQQLAPQYTYAQGGQQTWAPERPLVGVNGLDVTSLRPXDLVXPFTXKKGEITGEXRMPSGKVAQPTITDNKDGTXTXRYAPSEAGLXEXDXRYDNMHXPGSPXQXYXDYVNCGHXTXYGPGXTHGVVNKPATXTXNTKDAGEGGLSLAXEGPSKAEISCTDNQDGTCSXSXLPVLPGDXSXLXKYNEQHXPGSPXTXRXTGDDSMRMSHLKVGSAADIPINISETDLSLLTATXVPPSGREEPCLLKRLRNGHVGXSXVPKETGEXLXHXKKNGQHVASSPIPVVXSQSEIGDXSRXRVSGQGXHEGHTFEPAEXIXDTRDXGYGGXSXSXEGPSKVDINTEDLEDGTCRXTXCPTEPGNXIXNXKXADQHXPGSPFSXKXTGEGRVKESITRRRRAPSVANVGSHCDLSLKIPEISIQDMTXQXTSPSGKTHEAEIVEGENHTXCXRFVPAEMGTXTXSXKYKGQHVPGSPFQFTXGPLGEGGXHKXRAGGPGLERAEAGVPXEXSXWTREAGXGGLAXAXEGPSKAEISFEDRKDGSCGXAXVXQEPGDXEXSXKXNEEHXPDSPFVXPXXSPSGDXRRXTVSSLQESGXKVNQPASFAXSXNGXKGAXDAKXHSPSGALEECYVTEIDQDKYAXRFIPRENGVXLXDXKXNGTHIPGSPFKXRVGEPGHGGDPGLXSAYGAGXEGGVTGNPAEXVXNTSNXGAGALSVTIDGPSKVKMDCQECPEGYRXTXTPMXPGSXLXSXKXGGPYHXGGSPFKXKVTGPRLVSNHSLHETSSVFVDSLTKATCAPQHGAPGPGPADXSKXVAKGLGLSKXYVGQKSSFTXDXSKAGNNMLLVGVHGPRTPCEEILVKHVGSRLYSXSXLXKDKGEYTXVXKXGDEHXPGSPYRXVVP

SEQ ID NO: 389 - protein, 2839 aa, Homo sapiens
  SITE (1592)..(1592): Xaa at position 1592 is Ile, Ala, Val, Leu, or Gly
  SITE (1605)..(1605): Xaa at position 1605 is Ile, Ala, Val, Leu, or Gly
  SITE (1606)..(1606): Xaa at position 1606 is Phe, Tyr, Met, His, Ile, Leu Val, Ala, or Gly
  SITE (1607)..(1607): Xaa at position 1607 is Tyr, Phe, Met, His, Ile, Leu Val, Ala, or Gly
  SITE (1609)..(1609): Xaa at position 1609 is Val, Ala, Gly, Leu, or Ile
  SITE (1613)..(1613): Xaa at position 1613 is Phe, Tyr, Met, His, Ile, Leu Val, Ala, or Gly
  SITE (1623)..(1623): Xaa at position 1623 is Leu, Ala, Val, Gly, or Ile
  SITE (1642)..(1642): Xaa at position 1642 is Val, Ala, Gly, Leu, or Ile
  SITE (1670)..(1670): Xaa at position 1670 is Ala, Gly, or Pro
  SITE (1680)..(1680): Xaa at position 1680 is Tyr, Phe, Met, His, Ile, Leu Val, Ala, or Gly
  SITE (1715)..(1715): Xaa at position 1715 is Leu, Ala, Val, Gly, or Ile
  SITE (1719)..(1719): Xaa at position 1719 is Ile, Ala, Val, Leu, or Gly
  SITE (1743)..(1743): Xaa at position 1743 is Ala, Gly, or Pro
  SITE (1755)..(1755): Xaa at position 1755 is Ile, Ala, Val, Leu, or Gly
  SITE (1761)..(1761): Xaa at position 1761 is Ala, Gly, or Pro
  SITE (1762)..(1762): Xaa at position 1762 is Val, Ala, Gly, Leu, or Ile
  SITE (1772)..(1772): Xaa at position 1772 is Val, Ala, Gly, Leu, or Ile
  SITE (1785)..(1785): Xaa at position 1785 is Ala, Gly, or Pro
  SITE (1788)..(1788): Xaa at position 1788 is Ile, Ala, Val, Leu, or Gly
  SITE (1799)..(1799): Xaa at position 1799 is Phe, Tyr, Met, His, Ile, Leu Val, Ala, or Gly
  SITE (1801)..(1801): Xaa at position 1801 is Leu, Ala, Val, Gly, or Ile
  SITE (1803)..(1803): Xaa at position 1803 is Ile, Ala, Val, Leu, or Gly
  SITE (1812)..(1812): Xaa at position 1812 is Phe, Tyr, Met, His, Ile, Leu Val, Ala, or Gly
  SITE (1817)..(1817): Xaa at position 1817 is Cys, Ala, Val, Gly, Ser, or Thr
  SITE (1820)..(1820): Xaa at position 1820 is Ile, Ala, Val, Leu, or Gly
  SITE (1824)..(1824): Xaa at position 1824 is Ile, Ala, Val, Leu, or Gly
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSXFYQAGTSKAGNPXXXYXARRXKTGQINGDLXIYHVLLTLKPYYAKPYEIXVDLTHTGPSNRFKTDFLSKWFVVFPGFXYDNVSAVYIXNCNSWVREYTKYHERLLTGLKGSKRLVFIDCPGKXAEHXEHEQQKLPAATLALEEDLKVFHNXLKLAHKDTKVSXKVGSTXXQVTSAERTKXLGQSVFLNDIYYXSEXEEICLVDENQXTXTXANQGTPLTXMHQEXEAXVQSXIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 390 - protein, 1286 aa, Homo sapiens
  SITE (64)..(64): Xaa at position 64 is Ala, Gly, or Pro
  SITE (81)..(81): Xaa at position 81 is Met, Ile, Leu, Val, Ala, or Gly
  SITE (109)..(109): Xaa at position 109 is Leu, Ala, Val, Gly, or Ile
  SITE (113)..(113): Xaa at position 113 is Met, Ile, Leu, Val, Ala, or Gly
  SITE (120)..(120): Xaa at position 120 is Tyr, Phe, Met, His, Ile, Leu, Val Ala, or Gly
  SITE (127)..(127): Xaa at position 127 is Val, Ala, Gly, Leu, or Ile
  SITE (131)..(131): Xaa at position 131 is Ala, Gly, or Pro
  SITE (137)..(137): Xaa at position 137 is Phe, Tyr, Met, His, Ile, Leu, Val Ala, or Gly
  SITE (141)..(141): Xaa at position 141 is Ala, Gly, or Pro
  SITE (142)..(142): Xaa at position 142 is Ala, Gly, or Pro
  SITE (146)..(146): Xaa at position 146 is Ile, Ala, Val, Leu, or Gly
  SITE (149)..(149): Xaa at position 149 is Ile, Ala, Val, Leu, or Gly
  SITE (153)..(153): Xaa at position 153 is Phe, Tyr, Met, His, Ile, Leu, Val Ala, or Gly
  SITE (154)..(154): Xaa at position 154 is Phe, Tyr, Met, His, Ile, Leu, Val Ala, or Gly
  SITE (156)..(156): Xaa at position 156 is Ala, Gly, or Pro
  SITE (157)..(157): Xaa at position 157 is Ile, Ala, Val, Leu, or Gly
  SITE (158)..(158): Xaa at position 158 is Leu, Ala, Val, Gly, or Ile
  SITE (162)..(162): Xaa at position 162 is Ile, Ala, Val, Leu, or Gly
  SITE (173)..(173): Xaa at position 173 is Leu, Ala, Val, Gly, or Ile
  SITE (177)..(177): Xaa at position 177 is Leu, Ala, Val, Gly, or Ile
  SITE (181)..(181): Xaa at position 181 is Ile, Ala, Val, Leu, or Gly
  SITE (184)..(184): Xaa at position 184 is Ile, Ala, Val, Leu, or Gly
  SITE (188)..(188): Xaa at position 188 is Ile, Ala, Val, Leu, or Gly
  SITE (200)..(200): Xaa at position 200 is Ala, Gly, or Pro
  SITE (208)..(208): Xaa at position 208 is Val, Ala, Gly, Leu, or Ile
  SITE (216)..(216): Xaa at position 216 is Leu, Ala, Val, Gly, or Ile
  SITE (220)..(220): Xaa at position 220 is Ile, Ala, Val, Leu, or Gly
  SITE (235)..(235): Xaa at position 235 is Ala, Gly, or Pro
  SITE (252)..(252): Xaa at position 252 is Ala, Gly, or Pro
  SITE (256)..(256): Xaa at position 256 is Ala, Gly, or Pro
  SITE (259)..(259): Xaa at position 259 is Ala, Gly, or Pro
  SITE (262)..(262): Xaa at position 262 is Ala, Gly, or Pro
  SITE (266)..(266): Xaa at position 266 is Val, Ala, Gly, Leu, or Ile
  SITE (268)..(268): Xaa at position 268 is Ala, Gly, or Pro
  SITE (269)..(269): Xaa at position 269 is Phe, Tyr, Met, His, Ile, Leu, Val Ala, or Gly
  SITE (279)..(279): Xaa at position 279 is Tyr, Phe, Met, His, Ile, Leu, Val Ala, or Gly
  SITE (283)..(283): Xaa at position 283 is Leu, Ala, Val, Gly, or Ile
  SITE (286)..(286): Xaa at position 286 is Ala, Gly, or Pro
  SITE (294)..(294): Xaa at position 294 is Ala, Gly, or Pro
  SITE (303)..(303): Xaa at position 303 is Ile, Ala, Val, Leu, or Gly
  SITE (304)..(304): Xaa at position 304 is Ala, Gly, or Pro
  SITE (310)..(310): Xaa at position 310 is Ala, Gly, or Pro
  SITE (313)..(313): Xaa at position 313 is Ala, Gly, or Pro
  SITE (315)..(315): Xaa at position 315 is Ala, Gly, or Pro
  SITE (316)..(316): Xaa at position 316 is Phe, Tyr, Met, His, Ile, Leu, Val Ala, or Gly
  SITE (334)..(334): Xaa at position 334 is Met, Ile, Leu, Val, Ala, or Gly
  SITE (336)..(336): Xaa at position 336 is Val, Ala, Gly, Leu, or Ile
  SITE (337)..(337): Xaa at position 337 is Phe, Tyr, Met, His, Ile, Leu, Val Ala, or Gly
  SITE (340)..(340): Xaa at position 340 is Ile, Ala, Val, Leu, or Gly
  SITE (350)..(350): Xaa at position 350 is Ala, Gly, or Pro
  SITE (360)..(360): Xaa at position 360 is Ala, Gly, or Pro
  SITE (364)..(364): Xaa at position 364 is Ala, Gly, or Pro
  SITE (367)..(367): Xaa at position 367 is Ile, Ala, Val, Leu, or Gly
  SITE (371)..(371): Xaa at position 371 is Ile, Ala, Val, Leu, or Gly
  SITE (377)..(377): Xaa at position 377 is Ile, Ala, Val, Leu, or Gly
  SITE (394)..(394): Xaa at position 394 is Leu, Ala, Val, Gly, or Ile
  SITE (399)..(399): Xaa at position 399 is Val, Ala, Gly, Leu, or Ile
  SITE (412)..(412): Xaa at position 412 is Leu, Ala, Val, Gly, or Ile
  SITE (415)..(415): Xaa at position 415 is Leu, Ala, Val, Gly, or Ile
  SITE (419)..(419): Xaa at position 419 is Val, Ala, Gly, Leu, or Ile
  SITE (425)..(425): Xaa at position 425 is Val, Ala, Gly, Leu, or Ile
  SITE (426)..(426): Xaa at position 426 is Ala, Gly, or Pro
  SITE (427)..(427): Xaa at position 427 is Leu, Ala, Val, Gly, or Ile
  SITE (428)..(428): Xaa at position 428 is Val, Ala, Gly, Leu, or Ile
  SITE (433)..(433): Xaa at position 433 is Cys, Ala, Val, Gly, Ser, or Thr
  SITE (441)..(441): Xaa at position 441 is Leu, Ala, Val, Gly, or Ile
  SITE (442)..(442): Xaa at position 442 is Ile, Ala, Val, Leu, or Gly
  SITE (453)..(453): Xaa at position 453 is Ile, Ala, Val, Leu, or Gly
  SITE (460)..(460): Xaa at position 460 is Ile, Ala, Val, Leu, or Gly
  SITE (463)..(463): Xaa at position 463 is Phe, Tyr, Met, His, Ile, Leu, Val Ala, or Gly
  SITE (465)..(465): Xaa at position 465 is Val, Ala, Gly, Leu, or Ile
  SITE (468)..(468): Xaa at position 468 is Leu, Ala, Val, Gly, or Ile
  SITE (472)..(472): Xaa at position 472 is Ile, Ala, Val, Leu, or Gly
  SITE (475)..(475): Xaa at position 475 is Val, Ala, Gly, Leu, or Ile
  SITE (481)..(481): Xaa at position 481 is Leu, Ala, Val, Gly, or Ile
  SITE (482)..(482): Xaa at position 482 is Phe, Tyr, Met, His, Ile, Leu, Val Ala, or Gly
  SITE (486)..(486): Xaa at position 486 is Ile, Ala, Val, Leu, or Gly
  SITE (490)..(490): Xaa at position 490 is Ile, Ala, Val, Leu, or Gly
  SITE (502)..(502): Xaa at position 502 is Ile, Ala, Val, Leu, or Gly
  SITE (506)..(506): Xaa at position 506 is Val, Ala, Gly, Leu, or Ile
  SITE (509)..(509): Xaa at position 509 is Ala, Gly, or Pro
  SITE (511)..(511): Xaa at position 511 is Ala, Gly, or Pro
  SITE (515)..(515): Xaa at position 515 is Ile, Ala, Val, Leu, or Gly
  SITE (526)..(526): Xaa at position 526 is Val, Ala, Gly, Leu, or Ile
  SITE (541)..(541): Xaa at position 541 is Ile, Ala, Val, Leu, or Gly
  SITE (542)..(542): Xaa at position 542 is Ala, Gly, or Pro
  SITE (543)..(543): Xaa at position 543 is Ile, Ala, Val, Leu, or Gly
  SITE (544)..(544): Xaa at position 544 is Ala, Gly, or Pro
  SITE (546)..(546): Xaa at position 546 is Ala, Gly, or Pro
  SITE (553)..(553): Xaa at position 553 is Ile, Ala, Val, Leu, or Gly
  SITE (555)..(555): Xaa at position 555 is Leu, Ala, Val, Gly, or Ile
  SITE (556)..(556): Xaa at position 556 is Leu, Ala, Val, Gly, or Ile
  SITE (559)..(559): Xaa at position 559 is Ala, Gly, or Pro
  SITE (571)..(571): Xaa at position 571 is Val, Ala, Gly, Leu, or Ile
  SITE (574)..(574): Xaa at position 574 is Ala, Gly, or Pro
  SITE (575)..(575): Xaa at position 575 is Leu, Ala, Val, Gly, or Ile
  SITE (578)..(578): Xaa at position 578 is Ala, Gly, or Pro
  SITE (585)..(585): Xaa at position 585 is Ile, Ala, Val, Leu, or Gly
  SITE (587)..(587): Xaa at position 587 is Ile, Ala, Val, Leu, or Gly
  SITE (594)..(594): Xaa at position 594 is Val, Ala, Gly, Leu, or Ile
  SITE (600)..(600): Xaa at position 600 is Ile, Ala, Val, Leu, or Gly
  SITE (601)..(601): Xaa at position 601 is Ala, Gly, or Pro
  SITE (603)..(603): Xaa at position 603 is Phe, Tyr, Met, His, Ile, Leu, Val Ala, or Gly
  SITE (617)..(617): Xaa at position 617 is Leu, Ala, Val, Gly, or Ile
  SITE (624)..(624): Xaa at position 624 is Tyr, Phe, Met, His, Ile, Leu, Val Ala, or Gly
  SITE (700)..(700): Xaa at position 700 is Val, Ala, Gly, Leu, or Ile
  SITE (717)..(717): Xaa at position 717 is Cys, Ala, Val, Gly, Ser, or Thr
  SITE (718)..(718): Xaa at position 718 is Ala, Gly, or Pro
  SITE (735)..(735): Xaa at position 735 is Ile, Ala, Val, Leu, or Gly
  SITE (736)..(736): Xaa at position 736 is Ile, Ala, Val, Leu, or Gly
  SITE (753)..(753): Xaa at position 753 is Ile, Ala, Val, Leu, or Gly
  SITE (757)..(757): Xaa at position 757 is Ile, Ala, Val, Leu, or Gly
  SITE (758)..(758): Xaa at position 758 is Phe, Tyr, Met, His, Ile, Leu, Val Ala, or Gly
  SITE (761)..(761): Xaa at position 761 is Leu, Ala, Val, Gly, or Ile
  SITE (779)..(779): Xaa at position 779 is Ala, Gly, or Pro
  SITE (783)..(783): Xaa at position 783 is Leu, Ala, Val, Gly, or Ile
  SITE (787)..(787): Xaa at position 787 is Leu, Ala, Val, Gly, or Ile
  SITE (791)..(791): Xaa at position 791 is Ala, Gly, or Pro
  SITE (792)..(792): Xaa at position 792 is Phe, Tyr, Met, His, Ile, Leu, Val Ala, or Gly
  SITE (795)..(795): Xaa at position 795 is Met, Ile, Leu, Val, Ala, or Gly
  SITE (796)..(796): Xaa at position 796 is Leu, Ala, Val, Gly, or Ile
  SITE (817)..(817): Xaa at position 817 is Leu, Ala, Val, Gly, or Ile
  SITE (821)..(821): Xaa at position 821 is Ala, Gly, or Pro
  SITE (824)..(824): Xaa at position 824 is Val, Ala, Gly, Leu, or Ile
  SITE (827)..(827): Xaa at position 827 is Ala, Gly, or Pro
  SITE (833)..(833): Xaa at position 833 is Ala, Gly, or Pro
  SITE (840)..(840): Xaa at position 840 is Ala, Gly, or Pro
  SITE (856)..(856): Xaa at position 856 is Leu, Ala, Val, Gly, or Ile
  SITE (896)..(896): Xaa at position 896 is Ala, Gly, or Pro
  SITE (899)..(899): Xaa at position 899 is Ala, Gly, or Pro
  SITE (900)..(900): Xaa at position 900 is Ile, Ala, Val, Leu, or Gly
  SITE (903)..(903): Xaa at position 903 is Ile, Ala, Val, Leu, or Gly
  SITE (906)..(906): Xaa at position 906 is Val, Ala, Gly, Leu, or Ile
  SITE (915)..(915): Xaa at position 915 is Phe, Tyr, Met, His, Ile, Leu, Val Ala, or Gly
  SITE (934)..(934): Xaa at position 934 is Ala, Gly, or Pro
  SITE (955)..(955): Xaa at position 955 is Cys, Ala, Val, Gly, Ser, or Thr
  SITE (960)..(960): Xaa at position 960 is Ala, Gly, or Pro
  SITE (975)..(975): Xaa at position 975 is Leu, Ala, Val, Gly, or Ile
  SITE (976)..(976): Xaa at position 976 is Val, Ala, Gly, Leu, or Ile
  SITE (982)..(982): Xaa at position 982 is Phe, Tyr, Met, His, Ile, Leu, Val Ala, or Gly
  SITE (1000)..(1000): Xaa at position 1000 is Ala, Gly, or Pro
  SITE (1004)..(1004): Xaa at position 1004 is Ala, Gly, or Pro
  SITE (1006)..(1006): Xaa at position 1006 is His, Phe, Tyr, Lys, Arg, Gly Ser, Thr, Ala, Val, Leu, Ile, Asn, Met, or Gln
  SITE (1007)..(1007): Xaa at position 1007 is Leu, Ala, Val, Gly, or Ile
  SITE (1034)..(1034): Xaa at position 1034 is Ile, Ala, Val, Leu, or Gly
  SITE (1036)..(1036): Xaa at position 1036 is Phe, Tyr, Met, His, Ile, Leu Val, Ala, or Gly
  SITE (1039)..(1039): Xaa at position 1039 is Val, Ala, Gly, Leu, or Ile
  SITE (1041)..(1041): Xaa at position 1041 is Phe, Tyr, Met, His, Ile, Leu Val, Ala, or Gly
  SITE (1052)..(1052): Xaa at position 1052 is Leu, Ala, Val, Gly, or Ile
  SITE (1055)..(1055): Xaa at position 1055 is Leu, Ala, Val, Gly, or Ile
  SITE (1059)..(1059): Xaa at position 1059 is Val, Ala, Gly, Leu, or Ile
  SITE (1065)..(1065): Xaa at position 1065 is Leu, Ala, Val, Gly, or Ile
  SITE (1066)..(1066): Xaa at position 1066 is Ala, Gly, or Pro
  SITE (1067)..(1067): Xaa at position 1067 is Leu, Ala, Val, Gly, or Ile
  SITE (1068)..(1068): Xaa at position 1068 is Val, Ala, Gly, Leu, or Ile
  SITE (1078)..(1078): Xaa at position 1078 is Val, Ala, Gly, Leu, or Ile
  SITE (1079)..(1079): Xaa at position 1079 is Val, Ala, Gly, Leu, or Ile
  SITE (1081)..(1081): Xaa at position 1081 is Leu, Ala, Val, Gly, or Ile
  SITE (1082)..(1082): Xaa at position 1082 is Leu, Ala, Val, Gly, or Ile
  SITE (1093)..(1093): Xaa at position 1093 is Val, Ala, Gly, Leu, or Ile
  SITE (1107)..(1107): Xaa at position 1107 is Ala, Gly, or Pro
  SITE (1110)..(1110): Xaa at position 1110 is Leu, Ala, Val, Gly, or Ile
  SITE (1112)..(1112): Xaa at position 1112 is Val, Ala, Gly, Leu, or Ile
  SITE (1115)..(1115): Xaa at position 1115 is Leu, Ala, Val, Gly, or Ile
  SITE (1119)..(1119): Xaa at position 1119 is Leu, Ala, Val, Gly, or Ile
  SITE (1122)..(1122): Xaa at position 1122 is Val, Ala, Gly, Leu, or Ile
  SITE (1129)..(1129): Xaa at position 1129 is Phe, Tyr, Met, His, Ile, Leu Val, Ala, or Gly
  SITE (1134)..(1134): Xaa at position 1134 is Ala, Gly, or Pro
  SITE (1137)..(1137): Xaa at position 1137 is Ile, Ala, Val, Leu, or Gly
  SITE (1151)..(1151): Xaa at position 1151 is Ile, Ala, Val, Leu, or Gly
  SITE (1154)..(1154): Xaa at position 1154 is Ala, Gly, or Pro
  SITE (1155)..(1155): Xaa at position 1155 is Ala, Gly, or Pro
  SITE (1158)..(1158): Xaa at position 1158 is Ala, Gly, or Pro
  SITE (1160)..(1160): Xaa at position 1160 is Ile, Ala, Val, Leu, or Gly
  SITE (1171)..(1171): Xaa at position 1171 is Tyr, Phe, Met, His, Ile, Leu Val, Ala, or Gly
  SITE (1175)..(1175): Xaa at position 1175 is Val, Ala, Gly, Leu, or Ile
  SITE (1191)..(1191): Xaa at position 1191 is Ala, Gly, or Pro
  SITE (1192)..(1192): Xaa at position 1192 is Ile, Ala, Val, Leu, or Gly
  SITE (1193)..(1193): Xaa at position 1193 is Ala, Gly, or Pro
  SITE (1196)..(1196): Xaa at position 1196 is Leu, Ala, Val, Gly, or Ile
  SITE (1204)..(1204): Xaa at position 1204 is Leu, Ala, Val, Gly, or Ile
  SITE (1205)..(1205): Xaa at position 1205 is Leu, Ala, Val, Gly, or Ile
  SITE (1220)..(1220): Xaa at position 1220 is Val, Ala, Gly, Leu, or Ile
  SITE (1223)..(1223): Xaa at position 1223 is Ala, Gly, or Pro
  SITE (1233)..(1233): Xaa at position 1233 is Cys, Ala, Val, Gly, Ser, or Thr
  SITE (1234)..(1234): Xaa at position 1234 is Ile, Ala, Val, Leu, or Gly
  SITE (1236)..(1236): Xaa at position 1236 is Ile, Ala, Val, Leu, or Gly
  SITE (1243)..(1243): Xaa at position 1243 is Ile, Ala, Val, Leu, or Gly
  SITE (1249)..(1249): Xaa at position 1249 is Ile, Ala, Val, Leu, or Gly
  SITE (1250)..(1250): Xaa at position 1250 is Val, Ala, Gly, Leu, or Ile
  SITE (1251)..(1251): Xaa at position 1251 is Val, Ala, Gly, Leu, or Ile
  SITE (1266)..(1266): Xaa at position 1266 is Leu, Ala, Val, Gly, or Ile
  SITE (1273)..(1273): Xaa at position 1273 is Tyr, Phe, Met, His, Ile, Leu Val, Ala, or Gly
MDLEAAKNGTAWRPTSAEGDFELGISSKQKRKKTKTVKMIGVLTLFRYSDWQDKLFMSLGTIMXIAHGSGLPLMMIVFGEXTDKFVDTAGNFSFPVNFSLSLLNPGKIXEEEXTRYAYYXSGLGAGXLVAXYIQVSXWTLXXGRQXRKXRQKXXHXXXRQEXGWFDINDTTEXNTRXTDDXSKXSEGXGDKVGMFFQAVXTFFAGFIXGFIRGWKXTLVXMAISPILGLSAAVWXKILSAFSDKELAAYAKXGAVXEEXLGXIRTXIXXGGQNKELERXQKHXENXKEIGIKKXISANISMGXXFLLIYXSYXLXXWYGSTLVISKEYTIGNAXTXXFSXLIGAFSVGQXAPCIDAFANXRGAXYVXFDIXDNNPKXDSFSERGHKPDSIKGNXEFNDXHFSYPSRANVKIXKGXNLKXQSGQTXXXXGSSGXGKSTTVQXXQRLYDPDEGTXNIDGQDXRNXNXNYXREIXGVXSQEPVXXSTTXAENXCYGRGNVTMDEXKKAXKEXNXYEFXMKLPQKFDTLXGERGAQLSGGQKQRXXXXRXLVRNPKXLXXDEXTSALDTESEAEXQAXXDKXREGRTTXVXAHRLSTXRNADVXXGXEDGVIVEQGSHSEXMKKEGVXFKLVNMQTSGSQIQSEEFELNDEKAATRMAPNGWKSRLFRHSTQKNLKNSQMCQKSLDVETDGLEANVPPVSFLKXLKLNKTEWPYFVVGTVXXIANGGLQPAFSVIFSEXXAIFGPGDDAVKQQKCNXFSLXXLFXGIISFFTFFLQGFTFGKXGEIXTRRXRSMXXKAXXRQDMSWFDDHKNSTGALSTRXATDXAQXQGXTGTRLXLIAQNIXNLGTGIIISFIYGWQXTLLLLAVVPIIAVSGIVEMKLLAGNAKRDKKELEAAGKIXTEXXENXRTXVSLTQERKXESMYVEKLYGPYRNSVQKXHIYGITFSISQAFMYFSYAGXFRFGXYLIVNGHMRFRDVIXXFSAIVXGAVALGHASSFAPDYAKXKLSXAXXFMLFERQPLIDSYSEEGLKPDKFEGNXTXNEXVXNYPTRANVPVXQGXSLEXKKGQTXXXXGSSGCGKSTXXQXXERFYDPLAGTXFVDFGFQLLDGQEXKKXNXQWXRAQXGIXSQEPILXDCSIXENXAYGDNSRVVSQDEXVSXXKAXNXHPFIETLPHKXETRXGDKGTQLSGGQKQRIXXXRAXIRQPQILXXDEATSALDTESEKVXQEXLDKAREGRTXXVXAHRLSTXQNADLXXXFQNGRVKEHGTHQQXLAQKGIXFSMVSVQAGTQNL

SEQ ID NO: 391 - protein, 790 aa, Homo sapiens
  SITE (10)..(10): Xaa at position 10 is Leu, Ala, Val, Gly, or Ile
  SITE (18)..(18): Xaa at position 18 is Ala, Gly, or Pro
  SITE (21)..(21): Xaa at position 21 is Ile, Ala, Val, Leu, or Gly
  SITE (37)..(37): Xaa at position 37 is Ile, Ala, Val, Leu, or Gly
  SITE (38)..(38): Xaa at position 38 is His, Phe, Tyr, Lys, Arg, Gly, Ser Thr, Ala, Val, Leu, Ile, Asn, Met, or Gln
  SITE (39)..(39): Xaa at position 39 is His, Phe, Tyr, Lys, Arg, Gly, Ser Thr, Ala, Val, Leu, Ile, Asn, Met, or Gln
  SITE (40)..(40): Xaa at position 40 is Phe, Tyr, Met, His, Ile, Leu, Val Ala, or Gly
  SITE (43)..(43): Xaa at position 43 is Met, Ile, Leu, Val, Ala, or Gly
  SITE (44)..(44): Xaa at position 44 is His, Phe, Tyr, Lys, Arg, Gly, Ser Thr, Ala, Val, Leu, Ile, Asn, Met, or Gln
  SITE (48)..(48): Xaa at position 48 is Leu, Ala, Val, Gly, or Ile
  SITE (51)..(51): Xaa at position 51 is Phe, Tyr, Met, His, Ile, Leu, Val Ala, or Gly
  SITE (64)..(64): Xaa at position 64 is Ile, Ala, Val, Leu, or Gly
  SITE (67)..(67): Xaa at position 67 is Ala, Gly, or Pro
  SITE (68)..(68): Xaa at position 68 is Leu, Ala, Val, Gly, or Ile
  SITE (77)..(77): Xaa at position 77 is Leu, Ala, Val, Gly, or Ile
  SITE (83)..(83): Xaa at position 83 is Leu, Ala, Val, Gly, or Ile
  SITE (94)..(94): Xaa at position 94 is Ala, Gly, or Pro
  SITE (104)..(104): Xaa at position 104 is Leu, Ala, Val, Gly, or Ile
  SITE (105)..(105): Xaa at position 105 is Met, Ile, Leu, Val, Ala, or Gly
  SITE (106)..(106): Xaa at position 106 is His, Phe, Tyr, Lys, Arg, Gly, Ser Thr, Ala, Val, Leu, Ile, Asn, Met, or Gln
  SITE (107)..(107): Xaa at position 107 is Ala, Gly, or Pro
  SITE (111)..(111): Xaa at position 111 is Tyr, Phe, Met, His, Ile, Leu, Val Ala, or Gly
  SITE (112)..(112): Xaa at position 112 is Met, Ile, Leu, Val, Ala, or Gly
  SITE (113)..(113): Xaa at position 113 is Trp, Tyr, Phe, Met, His, Ile, Leu Val, Ala, or Gly
  SITE (115)..(115): Xaa at position 115 is Val, Ala, Gly, Leu, or Ile
  SITE (122)..(122): Xaa at position 122 is Leu, Ala, Val, Gly, or Ile
  SITE (125)..(125): Xaa at position 125 is Ala, Gly, or Pro
  SITE (126)..(126): Xaa at position 126 is Leu, Ala, Val, Gly, or Ile
  SITE (138)..(138): Xaa at position 138 is Phe, Tyr, Met, His, Ile, Leu, Val Ala, or Gly
  SITE (175)..(175): Xaa at position 175 is Ala, Gly, or Pro
  SITE (195)..(195): Xaa at position 195 is His, Phe, Tyr, Lys, Arg, Gly, Ser Thr, Ala, Val, Leu, Ile, Asn, Met, or Gln
  SITE (196)..(196): Xaa at position 196 is Ile, Ala, Val, Leu, or Gly
  SITE (197)..(197): Xaa at position 197 is Phe, Tyr, Met, His, Ile, Leu, Val Ala, or Gly
  SITE (198)..(198): Xaa at position 198 is Val, Ala, Gly, Leu, or Ile
  SITE (199)..(199): Xaa at position 199 is Leu, Ala, Val, Gly, or Ile
  SITE (200)..(200): Xaa at position 200 is Cys, Ala, Val, Gly, Ser, or Thr
  SITE (202)..(202): Xaa at position 202 is Ile, Ala, Val, Leu, or Gly
  SITE (203)..(203): Xaa at position 203 is Leu, Ala, Val, Gly, or Ile
  SITE (207)..(207): Xaa at position 207 is Ile, Ala, Val, Leu, or Gly
  SITE (208)..(208): Xaa at position 208 is Ile, Ala, Val, Leu, or Gly
  SITE (209)..(209): Xaa at position 209 is Val, Ala, Gly, Leu, or Ile
  SITE (229)..(229): Xaa at position 229 is Val, Ala, Gly, Leu, or Ile
  SITE (232)..(232): Xaa at position 232 is Ile, Ala, Val, Leu, or Gly
  SITE (233)..(233): Xaa at position 233 is Tyr, Phe, Met, His, Ile, Leu, Val Ala, or Gly
  SITE (234)..(234): Xaa at position 234 is Leu, Ala, Val, Gly, or Ile
  SITE (248)..(248): Xaa at position 248 is Ile, Ala, Val, Leu, or Gly
  SITE (249)..(249): Xaa at position 249 is Val, Ala, Gly, Leu, or Ile
  SITE (250)..(250): Xaa at position 250 is Leu, Ala, Val, Gly, or Ile
  SITE (258)..(258): Xaa at position 258 is Val, Ala, Gly, Leu, or Ile
  SITE (260)..(260): Xaa at position 260 is Leu, Ala, Val, Gly, or Ile
  SITE (261)..(261): Xaa at position 261 is Val, Ala, Gly, Leu, or Ile
  SITE (272)..(272): Xaa at position 272 is Ala, Gly, or Pro
  SITE (273)..(273): Xaa at position 273 is Val, Ala, Gly, Leu, or Ile
  SITE (288)..(288): Xaa at position 288 is Val, Ala, Gly, Leu, or Ile
  SITE (289)..(289): Xaa at position 289 is His, Phe, Tyr, Lys, Arg, Gly, Ser Thr, Ala, Val, Leu, Ile, Asn, Met, or Gln
  SITE (290)..(290): Xaa at position 290 is Phe, Tyr, Met, His, Ile, Leu, Val Ala, or Gly
  SITE (291)..(291): Xaa at position 291 is Leu, Ala, Val, Gly, or Ile
  SITE (302)..(302): Xaa at position 302 is Leu, Ala, Val, Gly, or Ile
  SITE (307)..(307): Xaa at position 307 is Leu, Ala, Val, Gly, or Ile
  SITE (314)..(314): Xaa at position 314 is Val, Ala, Gly, Leu, or Ile
  SITE (325)..(325): Xaa at position 325 is Ile, Ala, Val, Leu, or Gly
  SITE (327)..(327): Xaa at position 327 is Ala, Gly, or Pro
  SITE (328)..(328): Xaa at position 328 is Ala, Gly, or Pro
  SITE (330)..(330): Xaa at position 330 is Leu, Ala, Val, Gly, or Ile
  SITE (339)..(339): Xaa at position 339 is Ile, Ala, Val, Leu, or Gly
  SITE (341)..(341): Xaa at position 341 is Leu, Ala, Val, Gly, or Ile
  SITE (345)..(345): Xaa at position 345 is Tyr, Phe, Met, His, Ile, Leu, Val Ala, or Gly
  SITE (349)..(349): Xaa at position 349 is Val, Ala, Gly, Leu, or Ile
  SITE (404)..(404): Xaa at position 404 is Cys, Ala, Val, Gly, Ser, or Thr
  SITE (624)..(624): Xaa at position 624 is Cys, Ala, Val, Gly, Ser, or Thr
  SITE (779)..(779): Xaa at position 779 is Cys, Ala, Val, Gly, Ser, or Thr
MAEQVLPQAXYLSNMRKXVKXRERTPEDIFKPTNGIXXXXKTXXRYTXEMXRTCQFCPQFREIXHKXXIDRNIQATXESQKKXNWCREVRKLVXLKTNGDGNCXXXXTSQXXXGXQDTDLVXRKXXFSTLKETDTRNXKFRWQLESLKSQEFVETGLCYDTRNWNDEWDNLIKMXSTDTPMARSGLQYNSLEEIXXXXXXNXXRRPXXXISDKMLRSLESGSNFAPLKXGGXXXPLHWPAQECYRYPXXXGYDSHHFXPXXTLKDSGPEIRXXPLVNRDRGRFEDLKXXXXTDPENEMKEKXLKEYXMVIEIPXQGWDHGTTHLXNXXKXDEANLPKEXNXVDDXFELXQHEYKKWQENSEQGRREGHAQNPMEPSVPQLSLMDVKCETPNCPFFMSVNTQPLXHECSERRQKNQNKLPKLNSKPGPEGLPGMALGASRGEAYEPLAWNPEESTGGPHSAPPTAPSPFLFSETTAMKCRSPGCPFTLNVQHNGFCERCHNARQLHASHAPDHTRHLDPGKCQACLQDVTRTFNGICSTCFKRTTAEASSSLSTSLPPSCHQRSKSDPSRLVRSPSPHSCHRAGNDAPAGCLSQAARTPGDRTGTSKCRKAGCVYFGTPENKGFXTLCFIEYRENKHFAAASGKVSPTASRFQNTIPCLGRECGTLGSTMFEGYCQKCFIEAQNQRFHEAKRTEEQLRSSQRRDVPRTTQSTSRPKCARASCKNILACRSEELCMECQHPNQRMGPGAHRGEPAPEDPPKQRCRAPACDHFGNAKCNGYXNECFQFKQMYG

SEQ ID NO: 392 - protein, 273 aa, Homo sapiens
  SITE (40)..(40): Xaa at position 40 is Val, Ala, Gly, Leu, or Ile
  SITE (43)..(43): Xaa at position 43 is Leu, Ala, Val, Gly, or Ile
  SITE (55)..(55): Xaa at position 55 is Leu, Ala, Val, Gly, or Ile
  SITE (70)..(70): Xaa at position 70 is Ile, Ala, Val, Leu, or Gly
  SITE (73)..(73): Xaa at position 73 is Met, Ile, Leu, Val, Ala, or Gly
  SITE (74)..(74): Xaa at position 74 is Val, Ala, Gly, Leu, or Ile
  SITE (77)..(77): Xaa at position 77 is Leu, Ala, Val, Gly, or Ile
  SITE (81)..(81): Xaa at position 81 is Leu, Ala, Val, Gly, or Ile
  SITE (100)..(100): Xaa at position 100 is Ile, Ala, Val, Leu, or Gly
  SITE (101)..(101): Xaa at position 101 is Ile, Ala, Val, Leu, or Gly
  SITE (104)..(104): Xaa at position 104 is Leu, Ala, Val, Gly, or Ile
  SITE (107)..(107): Xaa at position 107 is Ile, Ala, Val, Leu, or Gly
  SITE (108)..(108): Xaa at position 108 is Val, Ala, Gly, Leu, or Ile
  SITE (140)..(140): Xaa at position 140 is Phe, Tyr, Met, His, Ile, Leu, Val Ala, or Gly
  SITE (141)..(141): Xaa at position 141 is Phe, Tyr, Met, His, Ile, Leu, Val Ala, or Gly
  SITE (144)..(144): Xaa at position 144 is Phe, Tyr, Met, His, Ile, Leu, Val Ala, or Gly
MKKTQTWILTCIYLQLLLFNPLVKTEGICRNRVTNNVKDXTKXVANLPKDYMITXKYVPGMDVLPSHCWXSEXXVQXSDSXTDLLDKFSNISEGLSNYSXXDKXVNXXDDLVECVKENSSKDLKKSFKSPEPRLFTPEEXXRIXNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 393 - protein, 976 aa, Homo sapiens
  SITE (81)..(81): Xaa at position 81 is Leu, Ala, Val, Gly, or Ile
  SITE (92)..(92): Xaa at position 92 is Ala, Gly, or Pro
  SITE (95)..(95): Xaa at position 95 is Val, Ala, Gly, Leu, or Ile
  SITE (96)..(96): Xaa at position 96 is His, Phe, Tyr, Lys, Arg, Gly, Ser Thr, Ala, Val, Leu, Ile, Asn, Met, or Gln
  SITE (97)..(97): Xaa at position 97 is Val, Ala, Gly, Leu, or Ile
  SITE (99)..(99): Xaa at position 99 is Leu, Ala, Val, Gly, or Ile
  SITE (101)..(101): Xaa at position 101 is Phe, Tyr, Met, His, Ile, Leu, Val Ala, or Gly
  SITE (103)..(103): Xaa at position 103 is Val, Ala, Gly, Leu, or Ile
  SITE (122)..(122): Xaa at position 122 is Phe, Tyr, Met, His, Ile, Leu, Val Ala, or Gly
  SITE (124)..(124): Xaa at position 124 is Leu, Ala, Val, Gly, or Ile
  SITE (148)..(148): Xaa at position 148 is Val, Ala, Gly, Leu, or Ile
  SITE (181)..(181): Xaa at position 181 is Leu, Ala, Val, Gly, or Ile
  SITE (183)..(183): Xaa at position 183 is Leu, Ala, Val, Gly, or Ile
  SITE (184)..(184): Xaa at position 184 is Ala, Gly, or Pro
  SITE (185)..(185): Xaa at position 185 is Phe, Tyr, Met, His, Ile, Leu, Val Ala, or Gly
  SITE (190)..(190): Xaa at position 190 is Ala, Gly, or Pro
  SITE (192)..(192): Xaa at position 192 is Val, Ala, Gly, Leu, or Ile
  SITE (194)..(194): Xaa at position 194 is Leu, Ala, Val, Gly, or Ile
  SITE (197)..(197): Xaa at position 197 is Val, Ala, Gly, Leu, or Ile
  SITE (199)..(199): Xaa at position 199 is Val, Ala, Gly, Leu, or Ile
MERRWPLGLGLVLLLCAPLPPGARAKEVTLMDTSKAQGELGWLLDPPKDGWSEQQQILNGTPLYMYQDCPMQGRRDTDHWXRSNWIYRGEEXSRXXXEXQXTXRDCKSFPGGAGPLGCKETXNXLYMESDQDVGIQLRRPLFQKVTTXAADQSFTIRDLVSGSVKLNVERCSLGRLTRRGXYXXXHNPGXCXAXVSXRXFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 394 - protein, 194 aa, Homo sapiens
  SITE (69)..(69): Xaa at position 69 is Leu, Ala, Val, Gly, or Ile
  SITE (71)..(71): Xaa at position 71 is Cys, Ala, Val, Gly, Ser, or Thr
  SITE (77)..(77): Xaa at position 77 is Leu, Ala, Val, Gly, or Ile
  SITE (79)..(79): Xaa at position 79 is Ile, Ala, Val, Leu, or Gly
  SITE (85)..(85): Xaa at position 85 is Val, Ala, Gly, Leu, or Ile
  SITE (98)..(98): Xaa at position 98 is Met, Ile, Leu, Val, Ala, or Gly
  SITE (100)..(100): Xaa at position 100 is Ile, Ala, Val, Leu, or Gly
  SITE (108)..(108): Xaa at position 108 is Val, Ala, Gly, Leu, or Ile
  SITE (110)..(110): Xaa at position 110 is Ile, Ala, Val, Leu, or Gly
  SITE (119)..(119): Xaa at position 119 is Leu, Ala, Val, Gly, or Ile
  SITE (120)..(120): Xaa at position 120 is Ala, Gly, or Pro
  SITE (121)..(121): Xaa at position 121 is Met, Ile, Leu, Val, Ala, or Gly
  SITE (137)..(137): Xaa at position 137 is Cys, Ala, Val, Gly, Ser, or Thr
  SITE (139)..(139): Xaa at position 139 is Phe, Tyr, Met, His, Ile, Leu, Val Ala, or Gly
  SITE (151)..(151): Xaa at position 151 is Tyr, Phe, Met, His, Ile, Leu, Val Ala, or Gly
  SITE (165)..(165): Xaa at position 165 is Val, Ala, Gly, Leu, or Ile
  SITE (166)..(166): Xaa at position 166 is Ala, Gly, or Pro
  SITE (167)..(167): Xaa at position 167 is Leu, Ala, Val, Gly, or Ile
  SITE (186)..(186): Xaa at position 186 is Ala, Gly, or Pro
  SITE (188)..(188): Xaa at position 188 is Phe, Tyr, Met, His, Ile, Leu, Val Ala, or Gly
MHKWILTWILPTLLYRSCFHIICLVGTISLACNDMTPEQMATNVNCSSPERHTRSYDYMEGGDIRVRRXFXRTQWYXRXDKRGKXKGTQEMKNNYNIXEXRTVAVGIXAXKGVESEFYXXXNKEGKLYAKKECNEDXNXKELILENHYNTXASAKWTHNGGEMFXXXNQKGIPVRGKKTKKEQKTXHXLPMAIT

SEQ ID NO: 395 - protein, 821 aa, Homo sapiens
  SITE (162)..(162): Xaa at position 162 is Met, Ile, Leu, Val, Ala, or Gly
  SITE (169)..(169): Xaa at position 169 is Val, Ala, Gly, Leu, or Ile
  SITE (175)..(175): Xaa at position 175 is Val, Ala, Gly, Leu, or Ile
  SITE (177)..(177): Xaa at position 177 is Phe, Tyr, Met, His, Ile, Leu, Val Ala, or Gly
  SITE (179)..(179): Xaa at position 179 is Cys, Ala, Val, Gly, Ser, or Thr
  SITE (181)..(181): Xaa at position 181 is Ala, Gly, or Pro
  SITE (198)..(198): Xaa at position 198 is Phe, Tyr, Met, His, Ile, Leu, Val Ala, or Gly
  SITE (216)..(216): Xaa at position 216 is Leu, Ala, Val, Gly, or Ile
  SITE (218)..(218): Xaa at position 218 is Met, Ile, Leu, Val, Ala, or Gly
  SITE (221)..(221): Xaa at position 221 is Val, Ala, Gly, Leu, or Ile
  SITE (229)..(229): Xaa at position 229 is Tyr, Phe, Met, His, Ile, Leu, Val Ala, or Gly
  SITE (231)..(231): Xaa at position 231 is Cys, Ala, Val, Gly, Ser, or Thr
  SITE (233)..(233): Xaa at position 233 is Val, Ala, Gly, Leu, or Ile
  SITE (244)..(244): Xaa at position 244 is Tyr, Phe, Met, His, Ile, Leu, Val Ala, or Gly
  SITE (246)..(246): Xaa at position 246 is Leu, Ala, Val, Gly, or Ile
  SITE (276)..(276): Xaa at position 276 is Phe, Tyr, Met, His, Ile, Leu, Val Ala, or Gly
  SITE (278)..(278): Xaa at position 278 is Cys, Ala, Val, Gly, Ser, or Thr
  SITE (290)..(290): Xaa at position 290 is Trp, Tyr, Phe, Met, His, Ile, Leu Val, Ala, or Gly
  SITE (324)..(324): Xaa at position 324 is Ile, Ala, Val, Leu, or Gly
  SITE (342)..(342): Xaa at position 342 is Cys, Ala, Val, Gly, Ser, or Thr
  SITE (344)..(344): Xaa at position 344 is Ala, Gly, or Pro
  SITE (355)..(355): Xaa at position 355 is Ala, Gly, or Pro
  SITE (357)..(357): Xaa at position 357 is Leu, Ala, Val, Gly, or Ile
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKXEKRLHAXPAANTXKXRXPXGGNPMPTMRWLKNGKEXKQEHRIGGYKVRNQHWSXIXESXVPSDKGNXTXVXENEYGSINHTXHXDVVERSPHRPILQAGLPANASTVVGGDVEXVXKVYSDAQPHIQXIKHVEKNGSKYGPDGLPYLKVLKAAGVNTTDKEXEVLYIRNVTFEDAGEYTXLXGNSIGISFHSXWXTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 396 - protein, 5038 aa, Homo sapiens
  SITE (13)..(13): Xaa at position 13 is Leu, Ala, Val, Gly, or Ile
  SITE (19)..(19): Xaa at position 19 is Val, Ala, Gly, Leu, or Ile
  SITE (20)..(20): Xaa at position 20 is Val, Ala, Gly, Leu, or Ile
  SITE (21)..(21): Xaa at position 21 is Leu, Ala, Val, Gly, or Ile
  SITE (23)..(23): Xaa at position 23 is Cys, Ala, Val, Gly, Ser, or Thr
  SITE (25)..(25): Xaa at position 25 is Ala, Gly, or Pro
  SITE (34)..(34): Xaa at position 34 is Leu, Ala, Val, Gly, or Ile
  SITE (35)..(35): Xaa at position 35 is Cys, Ala, Val, Gly, Ser, or Thr
  SITE (36)..(36): Xaa at position 36 is Leu, Ala, Val, Gly, or Ile
  SITE (37)..(37): Xaa at position 37 is Ala, Gly, or Pro
  SITE (38)..(38): Xaa at position 38 is Ala, Gly, or Pro
  SITE (63)..(63): Xaa at position 63 is Ile, Ala, Val, Leu, or Gly
  SITE (64)..(64): Xaa at position 64 is Cys, Ala, Val, Gly, Ser, or Thr
  SITE (66)..(66): Xaa at position 66 is Phe, Tyr, Met, His, Ile, Leu, Val Ala, or Gly
  SITE (68)..(68): Xaa at position 68 is Leu, Ala, Val, Gly, or Ile
  SITE (77)..(77): Xaa at position 77 is Leu, Ala, Val, Gly, or Ile
  SITE (100)..(100): Xaa at position 100 is Leu, Ala, Val, Gly, or Ile
  SITE (102)..(102): Xaa at position 102 is Tyr, Phe, Met, His, Ile, Leu, Val Ala, or Gly
  SITE (105)..(105): Xaa at position 105 is Ala, Gly, or Pro
  SITE (106)..(106): Xaa at position 106 is Ile, Ala, Val, Leu, or Gly
  SITE (108)..(108): Xaa at position 108 is Leu, Ala, Val, Gly, or Ile
  SITE (110)..(110): Xaa at position 110 is His, Phe, Tyr, Lys, Arg, Gly, Ser Thr, Ala, Val, Leu, Ile, Asn, Met, or Gln
  SITE (117)..(117): Xaa at position 117 is Leu, Ala, Val, Gly, or Ile
  SITE (131)..(131): Xaa at position 131 is Ala, Gly, or Pro
  SITE (134)..(134): Xaa at position 134 is Val, Ala, Gly, Leu, or Ile
  SITE (136)..(136): Xaa at position 136 is Leu, Ala, Val, Gly, or Ile
  SITE (145)..(145): Xaa at position 145 is Cys, Ala, Val, Gly, Ser, or Thr
  SITE (147)..(147): Xaa at position 147 is Trp, Tyr, Phe, Met, His, Ile, Leu Val, Ala, or Gly
  SITE (149)..(149): Xaa at position 149 is Met, Ile, Leu, Val, Ala, or Gly
  SITE (162)..(162): Xaa at position 162 is Val, Ala, Gly, Leu, or Ile
  SITE (168)..(168): Xaa at position 168 is Ile, Ala, Val, Leu, or Gly
  SITE (170)..(170): Xaa at position 170 is Leu, Ala, Val, Gly, or Ile
  SITE (179)..(179): Xaa at position 179 is Leu, Ala, Val, Gly, or Ile
  SITE (190)..(190): Xaa at position 190 is Val, Ala, Gly, Leu, or Ile
  SITE (192)..(192): Xaa at position 192 is Ala, Gly, or Pro
  SITE (199)..(199): Xaa at position 199 is Trp, Tyr, Phe, Met, His, Ile, Leu Val, Ala, or Gly
  SITE (201)..(201): Xaa at position 201 is Met, Ile, Leu, Val, Ala, or Gly
  SITE (213)..(213): Xaa at position 213 is Val, Ala, Gly, Leu, or Ile
  SITE (219)..(219): Xaa at position 219 is Leu, Ala, Val, Gly, or Ile
  SITE (221)..(221): Xaa at position 221 is Leu, Ala, Val, Gly, or Ile
  SITE (223)..(223): Xaa at position 223 is His, Phe, Tyr, Lys, Arg, Gly, Ser Thr, Ala, Val, Leu, Ile, Asn, Met, or Gln
  SITE (229)..(229): Xaa at position 229 is Cys, Ala, Val, Gly, Ser, or Thr
  SITE (230)..(230): Xaa at position 230 is Leu, Ala, Val, Gly, or Ile
  SITE (232)..(232): Xaa at position 232 is Ile, Ala, Val, Leu, or Gly
  SITE (244)..(244): Xaa at position 244 is Val, Ala, Gly, Leu, or Ile
  SITE (246)..(246): Xaa at position 246 is Tyr, Phe, Met, His, Ile, Leu, Val Ala, or Gly
  SITE (251)..(251): Xaa at position 251 is Val, Ala, Gly, Leu, or Ile
  SITE (255)..(255): Xaa at position 255 is Ala, Gly, or Pro
  SITE (258)..(258): Xaa at position 258 is Leu, Ala, Val, Gly, or Ile
  SITE (259)..(259): Xaa at position 259 is Trp, Tyr, Phe, Met, His, Ile, Leu Val, Ala, or Gly
  SITE (261)..(261): Xaa at position 261 is Leu, Ala, Val, Gly, or Ile
  SITE (273)..(273): Xaa at position 273 is Leu, Ala, Val, Gly, or Ile
  SITE (279)..(279): Xaa at position 279 is Leu, Ala, Val, Gly, or Ile
  SITE (281)..(281): Xaa at position 281 is Val, Ala, Gly, Leu, or Ile
  SITE (283)..(283): Xaa at position 283 is His, Phe, Tyr, Lys, Arg, Gly, Ser Thr, Ala, Val, Leu, Ile, Asn, Met, or Gln
  SITE (284)..(284): Xaa at position 284 is Val, Ala, Gly, Leu, or Ile
  SITE (289)..(289): Xaa at position 289 is Tyr, Phe, Met, His, Ile, Leu, Val Ala, or Gly
  SITE (290)..(290): Xaa at position 290 is Leu, Ala, Val, Gly, or Ile
  SITE (291)..(291): Xaa at position 291 is Ala, Gly, or Pro
  SITE (299)..(299): Xaa at position 299 is Val, Ala, Gly, Leu, or Ile
  SITE (300)..(300): Xaa at position 300 is Val, Ala, Gly, Leu, or Ile
  SITE (306)..(306): Xaa at position 306 is Ala, Gly, or Pro
  SITE (313)..(313): Xaa at position 313 is Phe, Tyr, Met, His, Ile, Leu, Val Ala, or Gly
  SITE (315)..(315): Xaa at position 315 is Phe, Tyr, Met, His, Ile, Leu, Val Ala, or Gly
  SITE (338)..(338): Xaa at position 338 is Ile, Ala, Val, Leu, or Gly
  SITE (345)..(345): Xaa at position 345 is Cys, Ala, Val, Gly, Ser, or Thr
  SITE (347)..(347): Xaa at position 347 is Val, Ala, Gly, Leu, or Ile
  SITE (356)..(356): Xaa at position 356 is Leu, Ala, Val, Gly, or Ile
  SITE (375)..(375): Xaa at position 375 is Ala, Gly, or Pro
  SITE (387)..(387): Xaa at position 387 is Leu, Ala, Val, Gly, or Ile
  SITE (389)..(389): Xaa at position 389 is Leu, Ala, Val, Gly, or Ile
  SITE (399)..(399): Xaa at position 399 is Ala, Gly, or Pro
  SITE (400)..(400): Xaa at position 400 is Ala, Gly, or Pro
  SITE (402)..(402): Xaa at position 402 is Met, Ile, Leu, Val, Ala, or Gly
  SITE (403)..(403): Xaa at position 403 is Ile, Ala, Val, Leu, or Gly
  SITE (410)..(410): Xaa at position 410 is Tyr, Phe, Met, His, Ile, Leu, Val Ala, or Gly
  SITE (413)..(413): Xaa at position 413 is Phe, Tyr, Met, His, Ile, Leu, Val Ala, or Gly
  SITE (435)..(435): Xaa at position 435 is Leu, Ala, Val, Gly, or Ile
  SITE (440)..(440): Xaa at position 440 is Val, Ala, Gly, Leu, or Ile
  SITE (444)..(444): Xaa at position 444 is Leu, Ala, Val, Gly, or Ile
  SITE (447)..(447): Xaa at position 447 is Leu, Ala, Val, Gly, or Ile
  SITE (448)..(448): Xaa at position 448 is Ile, Ala, Val, Leu, or Gly
  SITE (451)..(451): Xaa at position 451 is Phe, Tyr, Met, His, Ile, Leu, Val Ala, or Gly
  SITE (470)..(470): Xaa at position 470 is Leu, Ala, Val, Gly, or Ile
  SITE (476)..(476): Xaa at position 476 is Leu, Ala, Val, Gly, or Ile
  SITE (477)..(477): Xaa at position 477 is Phe, Tyr, Met, His, Ile, Leu, Val Ala, or Gly
  SITE (482)..(482): Xaa at position 482 is Met, Ile, Leu, Val, Ala, or Gly
  SITE (486)..(486): Xaa at position 486 is Val, Ala, Gly, Leu, or Ile
  SITE (489)..(489): Xaa at position 489 is Cys, Ala, Val, Gly, Ser, or Thr
  SITE (490)..(490): Xaa at position 490 is Ile, Ala, Val, Leu, or Gly
  SITE (493)..(493): Xaa at position 493 is Leu, Ala, Val, Gly, or Ile
  SITE (502)..(502): Xaa at position 502 is Phe, Tyr, Met, His, Ile, Leu, Val Ala, or Gly
  SITE (506)..(506): Xaa at position 506 is Ala, Gly, or Pro
  SITE (517)..(517): Xaa at position 517 is Ile, Ala, Val, Leu, or Gly
  SITE (518)..(518): Xaa at position 518 is Val, Ala, Gly, Leu, or Ile
  SITE (521)..(521): Xaa at position 521 is Leu, Ala, Val, Gly, or Ile
  SITE (524)..(524): Xaa at position 524 is Leu, Ala, Val, Gly, or Ile
  SITE (528)..(528): Xaa at position 528 is Leu, Ala, Val, Gly, or Ile
  SITE (685)..(685): Xaa at position 685 is Trp, Tyr, Phe, Met, His, Ile, Leu Val, Ala, or Gly
  SITE (686)..(686): Xaa at position 686 is Ala, Gly, or Pro
  SITE (706)..(706): Xaa at position 706 is Val, Ala, Gly, Leu, or Ile
  SITE (745)..(745): Xaa at position 745 is Cys, Ala, Val, Gly, Ser, or Thr
  SITE (754)..(754): Xaa at position 754 is Ile, Ala, Val, Leu, or Gly
  SITE (779)..(779): Xaa at position 779 is Val, Ala, Gly, Leu, or Ile
  SITE (780)..(780): Xaa at position 780 is Val, Ala, Gly, Leu, or Ile
  SITE (874)..(874): Xaa at position 874 is Ala, Gly, or Pro
  SITE (909)..(909): Xaa at position 909 is Phe, Tyr, Met, His, Ile, Leu, Val Ala, or Gly
  SITE (984)..(984): Xaa at position 984 is Val, Ala, Gly, Leu, or Ile
  SITE (988)..(988): Xaa at position 988 is Ala, Gly, or Pro
  SITE (992)..(992): Xaa at position 992 is His, Phe, Tyr, Lys, Arg, Gly, Ser Thr, Ala, Val, Leu, Ile, Asn, Met, or Gln
  SITE (1038)..(1038): Xaa at position 1038 is Leu, Ala, Val, Gly, or Ile
  SITE (1042)..(1042): Xaa at position 1042 is Val, Ala, Gly, Leu, or Ile
  SITE (1093)..(1093): Xaa at position 1093 is Ala, Gly, or Pro
  SITE (1101)..(1101): Xaa at position 1101 is Val, Ala, Gly, Leu, or Ile
  SITE (1103)..(1103): Xaa at position 1103 is Trp, Tyr, Phe, Met, His, Ile Leu, Val, Ala, or Gly
  SITE (1104)..(1104): Xaa at position 1104 is Ala, Gly, or Pro
  SITE (1114)..(1114): Xaa at position 1114 is Leu, Ala, Val, Gly, or Ile
  SITE (1120)..(1120): Xaa at position 1120 is Ala, Gly, or Pro
  SITE (1122)..(1122): Xaa at position 1122 is Val, Ala, Gly, Leu, or Ile
  SITE (1123)..(1123): Xaa at position 1123 is Phe, Tyr, Met, His, Ile, Leu Val, Ala, or Gly
  SITE (1148)..(1148): Xaa at position 1148 is Val, Ala, Gly, Leu, or Ile
  SITE (1150)..(1150): Xaa at position 1150 is Cys, Ala, Val, Gly, Ser, or Thr
  SITE (1152)..(1152): Xaa at position 1152 is Ile, Ala, Val, Leu, or Gly
  SITE (1159)..(1159): Xaa at position 1159 is Ile, Ala, Val, Leu, or Gly
  SITE (1161)..(1161): Xaa at position 1161 is Phe, Tyr, Met, His, Ile, Leu Val, Ala, or Gly
  SITE (1181)..(1181): Xaa at position 1181 is Ile, Ala, Val, Leu, or Gly
  SITE (1190)..(1190): Xaa at position 1190 is Val, Ala, Gly, Leu, or Ile
  SITE (1449)..(1449): Xaa at position 1449 is Ala, Gly, or Pro
  SITE (1451)..(1451): Xaa at position 1451 is Trp, Tyr, Phe, Met, His, Ile Leu, Val, Ala, or Gly
  SITE (1452)..(1452): Xaa at position 1452 is Val, Ala, Gly, Leu, or Ile
  SITE (1465)..(1465): Xaa at position 1465 is Leu, Ala, Val, Gly, or Ile
  SITE (1471)..(1471): Xaa at position 1471 is Val, Ala, Gly, Leu, or Ile
  SITE (1473)..(1473): Xaa at position 1473 is Val, Ala, Gly, Leu, or Ile
  SITE (1475)..(1475): Xaa at position 1475 is Met, Ile, Leu, Val, Ala, or Gly
  SITE (1515)..(1515): Xaa at position 1515 is Ile, Ala, Val, Leu, or Gly
  SITE (1526)..(1526): Xaa at position 1526 is Met, Ile, Leu, Val, Ala, or Gly
  SITE (1528)..(1528): Xaa at position 1528 is Phe, Tyr, Met, His, Ile, Leu Val, Ala, or Gly
  SITE (1550)..(1550): Xaa at position 1550 is Ala, Gly, or Pro
  SITE (2754)..(2754): Xaa at position 2754 is Phe, Tyr, Met, His, Ile, Leu Val, Ala, or Gly
  SITE (2759)..(2759): Xaa at position 2759 is Ala, Gly, or Pro
  SITE (2761)..(2761): Xaa at position 2761 is Tyr, Phe, Met, His, Ile, Leu Val, Ala, or Gly
  SITE (2763)..(2763): Xaa at position 2763 is His, Phe, Tyr, Lys, Arg, Gly Ser, Thr, Ala, Val, Leu, Ile, Asn, Met, or Gln
  SITE (2767)..(2767): Xaa at position 2767 is Ala, Gly, or Pro
  SITE (2813)..(2813): Xaa at position 2813 is Leu, Ala, Val, Gly, or Ile
  SITE (2815)..(2815): Xaa at position 2815 is Ala, Gly, or Pro
  SITE (2816)..(2816): Xaa at position 2816 is Met, Ile, Leu, Val, Ala, or Gly
  SITE (2862)..(2862): Xaa at position 2862 is Leu, Ala, Val, Gly, or Ile
  SITE (2874)..(2874): Xaa at position 2874 is Met, Ile, Leu, Val, Ala, or Gly
  SITE (2878)..(2878): Xaa at position 2878 is Leu, Ala, Val, Gly, or Ile
  SITE (2879)..(2879): Xaa at position 2879 is Ala, Gly, or Pro
  SITE (2923)..(2923): Xaa at position 2923 is Ala, Gly, or Pro
  SITE (2926)..(2926): Xaa at position 2926 is Leu, Ala, Val, Gly, or Ile
  SITE (2927)..(2927): Xaa at position 2927 is Leu, Ala, Val, Gly, or Ile
  SITE (2930)..(2930): Xaa at position 2930 is Leu, Ala, Val, Gly, or Ile
MGDAEGEDEVQFXRTDDEXXXQXSXTVLKEQLKXXXXXEGFGNRLCFLEPTSNAQNVPPDLAXXCXVXEQSLSVRAXQEMLANTVEAGVESSQGGGHRTXLXGHXXLXRXAHSRMYXSCLTTSRSMTDKLXFDXGXQEDATGEAXWXTXHPASKQRSEGEKXRVGDDXIXVSVSSERYXHLSTASGELQXDXSFMQTLXNXNPICSRCEEGFXTGGHVXRXFXGHMDEXXTXSPADSDDQRRLXYXEGGAXCTHXRSXXRXEPLRISWSGSHXRWGQPXRXRXXTTGQXXXLTEDQGLXXVDASKXHTKATSXCXRISKEKLDVAPKRDVEGMGPPEXKYGESLXFXQHVASGLWXTYAAPDPKALRLGVLKKKXMLHQEGHMDDAXSXTRCQQEESQXXRXXHSTNGLXNQXIKSLDSFSGKPRGSGPPAGTAXPIEGXILSXQDXXIYXEPPSEDLQHEEKQSKLRSXRNRQSXXQEEGXLSMXLNXXDRXNVYTTAAHXAEFXGEEAAESWKEXXNLXYEXLASXIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGXXLTEGYTPYPGAGEGWGGNGXGDDLYSYGFDGLHLWTGHVARPVTSPGQHLLAPEDVISXCLDLSVPSXSFRINGCPVQGVFESFNLDGLFFPXXSFSAGVKVRFLLGGRHGEFKFLPPPGYAPCHEAVLPRERLHLEPIKEYRREGPRGPHLVGPSRCLSHTDFVPCPVDTVQIVLPPHLERIREKLXENIHELWALTRIEQGWTYGPVRDDNKRLHPCLVDXHSLPEPERNYNLQMSGETLKTLLALGCHVGMADEKAEDNLKKTKLPKTYMMSNGYKPAPLDLSHVRLTPAQTTLXDRLXENGXNVWARDRVGQGWSYSAVQDIPARRNPRLVPYRLLDEATKRSNRDSXCQAXRTLLGYGYNIEPPDQEPSQVENQSRCDRVRIFRAEKSYTVQSGRWYFEFEXVTTGEMRXGXXRPELRPDVEXGADELXYXXNGHRGQRWHLGSEPFGRPWQPGDVXGXMXDLTENTXIXTLNGEVLMSDSGSETAFREXEIGDGFLPXCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWXGXXTPDYHQHDMSFDXSKVRVXTXTXGDEQGNVHSSLKCSNCYMVWGGDFVSPGQQGRISHTDLVXGCLVDLATGLXTXTANGKESNTFFQVEPNTKLFPXVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSXINKFXEXTXEKWXFDKIQNNWSYGENIDEELKTHPMLRPYKTFSEKDKEIYRWPIKESXKXXIAWEWTIEKAREGEEEKTEKKKTRKISQSAQTYDPREGYNPQPPDXSAVTLSRELQAXAEQXXENYHNTWGRKKKQELEAKGGGTHPLLVPYDTLTAKEKARDREKXQEXXKFXQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 397 - protein, 1342 aa, Homo sapiens
  SITE (52)..(52): Xaa at position 52 is Leu, Ala, Val, Gly, or Ile
  SITE (53)..(53): Xaa at position 53 is Tyr, Phe, Met, His, Ile, Leu, Val Ala, or Gly
  SITE (56)..(56): Xaa at position 56 is Cys, Ala, Val, Gly, Ser, or Thr
  SITE (58)..(58): Xaa at position 58 is Val, Ala, Gly, Leu, or Ile
  SITE (59)..(59): Xaa at position 59 is Val, Ala, Gly, Leu, or Ile
  SITE (63)..(63): Xaa at position 63 is Leu, Ala, Val, Gly, or Ile
  SITE (65)..(65): Xaa at position 65 is Ile, Ala, Val, Leu, or Gly
  SITE (77)..(77): Xaa at position 77 is Leu, Ala, Val, Gly, or Ile
  SITE (80)..(80): Xaa at position 80 is Ile, Ala, Val, Leu, or Gly
  SITE (83)..(83): Xaa at position 83 is Val, Ala, Gly, Leu, or Ile
  SITE (87)..(87): Xaa at position 87 is Val, Ala, Gly, Leu, or Ile
  SITE (88)..(88): Xaa at position 88 is Leu, Ala, Val, Gly, or Ile
  SITE (89)..(89): Xaa at position 89 is Val, Ala, Gly, Leu, or Ile
  SITE (90)..(90): Xaa at position 90 is Ala, Gly, or Pro
  SITE (94)..(94): Xaa at position 94 is Phe, Tyr, Met, His, Ile, Leu, Val Ala, or Gly
  SITE (97)..(97): Xaa at position 97 is Leu, Ala, Val, Gly, or Ile
  SITE (99)..(99): Xaa at position 99 is Leu, Ala, Val, Gly, or Ile
  SITE (102)..(102): Xaa at position 102 is Leu, Ala, Val, Gly, or Ile
  SITE (104)..(104): Xaa at position 104 is Val, Ala, Gly, Leu, or Ile
  SITE (105)..(105): Xaa at position 105 is Val, Ala, Gly, Leu, or Ile
  SITE (116)..(116): Xaa at position 116 is Ala, Gly, or Pro
  SITE (117)..(117): Xaa at position 117 is Ile, Ala, Val, Leu, or Gly
  SITE (118)..(118): Xaa at position 118 is Phe, Tyr, Met, His, Ile, Leu, Val Ala, or Gly
  SITE (119)..(119): Xaa at position 119 is Val, Ala, Gly, Leu, or Ile
  SITE (121)..(121): Xaa at position 121 is Leu, Ala, Val, Gly, or Ile
  SITE (130)..(130): Xaa at position 130 is Ala, Gly, or Pro
  SITE (131)..(131): Xaa at position 131 is Leu, Ala, Val, Gly, or Ile
  SITE (134)..(134): Xaa at position 134 is Leu, Ala, Val, Gly, or Ile
  SITE (136)..(136): Xaa at position 136 is Leu, Ala, Val, Gly, or Ile
  SITE (139)..(139): Xaa at position 139 is Leu, Ala, Val, Gly, or Ile
  SITE (142)..(142): Xaa at position 142 is Ile, Ala, Val, Leu, or Gly
  SITE (147)..(147): Xaa at position 147 is Val, Ala, Gly, Leu, or Ile
  SITE (149)..(149): Xaa at position 149 is Ile, Ala, Val, Leu, or Gly
  SITE (155)..(155): Xaa at position 155 is Leu, Ala, Val, Gly, or Ile
  SITE (158)..(158): Xaa at position 158 is Met, Ile, Leu, Val, Ala, or Gly
  SITE (161)..(161): Xaa at position 161 is Ile, Ala, Val, Leu, or Gly
  SITE (166)..(166): Xaa at position 166 is Ile, Ala, Val, Leu, or Gly
  SITE (167)..(167): Xaa at position 167 is Val, Ala, Gly, Leu, or Ile
  SITE (190)..(190): Xaa at position 190 is Cys, Ala, Val, Gly, Ser, or Thr
  SITE (194)..(194): Xaa at position 194 is Cys, Ala, Val, Gly, Ser, or Thr
  SITE (195)..(195): Xaa at position 195 is Trp, Tyr, Phe, Met, His, Ile, Leu Val, Ala, or Gly
  SITE (231)..(231): Xaa at position 231 is Cys, Ala, Val, Gly, Ser, or Thr
  SITE (232)..(232): Xaa at position 232 is Ala, Gly, or Pro
  SITE (245)..(245): Xaa at position 245 is Ala, Gly, or Pro
  SITE (255)..(255): Xaa at position 255 is Cys, Ala, Val, Gly, Ser, or Thr
  SITE (259)..(259): Xaa at position 259 is Cys, Ala, Val, Gly, Ser, or Thr
  SITE (295)..(295): Xaa at position 295 is Val, Ala, Gly, Leu, or Ile
  SITE (296)..(296): Xaa at position 296 is Val, Ala, Gly, Leu, or Ile
  SITE (331)..(331): Xaa at position 331 is Cys, Ala, Val, Gly, Ser, or Thr
  SITE (343)..(343): Xaa at position 343 is Val, Ala, Gly, Leu, or Ile
  SITE (348)..(348): Xaa at position 348 is Ile, Ala, Val, Leu, or Gly
  SITE (351)..(351): Xaa at position 351 is Phe, Tyr, Met, His, Ile, Leu, Val Ala, or Gly
  SITE (354)..(354): Xaa at position 354 is Cys, Ala, Val, Gly, Ser, or Thr
  SITE (357)..(357): Xaa at position 357 is Ile, Ala, Val, Leu, or Gly
  SITE (361)..(361): Xaa at position 361 is Leu, Ala, Val, Gly, or Ile
  SITE (363)..(363): Xaa at position 363 is Phe, Tyr, Met, His, Ile, Leu, Val Ala, or Gly
  SITE (376)..(376): Xaa at position 376 is Ile, Ala, Val, Leu, or Gly
  SITE (384)..(384): Xaa at position 384 is Leu, Ala, Val, Gly, or Ile
  SITE (387)..(387): Xaa at position 387 is Phe, Tyr, Met, His, Ile, Leu, Val Ala, or Gly
  SITE (390)..(390): Xaa at position 390 is Val, Ala, Gly, Leu, or Ile
  SITE (393)..(393): Xaa at position 393 is Ile, Ala, Val, Leu, or Gly
  SITE (397)..(397): Xaa at position 397 is Leu, Ala, Val, Gly, or Ile
  SITE (399)..(399): Xaa at position 399 is Ile, Ala, Val, Leu, or Gly
  SITE (409)..(409): Xaa at position 409 is Phe, Tyr, Met, His, Ile, Leu, Val Ala, or Gly
  SITE (411)..(411): Xaa at position 411 is Val, Ala, Gly, Leu, or Ile
  SITE (412)..(412): Xaa at position 412 is Phe, Tyr, Met, His, Ile, Leu, Val Ala, or Gly
  SITE (415)..(415): Xaa at position 415 is Leu, Ala, Val, Gly, or Ile
  SITE (418)..(418): Xaa at position 418 is Ile, Ala, Val, Leu, or Gly
  SITE (428)..(428): Xaa at position 428 is Phe, Tyr, Met, His, Ile, Leu, Val Ala, or Gly
  SITE (430)..(430): Xaa at position 430 is Leu, Ala, Val, Gly, or Ile
  SITE (432)..(432): Xaa at position 432 is Ile, Ala, Val, Leu, or Gly
  SITE (438)..(438): Xaa at position 438 is Val, Ala, Gly, Leu, or Ile
  SITE (441)..(441): Xaa at position 441 is Leu, Ala, Val, Gly, or Ile
  SITE (443)..(443): Xaa at position 443 is Phe, Tyr, Met, His, Ile, Leu, Val Ala, or Gly
  SITE (446)..(446): Xaa at position 446 is Leu, Ala, Val, Gly, or Ile
  SITE (449)..(449): Xaa at position 449 is Ile, Ala, Val, Leu, or Gly
  SITE (454)..(454): Xaa at position 454 is Ile, Ala, Val, Leu, or Gly
  SITE (456)..(456): Xaa at position 456 is Ile, Ala, Val, Leu, or Gly
  SITE (462)..(462): Xaa at position 462 is Leu, Ala, Val, Gly, or Ile
  SITE (463)..(463): Xaa at position 463 is Cys, Ala, Val, Gly, Ser, or Thr
  SITE (465)..(465): Xaa at position 465 is His, Phe, Tyr, Lys, Arg, Gly, Ser Thr, Ala, Val, Leu, Ile, Asn, Met, or Gln
  SITE (473)..(473): Xaa at position 473 is Val, Ala, Gly, Leu, or Ile
  SITE (474)..(474): Xaa at position 474 is Leu, Ala, Val, Gly, or Ile
  SITE (493)..(493): Xaa at position 493 is Cys, Ala, Val, Gly, Ser, or Thr
  SITE (504)..(504): Xaa at position 504 is Cys, Ala, Val, Gly, Ser, or Thr
  SITE (509)..(509): Xaa at position 509 is Cys, Ala, Val, Gly, Ser, or Thr
  SITE (510)..(510): Xaa at position 510 is Trp, Tyr, Phe, Met, His, Ile, Leu Val, Ala, or Gly
  SITE (529)..(529): Xaa at position 529 is Cys, Ala, Val, Gly, Ser, or Thr
  SITE (533)..(533): Xaa at position 533 is Cys, Ala, Val, Gly, Ser, or Thr
  SITE (552)..(552): Xaa at position 552 is Cys, Ala, Val, Gly, Ser, or Thr
MRANDALQVLGLLFSLARGSEVGNSQAVCPGTLNGLSVTGDAENQYQTLYKXXERXEXXMGNXEXVLTGHNADLSFXQWXREXTGYXXXXMNEXSTXPXPNXRXXRGTQVYDGKFXXXXMXNYNTNSSHXXRQXRXTQXTEXLSGGXYXEKNDKXCHXDTXDWRDXXRDRDAEIVVKDNGRSCPPCHEVXKGRXXGPGSEDCQTLTKTICAPQCNGHCFGPNPNQCCHDEXXGGCSGPQDTDCFXCRHFNDSGAXVPRXPQPLVYNKLTFQLEPNPHTKYQYGGVCVASCPHNFXXDQTSCVRACPPDKMEVDKNGLKMCEPCGGLCPKAXEGTGSGSRFQTXDSSNXDGXVNXTKXLGNXDXLITGLNGDPWHKXPALDPEKXNVXRTXREXTGYXNXQSWPPHMHNXSXXSNXTTXGGRSLYNRGXSXLXMKNLNXTSXGXRSXKEXSAGRXYXSANRQXXYXHSLNWTKXXRGPTEERLDIKHNRPRRDXVAEGKVCDPLXSSGGXXGPGPGQCLSCRNYSRGGVXVTHXNFLNGEPREFAHEAECFSXHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 398 - protein, 280 aa, Homo sapiens
  SITE (42)..(42): Xaa at position 42 is Phe, Tyr, Met, His, Ile, Leu, Val Ala, or Gly
  SITE (44)..(44): Xaa at position 44 is Ile, Ala, Val, Leu, or Gly
  SITE (63)..(63): Xaa at position 63 is Val, Ala, Gly, Leu, or Ile
  SITE (72)..(72): Xaa at position 72 is Val, Ala, Gly, Leu, or Ile
  SITE (75)..(75): Xaa at position 75 is Ala, Gly, or Pro
  SITE (76)..(76): Xaa at position 76 is Leu, Ala, Val, Gly, or Ile
  SITE (79)..(79): Xaa at position 79 is Ile, Ala, Val, Leu, or Gly
  SITE (87)..(87): Xaa at position 87 is Leu, Ala, Val, Gly, or Ile
  SITE (101)..(101): Xaa at position 101 is Cys, Ala, Val, Gly, Ser, or Thr
  SITE (103)..(103): Xaa at position 103 is Met, Ile, Leu, Val, Ala, or Gly
  SITE (111)..(111): Xaa at position 111 is Leu, Ala, Val, Gly, or Ile
  SITE (112)..(112): Xaa at position 112 is Ala, Gly, or Pro
  SITE (127)..(127): Xaa at position 127 is Ile, Ala, Val, Leu, or Gly
  SITE (146)..(146): Xaa at position 146 is Phe, Tyr, Met, His, Ile, Leu, Val Ala, or Gly
  SITE (183)..(183): Xaa at position 183 is Leu, Ala, Val, Gly, or Ile
  SITE (190)..(190): Xaa at position 190 is Ala, Gly, or Pro
  SITE (191)..(191): Xaa at position 191 is Cys, Ala, Val, Gly, Ser, or Thr
  SITE (199)..(199): Xaa at position 199 is Tyr, Phe, Met, His, Ile, Leu, Val Ala, or Gly
  SITE (206)..(206): Xaa at position 206 is Tyr, Phe, Met, His, Ile, Leu, Val Ala, or Gly
  SITE (210)..(210): Xaa at position 210 is Ala, Gly, or Pro
  SITE (211)..(211): Xaa at position 211 is Val, Ala, Gly, Leu, or Ile
  SITE (212)..(212): Xaa at position 212 is Leu, Ala, Val, Gly, or Ile
  SITE (215)..(215): Xaa at position 215 is Ala, Gly, or Pro
  SITE (234)..(234): Xaa at position 234 is Leu, Ala, Val, Gly, or Ile
  SITE (240)..(240): Xaa at position 240 is Leu, Ala, Val, Gly, or Ile
  SITE (262)..(262): Xaa at position 262 is Ala, Gly, or Pro
  SITE (263)..(263): Xaa at position 263 is Ile, Ala, Val, Leu, or Gly
  SITE (266)..(266): Xaa at position 266 is Ile, Ala, Val, Leu, or Gly
MAAVVALSLRRRLPATTLGGACLQASRGAQTAAATAPRIKKXAXYRWDPDKAGDKPHMQTYEXDLNKCGPMXLDXXIKXKNEVDSTXTFRRSCREGICGSXAXNINGGNTXXCTRRIDTNLNKVSKXYPLPHMYVIKDLVPDLSNXYAQYKSIEPYLKKKDESQEGKQQYLQSIEEREKLDGXYECILCXXCSTSCPSXWWNGDKXLGPXXXMQXYRWMIDSRDDFTEERLAKXQDPFSXYRCHTIMNCTRTCPKGLNPGKXXAEXKKMMATYKEKKASV

SEQ ID NO: 399 - protein, 4242 aa, Homo sapiens
  SITE (435)..(435): Xaa at position 435 is Cys, Ala, Val, Gly, Ser, or Thr
  SITE (466)..(466): Xaa at position 466 is Cys, Ala, Val, Gly, Ser, or Thr
  SITE (3669)..(3669): Xaa at position 3669 is Leu, Ala, Val, Gly, or Ile
  SITE (3671)..(3671): Xaa at position 3671 is Leu, Ala, Val, Gly, or Ile
  SITE (3679)..(3679): Xaa at position 3679 is Ala, Gly, or Pro
  SITE (3683)..(3683): Xaa at position 3683 is Phe, Tyr, Met, His, Ile, Leu Val, Ala, or Gly
  SITE (3685)..(3685): Xaa at position 3685 is Leu, Ala, Val, Gly, or Ile
  SITE (3716)..(3716): Xaa at position 3716 is Ala, Gly, or Pro
  SITE (3718)..(3718): Xaa at position 3718 is Leu, Ala, Val, Gly, or Ile
  SITE (3729)..(3729): Xaa at position 3729 is Leu, Ala, Val, Gly, or Ile
  SITE (3731)..(3731): Xaa at position 3731 is Leu, Ala, Val, Gly, or Ile
  SITE (3859)..(3859): Xaa at position 3859 is Ala, Gly, or Pro
  SITE (3861)..(3861): Xaa at position 3861 is Leu, Ala, Val, Gly, or Ile
  SITE (3873)..(3873): Xaa at position 3873 is Tyr, Phe, Met, His, Ile, Leu Val, Ala, or Gly
  SITE (3875)..(3875): Xaa at position 3875 is Val, Ala, Gly, Leu, or Ile
  SITE (3877)..(3877): Xaa at position 3877 is Val, Ala, Gly, Leu, or Ile
  SITE (3898)..(3898): Xaa at position 3898 is Leu, Ala, Val, Gly, or Ile
  SITE (3909)..(3909): Xaa at position 3909 is Ala, Gly, or Pro
  SITE (3911)..(3911): Xaa at position 3911 is Val, Ala, Gly, Leu, or Ile
  SITE (3947)..(3947): Xaa at position 3947 is Ala, Gly, or Pro
  SITE (3949)..(3949): Xaa at position 3949 is Leu, Ala, Val, Gly, or Ile
  SITE (3961)..(3961): Xaa at position 3961 is Tyr, Phe, Met, His, Ile, Leu Val, Ala, or Gly
  SITE (3963)..(3963): Xaa at position 3963 is Leu, Ala, Val, Gly, or Ile
  SITE (3977)..(3977): Xaa at position 3977 is Leu, Ala, Val, Gly, or Ile
  SITE (3986)..(3986): Xaa at position 3986 is Leu, Ala, Val, Gly, or Ile
  SITE (3995)..(3995): Xaa at position 3995 is Tyr, Phe, Met, His, Ile, Leu Val, Ala, or Gly
  SITE (3997)..(3997): Xaa at position 3997 is Ala, Gly, or Pro
  SITE (3999)..(3999): Xaa at position 3999 is Leu, Ala, Val, Gly, or Ile
  SITE (4001)..(4001): Xaa at position 4001 is Ala, Gly, or Pro
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRAXPRDCRGRGRCENGVCVCNAGYSGEDCGVRSXPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSXRXNWEAPPGXFDSXLXRFGVPSPSTLEPHPRPLLQRELMVPGTRHSXVXRDLRSGTLYSXTXYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFXVXHWKPPQNPVDTXDXQXTAPGAPPLQAETPGSAVDYPXHDLVLHTNYTXTXRGLRGPNLTSPASITFTTGLEAPRDLEAKEVTPRTXLXTWTEPPVRPAGXLXSFHTPGGQNQEILXPGGITSHQXLGLFPSTSXNXRXQXMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 400 - protein, 829 aa, Homo sapiens
  SITE (116)..(116): Xaa at position 116 is Val, Ala, Gly, Leu, or Ile
  SITE (131)..(131): Xaa at position 131 is Leu, Ala, Val, Gly, or Ile
  SITE (141)..(141): Xaa at position 141 is Ile, Ala, Val, Leu, or Gly
  SITE (157)..(157): Xaa at position 157 is Val, Ala, Gly, Leu, or Ile
  SITE (158)..(158): Xaa at position 158 is Phe, Tyr, Met, His, Ile, Leu, Val Ala, or Gly
  SITE (167)..(167): Xaa at position 167 is Leu, Ala, Val, Gly, or Ile
  SITE (169)..(169): Xaa at position 169 is Leu, Ala, Val, Gly, or Ile
  SITE (173)..(173): Xaa at position 173 is Leu, Ala, Val, Gly, or Ile
  SITE (183)..(183): Xaa at position 183 is Leu, Ala, Val, Gly, or Ile
  SITE (187)..(187): Xaa at position 187 is Ala, Gly, or Pro
  SITE (201)..(201): Xaa at position 201 is Ile, Ala, Val, Leu, or Gly
  SITE (203)..(203): Xaa at position 203 is Ile, Ala, Val, Leu, or Gly
  SITE (224)..(224): Xaa at position 224 is Val, Ala, Gly, Leu, or Ile
  SITE (237)..(237): Xaa at position 237 is Val, Ala, Gly, Leu, or Ile
  SITE (254)..(254): Xaa at position 254 is Ala, Gly, or Pro
  SITE (269)..(269): Xaa at position 269 is Met, Ile, Leu, Val, Ala, or Gly
  SITE (279)..(279): Xaa at position 279 is Ile, Ala, Val, Leu, or Gly
  SITE (281)..(281): Xaa at position 281 is Val, Ala, Gly, Leu, or Ile
  SITE (294)..(294): Xaa at position 294 is Tyr, Phe, Met, His, Ile, Leu, Val Ala, or Gly
  SITE (296)..(296): Xaa at position 296 is Leu, Ala, Val, Gly, or Ile
  SITE (298)..(298): Xaa at position 298 is Ile, Ala, Val, Leu, or Gly
  SITE (300)..(300): Xaa at position 300 is Ala, Gly, or Pro
  SITE (312)..(312): Xaa at position 312 is Ala, Gly, or Pro
  SITE (314)..(314): Xaa at position 314 is Ala, Gly, or Pro
  SITE (316)..(316): Xaa at position 316 is Val, Ala, Gly, Leu, or Ile
  SITE (318)..(318): Xaa at position 318 is Ile, Ala, Val, Leu, or Gly
  SITE (349)..(349): Xaa at position 349 is Leu, Ala, Val, Gly, or Ile
  SITE (390)..(390): Xaa at position 390 is Leu, Ala, Val, Gly, or Ile
  SITE (396)..(396): Xaa at position 396 is Leu, Ala, Val, Gly, or Ile
  SITE (406)..(406): Xaa at position 406 is Leu, Ala, Val, Gly, or Ile
  SITE (408)..(408): Xaa at position 408 is Val, Ala, Gly, Leu, or Ile
  SITE (410)..(410): Xaa at position 410 is Val, Ala, Gly, Leu, or Ile
  SITE (425)..(425): Xaa at position 425 is Ala, Gly, or Pro
  SITE (427)..(427): Xaa at position 427 is Ile, Ala, Val, Leu, or Gly
  SITE (429)..(429): Xaa at position 429 is Val, Ala, Gly, Leu, or Ile
  SITE (462)..(462): Xaa at position 462 is Tyr, Phe, Met, His, Ile, Leu, Val Ala, or Gly
  SITE (495)..(495): Xaa at position 495 is Val, Ala, Gly, Leu, or Ile
  SITE (501)..(501): Xaa at position 501 is Leu, Ala, Val, Gly, or Ile
  SITE (514)..(514): Xaa at position 514 is Tyr, Phe, Met, His, Ile, Leu, Val Ala, or Gly
  SITE (516)..(516): Xaa at position 516 is Val, Ala, Gly, Leu, or Ile
  SITE (518)..(518): Xaa at position 518 is Val, Ala, Gly, Leu, or Ile
  SITE (520)..(520): Xaa at position 520 is Ala, Gly, or Pro
  SITE (534)..(534): Xaa at position 534 is Leu, Ala, Val, Gly, or Ile
  SITE (536)..(536): Xaa at position 536 is Leu, Ala, Val, Gly, or Ile
  SITE (553)..(553): Xaa at position 553 is Ile, Ala, Val, Leu, or Gly
  SITE (565)..(565): Xaa at position 565 is Leu, Ala, Val, Gly, or Ile
  SITE (602)..(602): Xaa at position 602 is Val, Ala, Gly, Leu, or Ile
  SITE (604)..(604): Xaa at position 604 is Leu, Ala, Val, Gly, or Ile
  SITE (617)..(617): Xaa at position 617 is Val, Ala, Gly, Leu, or Ile
  SITE (619)..(619): Xaa at position 619 is Leu, Ala, Val, Gly, or Ile
  SITE (621)..(621): Xaa at position 621 is Leu, Ala, Val, Gly, or Ile
  SITE (633)..(633): Xaa at position 633 is Ile, Ala, Val, Leu, or Gly
  SITE (635)..(635): Xaa at position 635 is Ala, Gly, or Pro
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISXPENGKGPFPQRLNQXKSNKDRDTKXFYSITGPGADSPPEGXXAVEKETGWXLXNKPXDREEIAKYEXFGHXVSENGASVEDPMNXSXIVTDQNDHKPKFTQDTFRGSXLEGVLPGTSVMQXTATDEDDAIYTYNGVVXYSIHSQEPKDPHDLXFTIHRSTGTXSXISSGLDREKVPEXTXTXQXTDMDGDGSTTTXVXVXEXLDANDNAPMFDPQKYEAHVPENAVGHEVQRXTVTDLDAPNSPAWRATYLIMGGDDGDHFTITTHPESNQGIXTTRKGXDFEAKNQHTXYXEXTNEAPFVLKLPTSTXTXVXHVEDVNEAPVFVPPSKVVEVQEGIPTGEPVCVXTAEDPDKENQKISYRILRDPAGWLAMDPDSGQXTAVGTXDREDEQFVRNNIXEXMXLXMDNGSPPTTGTGTXLXTLIDVNDHGPVPEPRQXTICNQSPVRQVXNITDKDLSPHTSPFQAQLTDDSDIYWTAEVNEEGDTXVXSLKKFLKQDTYDXHXSXSDHGNKEQLTVXRXTVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 401 - protein, 178 aa, Homo sapiens
  SITE (41)..(41): Xaa at position 41 is Leu, Ala, Val, Gly, or Ile
  SITE (44)..(44): Xaa at position 44 is Leu, Ala, Val, Gly, or Ile
  SITE (47)..(47): Xaa at position 47 is Ala, Gly, or Pro
  SITE (51)..(51): Xaa at position 51 is Val, Ala, Gly, Leu, or Ile
  SITE (55)..(55): Xaa at position 55 is Phe, Tyr, Met, His, Ile, Leu, Val Ala, or Gly
  SITE (66)..(66): Xaa at position 66 is Leu, Ala, Val, Gly, or Ile
  SITE (70)..(70): Xaa at position 70 is Leu, Ala, Val, Gly, or Ile
  SITE (82)..(82): Xaa at position 82 is Ala, Gly, or Pro
  SITE (83)..(83): Xaa at position 83 is Leu, Ala, Val, Gly, or Ile
  SITE (86)..(86): Xaa at position 86 is Met, Ile, Leu, Val, Ala, or Gly
  SITE (90)..(90): Xaa at position 90 is Tyr, Phe, Met, His, Ile, Leu, Val Ala, or Gly
  SITE (94)..(94): Xaa at position 94 is Val, Ala, Gly, Leu, or Ile
  SITE (98)..(98): Xaa at position 98 is Ala, Gly, or Pro
  SITE (109)..(109): Xaa at position 109 is Val, Ala, Gly, Leu, or Ile
  SITE (112)..(112): Xaa at position 112 is Leu, Ala, Val, Gly, or Ile
  SITE (116)..(116): Xaa at position 116 is Leu, Ala, Val, Gly, or Ile
  SITE (126)..(126): Xaa at position 126 is Cys, Ala, Val, Gly, Ser, or Thr
  SITE (130)..(130): Xaa at position 130 is Leu, Ala, Val, Gly, or Ile
  SITE (139)..(139): Xaa at position 139 is Val, Ala, Gly, Leu, or Ile
  SITE (157)..(157): Xaa at position 157 is Ala, Gly, or Pro
  SITE (158)..(158): Xaa at position 158 is Met, Ile, Leu, Val, Ala, or Gly
  SITE (161)..(161): Xaa at position 161 is Phe, Tyr, Met, His, Ile, Leu, Val Ala, or Gly
  SITE (164)..(164): Xaa at position 164 is Phe, Tyr, Met, His, Ile, Leu, Val Ala, or Gly
  SITE (165)..(165): Xaa at position 165 is Ile, Ala, Val, Leu, or Gly
  SITE (168)..(168): Xaa at position 168 is Ile, Ala, Val, Leu, or Gly
MHSSALLCCLVLLTGVRASPGQGTQSENSCTHFPGNLPNMXRDXRDXFSRXKTFXQMKDQLDNLLXKESXLEDFKGYLGCQXXSEXIQFXLEEXMPQXENQDPDIKAHXNSXGENXKTLRLRLRRXHRFXPCENKSKAXEQVKNAFNKLQEKGIYKXXSEXDIXXNYXEAYMTMKIRN

SEQ ID NO: 402 - protein, 96 aa, Homo sapiens
  SITE (47)..(47): Xaa at position 47 is Ile, Ala, Val, Leu, or Gly
  SITE (62)..(62): Xaa at position 62 is Leu, Ala, Val, Gly, or Ile
  SITE (64)..(64): Xaa at position 64 is Phe, Tyr, Met, His, Ile, Leu, Val Ala, or Gly
  SITE (74)..(74): Xaa at position 74 is Ala, Gly, or Pro
  SITE (81)..(81): Xaa at position 81 is Val, Ala, Gly, Leu, or Ile
MQIITTALVCLLLAGMWPEDVDSKSMQVPFSRCCFSFAEQEIPLRAXLCYRNTSSICSNEGXIXKLKRGKEACXLDTVGWXQRHRKMLRHCPSKRK

SEQ ID NO: 403 - protein, 925 aa, Homo sapiens
  SITE (164)..(164): Xaa at position 164 is Cys, Ala, Val, Gly, Ser, or Thr
  SITE (166)..(166): Xaa at position 166 is Cys, Ala, Val, Gly, Ser, or Thr
  SITE (170)..(170): Xaa at position 170 is Cys, Ala, Val, Gly, Ser, or Thr
  SITE (392)..(392): Xaa at position 392 is Ala, Gly, or Pro
  SITE (507)..(507): Xaa at position 507 is Ile, Ala, Val, Leu, or Gly
  SITE (632)..(632): Xaa at position 632 is Ile, Ala, Val, Leu, or Gly
  SITE (638)..(638): Xaa at position 638 is Phe, Tyr, Met, His, Ile, Leu, Val Ala, or Gly
  SITE (826)..(826): Xaa at position 826 is Leu, Ala, Val, Gly, or Ile
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLXAXSDDXKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKXLQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRXEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSXLPIEDXQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEIXIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 404 - protein, 613 aa, Homo sapiens
  SITE (124)..(124): Xaa at position 124 is Ile, Ala, Val, Leu, or Gly
  SITE (126)..(126): Xaa at position 126 is Ile, Ala, Val, Leu, or Gly
  SITE (138)..(138): Xaa at position 138 is Leu, Ala, Val, Gly, or Ile
  SITE (146)..(146): Xaa at position 146 is Leu, Ala, Val, Gly, or Ile
  SITE (165)..(165): Xaa at position 165 is Phe, Tyr, Met, His, Ile, Leu, Val Ala, or Gly
  SITE (172)..(172): Xaa at position 172 is Phe, Tyr, Met, His, Ile, Leu, Val Ala, or Gly
  SITE (175)..(175): Xaa at position 175 is Ile, Ala, Val, Leu, or Gly
  SITE (179)..(179): Xaa at position 179 is Tyr, Phe, Met, His, Ile, Leu, Val Ala, or Gly
  SITE (191)..(191): Xaa at position 191 is Val, Ala, Gly, Leu, or Ile
  SITE (196)..(196): Xaa at position 196 is Phe, Tyr, Met, His, Ile, Leu, Val Ala, or Gly
  SITE (200)..(200): Xaa at position 200 is Ile, Ala, Val, Leu, or Gly
  SITE (203)..(203): Xaa at position 203 is Tyr, Phe, Met, His, Ile, Leu, Val Ala, or Gly
  SITE (260)..(260): Xaa at position 260 is Ile, Ala, Val, Leu, or Gly
  SITE (445)..(445): Xaa at position 445 is Val, Ala, Gly, Leu, or Ile
  SITE (451)..(451): Xaa at position 451 is Ala, Gly, or Pro
  SITE (452)..(452): Xaa at position 452 is Val, Ala, Gly, Leu, or Ile
  SITE (455)..(455): Xaa at position 455 is Ala, Gly, or Pro
  SITE (470)..(470): Xaa at position 470 is Ala, Gly, or Pro
  SITE (474)..(474): Xaa at position 474 is Ala, Gly, or Pro
  SITE (500)..(500): Xaa at position 500 is Cys, Ala, Val, Gly, Ser, or Thr
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHXNXSGLRFETQLGTXAQFPNTLXGDPAKRLRYFDPLRNEYFXDRNRPSXDGXLYYXQSGGRLRRPVNXSLDVXADEXRFXQLGDEAMERFREDEGFIKEEEKPLPRNEFQRQVWLIFEYPESSGSARAIAIVSVLVXLISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGXILFSSXXYFXEADNQGTHFSSIPDXFWWXVVTMTTVGYGDMRPITVGGKIVGSLXAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 405 - protein, 817 aa, Homo sapiens
  SITE (709)..(709): Xaa at position 709 is Val, Ala, Gly, Leu, or Ile
  SITE (711)..(711): Xaa at position 711 is Ile, Ala, Val, Leu, or Gly
  SITE (721)..(721): Xaa at position 721 is Leu, Ala, Val, Gly, or Ile
  SITE (724)..(724): Xaa at position 724 is Val, Ala, Gly, Leu, or Ile
  SITE (726)..(726): Xaa at position 726 is Phe, Tyr, Met, His, Ile, Leu, Val Ala, or Gly
  SITE (728)..(728): Xaa at position 728 is Leu, Ala, Val, Gly, or Ile
  SITE (744)..(744): Xaa at position 744 is Ile, Ala, Val, Leu, or Gly
MMDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEXQXVFKNPLPVTXTNXVXRXEGSGLQRPKILNVGDXGGNETVTLRQSFVPVRPGPRQLIASLDSPQLSQVHGVIQVDVAPAPGDGGFFSDAGGDSHLGETIPMASRGGA

SEQ ID NO: 406 - protein, 312 aa, Homo sapiens
  SITE (25)..(25): Xaa at position 25 is Tyr, Phe, Met, His, Ile, Leu, Val Ala, or Gly
  SITE (54)..(54): Xaa at position 54 is Ile, Ala, Val, Leu, or Gly
  SITE (56)..(56): Xaa at position 56 is Ile, Ala, Val, Leu, or Gly
  SITE (75)..(75): Xaa at position 75 is Tyr, Phe, Met, His, Ile, Leu, Val Ala, or Gly
  SITE (81)..(81): Xaa at position 81 is Trp, Tyr, Phe, Met, His, Ile, Leu Val, Ala, or Gly
  SITE (83)..(83): Xaa at position 83 is Val, Ala, Gly, Leu, or Ile
  SITE (90)..(90): Xaa at position 90 is Val, Ala, Gly, Leu, or Ile
  SITE (92)..(92): Xaa at position 92 is Met, Ile, Leu, Val, Ala, or Gly
  SITE (94)..(94): Xaa at position 94 is Leu, Ala, Val, Gly, or Ile
  SITE (100)..(100): Xaa at position 100 is Ile, Ala, Val, Leu, or Gly
  SITE (109)..(109): Xaa at position 109 is Tyr, Phe, Met, His, Ile, Leu, Val Ala, or Gly
  SITE (111)..(111): Xaa at position 111 is Ala, Gly, or Pro
  SITE (114)..(114): Xaa at position 114 is Leu, Ala, Val, Gly, or Ile
  SITE (116)..(116): Xaa at position 116 is Leu, Ala, Val, Gly, or Ile
  SITE (118)..(118): Xaa at position 118 is Trp, Tyr, Phe, Met, His, Ile, Leu Val, Ala, or Gly
  SITE (128)..(128): Xaa at position 128 is His, Phe, Tyr, Lys, Arg, Gly, Ser Thr, Ala, Val, Leu, Ile, Asn, Met, or Gln
  SITE (137)..(137): Xaa at position 137 is Met, Ile, Leu, Val, Ala, or Gly
  SITE (139)..(139): Xaa at position 139 is Met, Ile, Leu, Val, Ala, or Gly
  SITE (140)..(140): Xaa at position 140 is His, Phe, Tyr, Lys, Arg, Gly, Ser Thr, Ala, Val, Leu, Ile, Asn, Met, or Gln
  SITE (141)..(141): Xaa at position 141 is Ile, Ala, Val, Leu, or Gly
  SITE (143)..(143): Xaa at position 143 is His, Phe, Tyr, Lys, Arg, Gly, Ser Thr, Ala, Val, Leu, Ile, Asn, Met, or Gln
  SITE (164)..(164): Xaa at position 164 is Ala, Gly, or Pro
  SITE (166)..(166): Xaa at position 166 is Leu, Ala, Val, Gly, or Ile
  SITE (167)..(167): Xaa at position 167 is Ala, Gly, or Pro
  SITE (168)..(168): Xaa at position 168 is Phe, Tyr, Met, His, Ile, Leu, Val Ala, or Gly
  SITE (169)..(169): Xaa at position 169 is Leu, Ala, Val, Gly, or Ile
  SITE (170)..(170): Xaa at position 170 is Val, Ala, Gly, Leu, or Ile
  SITE (180)..(180): Xaa at position 180 is Phe, Tyr, Met, His, Ile, Leu, Val Ala, or Gly
  SITE (187)..(187): Xaa at position 187 is Leu, Ala, Val, Gly, or Ile
  SITE (190)..(190): Xaa at position 190 is Ile, Ala, Val, Leu, or Gly
  SITE (217)..(217): Xaa at position 217 is Tyr, Phe, Met, His, Ile, Leu, Val Ala, or Gly
  SITE (229)..(229): Xaa at position 229 is Cys, Ala, Val, Gly, Ser, or Thr
  SITE (233)..(233): Xaa at position 233 is Val, Ala, Gly, Leu, or Ile
  SITE (237)..(237): Xaa at position 237 is Val, Ala, Gly, Leu, or Ile
  SITE (238)..(238): Xaa at position 238 is Phe, Tyr, Met, His, Ile, Leu, Val Ala, or Gly
  SITE (242)..(242): Xaa at position 242 is Ile, Ala, Val, Leu, or Gly
  SITE (244)..(244): Xaa at position 244 is Leu, Ala, Val, Gly, or Ile
  SITE (252)..(252): Xaa at position 252 is Phe, Tyr, Met, His, Ile, Leu, Val Ala, or Gly
  SITE (256)..(256): Xaa at position 256 is Leu, Ala, Val, Gly, or Ile
  SITE (266)..(266): Xaa at position 266 is Met, Ile, Leu, Val, Ala, or Gly
MRMLLALLALSAARPSASAESHWCXEVQAESSNYPCLVPVKWGGNCQKDRQSPXNXVTTKAKVDKKLGRFFFSGXDKKQTXTXQNNGHSXMXLXENKASXSGGGLPAPXQXKQXHXHXSDLPYKGSEXSLDGEHFAXEXXXVXEKEKGTSRNVKEAQDPEDEIXVXXXXXEAGTQVNEGXQPLVEAXSNXPKPEMSTTMAESSLLDLLPKEEKLRHXFRYLGSLTTPTXDEKXVWTXXREPXQXHREQILAXSQKXYYDKEQTVSXKDNVRPLQQLGQRTVIKSGAPGRPLPWALPALLGPMLACLLAGFLR

SEQ ID NO: 407 - protein, 216 aa, Homo sapiens
  SITE (42)..(42): Xaa at position 42 is Val, Ala, Gly, Leu, or Ile
  SITE (44)..(44): Xaa at position 44 is Val, Ala, Gly, Leu, or Ile
  SITE (46)..(46): Xaa at position 46 is Val, Ala, Gly, Leu, or Ile
  SITE (47)..(47): Xaa at position 47 is Tyr, Phe, Met, His, Ile, Leu, Val Ala, or Gly
  SITE (48)..(48): Xaa at position 48 is Phe, Tyr, Met, His, Ile, Leu, Val Ala, or Gly
  SITE (50)..(50): Xaa at position 50 is Leu, Ala, Val, Gly, or Ile
  SITE (52)..(52): Xaa at position 52 is Ile, Ala, Val, Leu, or Gly
  SITE (60)..(60): Xaa at position 60 is Val, Ala, Gly, Leu, or Ile
  SITE (61)..(61): Xaa at position 61 is Ile, Ala, Val, Leu, or Gly
  SITE (62)..(62): Xaa at position 62 is Phe, Tyr, Met, His, Ile, Leu, Val Ala, or Gly
  SITE (64)..(64): Xaa at position 64 is Leu, Ala, Val, Gly, or Ile
  SITE (65)..(65): Xaa at position 65 is Phe, Tyr, Met, His, Ile, Leu, Val Ala, or Gly
  SITE (69)..(69): Xaa at position 69 is Val, Ala, Gly, Leu, or Ile
  SITE (73)..(73): Xaa at position 73 is Val, Ala, Gly, Leu, or Ile
  SITE (76)..(76): Xaa at position 76 is Phe, Tyr, Met, His, Ile, Leu, Val Ala, or Gly
  SITE (78)..(78): Xaa at position 78 is Ala, Gly, or Pro
  SITE (79)..(79): Xaa at position 79 is Leu, Ala, Val, Gly, or Ile
  SITE (80)..(80): Xaa at position 80 is Ala, Gly, or Pro
  SITE (86)..(86): Xaa at position 86 is Phe, Tyr, Met, His, Ile, Leu, Val Ala, or Gly
  SITE (88)..(88): Xaa at position 88 is Tyr, Phe, Met, His, Ile, Leu, Val Ala, or Gly
  SITE (93)..(93): Xaa at position 93 is Phe, Tyr, Met, His, Ile, Leu, Val Ala, or Gly
  SITE (96)..(96): Xaa at position 96 is Val, Ala, Gly, Leu, or Ile
  SITE (97)..(97): Xaa at position 97 is Ile, Ala, Val, Leu, or Gly
  SITE (101)..(101): Xaa at position 101 is Met, Ile, Leu, Val, Ala, or Gly
  SITE (102)..(102): Xaa at position 102 is Ile, Ala, Val, Leu, or Gly
  SITE (118)..(118): Xaa at position 118 is Ile, Ala, Val, Leu, or Gly
  SITE (123)..(123): Xaa at position 123 is Phe, Tyr, Met, His, Ile, Leu, Val Ala, or Gly
  SITE (130)..(130): Xaa at position 130 is Leu, Ala, Val, Gly, or Ile
  SITE (132)..(132): Xaa at position 132 is His, Phe, Tyr, Lys, Arg, Gly, Ser Thr, Ala, Val, Leu, Ile, Asn, Met, or Gln
  SITE (137)..(137): Xaa at position 137 is Trp, Tyr, Phe, Met, His, Ile, Leu Val, Ala, or Gly
  SITE (138)..(138): Xaa at position 138 is Val, Ala, Gly, Leu, or Ile
  SITE (140)..(140): Xaa at position 140 is Met, Ile, Leu, Val, Ala, or Gly
  SITE (152)..(152): Xaa at position 152 is Phe, Tyr, Met, His, Ile, Leu, Val Ala, or Gly
  SITE (153)..(153): Xaa at position 153 is Phe, Tyr, Met, His, Ile, Leu, Val Ala, or Gly
  SITE (154)..(154): Xaa at position 154 is Ile, Ala, Val, Leu, or Gly
  SITE (167)..(167): Xaa at position 167 is Val, Ala, Gly, Leu, or Ile
  SITE (168)..(168): Xaa at position 168 is Val, Ala, Gly, Leu, or Ile
  SITE (169)..(169): Xaa at position 169 is Phe, Tyr, Met, His, Ile, Leu, Val Ala, or Gly
  SITE (172)..(172): Xaa at position 172 is Val, Ala, Gly, Leu, or Ile
  SITE (178)..(178): Xaa at position 178 is Val, Ala, Gly, Leu, or Ile
  SITE (179)..(179): Xaa at position 179 is Val, Ala, Gly, Leu, or Ile
  SITE (182)..(182): Xaa at position 182 is Val, Ala, Gly, Leu, or Ile
  SITE (194)..(194): Xaa at position 194 is Leu, Ala, Val, Gly, or Ile
  SITE (197)..(197): Xaa at position 197 is Val, Ala, Gly, Leu, or Ile
  SITE (198)..(198): Xaa at position 198 is Ile, Ala, Val, Leu, or Gly
  SITE (199)..(199): Xaa at position 199 is Ile, Ala, Val, Leu, or Gly
  SITE (205)..(205): Xaa at position 205 is Ile, Ala, Val, Leu, or Gly
MLRLSERNMKVLLAAALIAGSVFFLLLPGPSAADEKKKGPKXTXKXXXDXRXGDEDVGRXXXGXXGKTXPKTXDNXVXXXTGEKGXGXKNSKXHRXXKDFXXQGGDFTRGDGTGGKSXYGERXPDENFKXKXYGPGXXSXANAGKDTNGSQXXXTTVKTAWLDGKHXXXGKXLEGMEXXRKXESTKTDSRDKPXKDXXXADCGKXEVEKPFAIAKE

SEQ ID NO: 408 - protein, 457 aa, Homo sapiens
  SITE (65)..(65): Xaa at position 65 is Val, Ala, Gly, Leu, or Ile
  SITE (67)..(67): Xaa at position 67 is Val, Ala, Gly, Leu, or Ile
  SITE (69)..(69): Xaa at position 69 is Cys, Ala, Val, Gly, Ser, or Thr
  SITE (71)..(71): Xaa at position 71 is Ile, Ala, Val, Leu, or Gly
  SITE (73)..(73): Xaa at position 73 is Ile, Ala, Val, Leu, or Gly
  SITE (86)..(86): Xaa at position 86 is Tyr, Phe, Met, His, Ile, Leu, Val Ala, or Gly
  SITE (88)..(88): Xaa at position 88 is Val, Ala, Gly, Leu, or Ile
  SITE (90)..(90): Xaa at position 90 is Ile, Ala, Val, Leu, or Gly
  SITE (92)..(92): Xaa at position 92 is Leu, Ala, Val, Gly, or Ile
  SITE (96)..(96): Xaa at position 96 is Trp, Tyr, Phe, Met, His, Ile, Leu Val, Ala, or Gly
  SITE (101)..(101): Xaa at position 101 is Leu, Ala, Val, Gly, or Ile
  SITE (111)..(111): Xaa at position 111 is Leu, Ala, Val, Gly, or Ile
  SITE (146)..(146): Xaa at position 146 is Leu, Ala, Val, Gly, or Ile
  SITE (148)..(148): Xaa at position 148 is Ile, Ala, Val, Leu, or Gly
  SITE (154)..(154): Xaa at position 154 is Val, Ala, Gly, Leu, or Ile
  SITE (160)..(160): Xaa at position 160 is Ile, Ala, Val, Leu, or Gly
  SITE (162)..(162): Xaa at position 162 is Leu, Ala, Val, Gly, or Ile
  SITE (164)..(164): Xaa at position 164 is Leu, Ala, Val, Gly, or Ile
  SITE (166)..(166): Xaa at position 166 is Cys, Ala, Val, Gly, Ser, or Thr
  SITE (170)..(170): Xaa at position 170 is Leu, Ala, Val, Gly, or Ile
  SITE (173)..(173): Xaa at position 173 is Phe, Tyr, Met, His, Ile, Leu, Val Ala, or Gly
  SITE (180)..(180): Xaa at position 180 is Cys, Ala, Val, Gly, Ser, or Thr
  SITE (182)..(182): Xaa at position 182 is Met, Ile, Leu, Val, Ala, or Gly
  SITE (184)..(184): Xaa at position 184 is Leu, Ala, Val, Gly, or Ile
  SITE (194)..(194): Xaa at position 194 is Leu, Ala, Val, Gly, or Ile
  SITE (196)..(196): Xaa at position 196 is Phe, Tyr, Met, His, Ile, Leu, Val Ala, or Gly
  SITE (237)..(237): Xaa at position 237 is Cys, Ala, Val, Gly, Ser, or Thr
  SITE (238)..(238): Xaa at position 238 is Ile, Ala, Val, Leu, or Gly
  SITE (240)..(240): Xaa at position 240 is Ala, Gly, or Pro
  SITE (242)..(242): Xaa at position 242 is Phe, Tyr, Met, His, Ile, Leu, Val Ala, or Gly
  SITE (244)..(244): Xaa at position 244 is Leu, Ala, Val, Gly, or Ile
MYSFNTLRLYLWETIVFFSLAASKEAEAARSAPKPMSPSDFLDKLMGRTSGYDARIRPNFKGPPXNXSXNXFXNSFGSIAETTMDXRXNXFXRQQXNDPRXAYNEYPDDSXDLDPSMLDSIWKPDLFFANEKGAHFHEITTDNKLXRXSRNGNXLYSIRXTXTXAXPMDXKNXPMDVQTXIXQXESFGYTMNDXIXEWQEQGAVQVADGLTLPQFILKEEKDLRYCTKHYNTGKFTXXEXRXHXERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKSPMLNLFQEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 409 - protein, 1912 aa, Homo sapiens
  SITE (41)..(41): Xaa at position 41 is Ala, Gly, or Pro
  SITE (43)..(43): Xaa at position 43 is Phe, Tyr, Met, His, Ile, Leu, Val Ala, or Gly
  SITE (45)..(45): Xaa at position 45 is Cys, Ala, Val, Gly, Ser, or Thr
  SITE (57)..(57): Xaa at position 57 is Trp, Tyr, Phe, Met, His, Ile, Leu Val, Ala, or Gly
  SITE (69)..(69): Xaa at position 69 is Phe, Tyr, Met, His, Ile, Leu, Val Ala, or Gly
  SITE (81)..(81): Xaa at position 81 is Val, Ala, Gly, Leu, or Ile
  SITE (82)..(82): Xaa at position 82 is Leu, Ala, Val, Gly, or Ile
  SITE (84)..(84): Xaa at position 84 is Ile, Ala, Val, Leu, or Gly
  SITE (87)..(87): Xaa at position 87 is Leu, Ala, Val, Gly, or Ile
  SITE (96)..(96): Xaa at position 96 is Tyr, Phe, Met, His, Ile, Leu, Val Ala, or Gly
  SITE (98)..(98): Xaa at position 98 is Cys, Ala, Val, Gly, Ser, or Thr
  SITE (100)..(100): Xaa at position 100 is Ala, Gly, or Pro
  SITE (113)..(113): Xaa at position 113 is Leu, Ala, Val, Gly, or Ile
  SITE (115)..(115): Xaa at position 115 is Val, Ala, Gly, Leu, or Ile
  SITE (143)..(143): Xaa at position 143 is Ala, Gly, or Pro
  SITE (145)..(145): Xaa at position 145 is Met, Ile, Leu, Val, Ala, or Gly
  SITE (147)..(147): Xaa at position 147 is Cys, Ala, Val, Gly, Ser, or Thr
  SITE (148)..(148): Xaa at position 148 is Ala, Gly, or Pro
  SITE (149)..(149): Xaa at position 149 is Ala, Gly, or Pro
  SITE (159)..(159): Xaa at position 159 is Trp, Tyr, Phe, Met, His, Ile, Leu Val, Ala, or Gly
  SITE (192)..(192): Xaa at position 192 is Leu, Ala, Val, Gly, or Ile
  SITE (194)..(194): Xaa at position 194 is Ile, Ala, Val, Leu, or Gly
  SITE (205)..(205): Xaa at position 205 is Tyr, Phe, Met, His, Ile, Leu, Val Ala, or Gly
  SITE (207)..(207): Xaa at position 207 is Cys, Ala, Val, Gly, Ser, or Thr
  SITE (209)..(209): Xaa at position 209 is Ala, Gly, or Pro
  SITE (221)..(221): Xaa at position 221 is Ala, Gly, or Pro
  SITE (223)..(223): Xaa at position 223 is Leu, Ala, Val, Gly, or Ile
  SITE (255)..(255): Xaa at position 255 is Ile, Ala, Val, Leu, or Gly
  SITE (257)..(257): Xaa at position 257 is Cys, Ala, Val, Gly, Ser, or Thr
  SITE (259)..(259): Xaa at position 259 is Ala, Gly, or Pro
  SITE (267)..(267): Xaa at position 267 is Val, Ala, Gly, Leu, or Ile
  SITE (269)..(269): Xaa at position 269 is Trp, Tyr, Phe, Met, His, Ile, Leu Val, Ala, or Gly
  SITE (294)..(294): Xaa at position 294 is Val, Ala, Gly, Leu, or Ile
  SITE (302)..(302): Xaa at position 302 is Cys, Ala, Val, Gly, Ser, or Thr
  SITE (304)..(304): Xaa at position 304 is Ala, Gly, or Pro
  SITE (315)..(315): Xaa at position 315 is Ala, Gly, or Pro
  SITE (317)..(317): Xaa at position 317 is Ile, Ala, Val, Leu, or Gly
  SITE (339)..(339): Xaa at position 339 is Ile, Ala, Val, Leu, or Gly
  SITE (341)..(341): Xaa at position 341 is Leu, Ala, Val, Gly, or Ile
  SITE (356)..(356): Xaa at position 356 is Ile, Ala, Val, Leu, or Gly
  SITE (373)..(373): Xaa at position 373 is Val, Ala, Gly, Leu, or Ile
  SITE (380)..(380): Xaa at position 380 is Val, Ala, Gly, Leu, or Ile
  SITE (391)..(391): Xaa at position 391 is Phe, Tyr, Met, His, Ile, Leu, Val Ala, or Gly
  SITE (393)..(393): Xaa at position 393 is Val, Ala, Gly, Leu, or Ile
  SITE (394)..(394): Xaa at position 394 is Val, Ala, Gly, Leu, or Ile
  SITE (395)..(395): Xaa at position 395 is Ala, Gly, or Pro
  SITE (434)..(434): Xaa at position 434 is Ile, Ala, Val, Leu, or Gly
  SITE (436)..(436): Xaa at position 436 is Val, Ala, Gly, Leu, or Ile
  SITE (453)..(453): Xaa at position 453 is Val, Ala, Gly, Leu, or Ile
  SITE (463)..(463): Xaa at position 463 is Val, Ala, Gly, Leu, or Ile
  SITE (479)..(479): Xaa at position 479 is Ile, Ala, Val, Leu, or Gly
  SITE (490)..(490): Xaa at position 490 is Val, Ala, Gly, Leu, or Ile
  SITE (492)..(492): Xaa at position 492 is Val, Ala, Gly, Leu, or Ile
  SITE (494)..(494): Xaa at position 494 is Ala, Gly, or Pro
  SITE (532)..(532): Xaa at position 532 is Ile, Ala, Val, Leu, or Gly
  SITE (534)..(534): Xaa at position 534 is Leu, Ala, Val, Gly, or Ile
  SITE (547)..(547): Xaa at position 547 is Tyr, Phe, Met, His, Ile, Leu, Val Ala, or Gly
  SITE (549)..(549): Xaa at position 549 is Leu, Ala, Val, Gly, or Ile
  SITE (564)..(564): Xaa at position 564 is Ile, Ala, Val, Leu, or Gly
  SITE (575)..(575): Xaa at position 575 is Leu, Ala, Val, Gly, or Ile
  SITE (583)..(583): Xaa at position 583 is Phe, Tyr, Met, His, Ile, Leu, Val Ala, or Gly
  SITE (585)..(585): Xaa at position 585 is Leu, Ala, Val, Gly, or Ile
  SITE (586)..(586): Xaa at position 586 is Ala, Gly, or Pro
  SITE (587)..(587): Xaa at position 587 is Ala, Gly, or Pro
  SITE (626)..(626): Xaa at position 626 is Ile, Ala, Val, Leu, or Gly
  SITE (628)..(628): Xaa at position 628 is Val, Ala, Gly, Leu, or Ile
  SITE (647)..(647): Xaa at position 647 is Ile, Ala, Val, Leu, or Gly
  SITE (651)..(651): Xaa at position 651 is Ala, Gly, or Pro
  SITE (674)..(674): Xaa at position 674 is Leu, Ala, Val, Gly, or Ile
  SITE (685)..(685): Xaa at position 685 is Ile, Ala, Val, Leu, or Gly
  SITE (687)..(687): Xaa at position 687 is Val, Ala, Gly, Leu, or Ile
  SITE (689)..(689): Xaa at position 689 is Ala, Gly, or Pro
  SITE (937)..(937): Xaa at position 937 is Leu, Ala, Val, Gly, or Ile
  SITE (956)..(956): Xaa at position 956 is Leu, Ala, Val, Gly, or Ile
  SITE (981)..(981): Xaa at position 981 is Leu, Ala, Val, Gly, or Ile
  SITE (992)..(992): Xaa at position 992 is Val, Ala, Gly, Leu, or Ile
  SITE (994)..(994): Xaa at position 994 is Val, Ala, Gly, Leu, or Ile
  SITE (996)..(996): Xaa at position 996 is Ala, Gly, or Pro
MVHVARLLLLLLTFFLRTDAETPPRFTRTPVDQTGVSGGVXSXIXQATGDPRPKIVXNKKGKKVSNQRXEVIEFDDGSGSXXRXQPXRTPRDEAIXEXVXSNNVGEISVSTRXTXLREDQIPRGFPTIDMGPQLKVVERTRTXTXLXXXSGNPDPEITXFKDFLPVDTSNNNGRIKQLRSESIGGTPIRGAXQXEQSEESDQGKXEXVXTNSAGTRYSAPXNXYVRELREVRRVPPRFSIPPTNHEIMPGGSVNXTXVXVGSPMPYXKXMLGAEDLTPEDDMPIGRNVLELNDXRQSANYTXVXMSTLGVIEAIXQXTVKALPKPPGTPVVTESTATSXTXTWDSGNPEPVSYYIXQHKPKNSEELYKEIDGXATTRYSXAGLSPYSDYEXRXXXVNNIGRGPPSEPVLTQTSEQAPSSAPRDVQARMLSSTTXLXQWKEPEEPNGQIQGYRXYYTMDPTQHXNNWMKHNVADSQITTXGNLVPQKTYSXKXLXFTSIGDGPLSSDIQVITQTGVPGQPLNFKAEPESETSXLXSWTPPRSDTIANXEXVYKDGEHGEEQRITXEPGTSYRLQGXKPNSLYYXRXXXRSPQGLGASTAEISARTMQSKPSAPPQDISCTSPSSTSXLXSWQPPPVEKQNGIITEYSXKYTXVDGEDDKPHEILGIPSDTTKYLXEQLEKWTEYRXTXTXHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQXSWQPPVLAERNGIITKYTXLYRDINIPLLPMEQLIVPADTTMTXTGLKPDTTYDXKXRXHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 410 - protein, 183 aa, Homo sapiens
  SITE (64)..(64): Xaa at position 64 is Val, Ala, Gly, Leu, or Ile
  SITE (66)..(66): Xaa at position 66 is Phe, Tyr, Met, His, Ile, Leu, Val Ala, or Gly
  SITE (86)..(86): Xaa at position 86 is Met, Ile, Leu, Val, Ala, or Gly
  SITE (93)..(93): Xaa at position 93 is Val, Ala, Gly, Leu, or Ile
  SITE (95)..(95): Xaa at position 95 is Ile, Ala, Val, Leu, or Gly
  SITE (97)..(97): Xaa at position 97 is Cys, Ala, Val, Gly, Ser, or Thr
  SITE (101)..(101): Xaa at position 101 is Tyr, Phe, Met, His, Ile, Leu, Val Ala, or Gly
  SITE (103)..(103): Xaa at position 103 is Ile, Ala, Val, Leu, or Gly
  SITE (105)..(105): Xaa at position 105 is Leu, Ala, Val, Gly, or Ile
  SITE (113)..(113): Xaa at position 113 is Val, Ala, Gly, Leu, or Ile
  SITE (115)..(115): Xaa at position 115 is Ile, Ala, Val, Leu, or Gly
  SITE (117)..(117): Xaa at position 117 is Leu, Ala, Val, Gly, or Ile
  SITE (135)..(135): Xaa at position 135 is Val, Ala, Gly, Leu, or Ile
  SITE (149)..(149): Xaa at position 149 is Val, Ala, Gly, Leu, or Ile
  SITE (151)..(151): Xaa at position 151 is Leu, Ala, Val, Gly, or Ile
  SITE (170)..(170): Xaa at position 170 is Leu, Ala, Val, Gly, or Ile
  SITE (172)..(172): Xaa at position 172 is Leu, Ala, Val, Gly, or Ile
MERVQPLEENVGNAARPRFERNKLLLVASVIQGLGLLLCFTYICLHFSALQVSHRYPRIQSIKXQXTEYKKEKGFILTSQKEDEIXKVQNNSXIXNXDGFXLXSXKGYFSQEXNXSXHYQKDEEPLFQLKKVRSXNSLMVASLTYKDKXYXNVTTDNTSLDDFHVNGGEXIXIHQNPGEFCVL

SEQ ID NO: 411 - protein, 247 aa, Homo sapiens
  SITE (141)..(141): Xaa at position 141 is Cys, Ala, Val, Gly, Ser, or Thr
  SITE (150)..(150): Xaa at position 150 is Ala, Gly, or Pro
  SITE (164)..(164): Xaa at position 164 is Val, Ala, Gly, Leu, or Ile
  SITE (166)..(166): Xaa at position 166 is Val, Ala, Gly, Leu, or Ile
  SITE (170)..(170): Xaa at position 170 is Val, Ala, Gly, Leu, or Ile
  SITE (196)..(196): Xaa at position 196 is Cys, Ala, Val, Gly, Ser, or Thr
  SITE (217)..(217): Xaa at position 217 is Ala, Gly, or Pro
  SITE (226)..(226): Xaa at position 226 is Ile, Ala, Val, Leu, or Gly
  SITE (231)..(231): Xaa at position 231 is Ile, Ala, Val, Leu, or Gly
  SITE (233)..(233): Xaa at position 233 is Ile, Ala, Val, Leu, or Gly
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVXDSISEWVTXADKKTAVDMSGGTXTXLEKXPVSKGQLKQYFYETKCNPMGYTKEGXRGIDKRHWNSQCRTTQSYVRXLTMDSKKRXGWRFXRXDTSCVCTLTIKRGR

SEQ ID NO: 412 - protein, 695 aa, Homo sapiens
  SITE (30)..(30): Xaa at position 30 is Phe, Tyr, Met, His, Ile, Leu, Val Ala, or Gly
  SITE (32)..(32): Xaa at position 32 is Cys, Ala, Val, Gly, Ser, or Thr
  SITE (37)..(37): Xaa at position 37 is Val, Ala, Gly, Leu, or Ile
  SITE (48)..(48): Xaa at position 48 is Ala, Gly, or Pro
  SITE (51)..(51): Xaa at position 51 is Leu, Ala, Val, Gly, or Ile
  SITE (53)..(53): Xaa at position 53 is Phe, Tyr, Met, His, Ile, Leu, Val Ala, or Gly
  SITE (58)..(58): Xaa at position 58 is Leu, Ala, Val, Gly, or Ile
  SITE (61)..(61): Xaa at position 61 is Ile, Ala, Val, Leu, or Gly
  SITE (66)..(66): Xaa at position 66 is Phe, Tyr, Met, His, Ile, Leu, Val Ala, or Gly
  SITE (69)..(69): Xaa at position 69 is Phe, Tyr, Met, His, Ile, Leu, Val Ala, or Gly
  SITE (72)..(72): Xaa at position 72 is Leu, Ala, Val, Gly, or Ile
  SITE (75)..(75): Xaa at position 75 is Ile, Ala, Val, Leu, or Gly
  SITE (77)..(77): Xaa at position 77 is Ile, Ala, Val, Leu, or Gly
  SITE (83)..(83): Xaa at position 83 is Leu, Ala, Val, Gly, or Ile
  SITE (86)..(86): Xaa at position 86 is Ile, Ala, Val, Leu, or Gly
  SITE (90)..(90): Xaa at position 90 is Val, Ala, Gly, Leu, or Ile
  SITE (91)..(91): Xaa at position 91 is Phe, Tyr, Met, His, Ile, Leu, Val Ala, or Gly
  SITE (94)..(94): Xaa at position 94 is Leu, Ala, Val, Gly, or Ile
  SITE (97)..(97): Xaa at position 97 is Leu, Ala, Val, Gly, or Ile
  SITE (100)..(100): Xaa at position 100 is Ile, Ala, Val, Leu, or Gly
  SITE (102)..(102): Xaa at position 102 is Ile, Ala, Val, Leu, or Gly
  SITE (105)..(105): Xaa at position 105 is Ala, Gly, or Pro
  SITE (108)..(108): Xaa at position 108 is Leu, Ala, Val, Gly, or Ile
  SITE (109)..(109): Xaa at position 109 is Leu, Ala, Val, Gly, or Ile
  SITE (115)..(115): Xaa at position 115 is Ala, Gly, or Pro
  SITE (116)..(116): Xaa at position 116 is Phe, Tyr, Met, His, Ile, Leu, Val Ala, or Gly
  SITE (119)..(119): Xaa at position 119 is Leu, Ala, Val, Gly, or Ile
  SITE (122)..(122): Xaa at position 122 is Leu, Ala, Val, Gly, or Ile
  SITE (125)..(125): Xaa at position 125 is Leu, Ala, Val, Gly, or Ile
  SITE (127)..(127): Xaa at position 127 is Ile, Ala, Val, Leu, or Gly
  SITE (132)..(132): Xaa at position 132 is Ile, Ala, Val, Leu, or Gly
  SITE (135)..(135): Xaa at position 135 is Leu, Ala, Val, Gly, or Ile
  SITE (138)..(138): Xaa at position 138 is Val, Ala, Gly, Leu, or Ile
  SITE (141)..(141): Xaa at position 141 is Ile, Ala, Val, Leu, or Gly
  SITE (147)..(147): Xaa at position 147 is Val, Ala, Gly, Leu, or Ile
  SITE (149)..(149): Xaa at position 149 is Leu, Ala, Val, Gly, or Ile
  SITE (151)..(151): Xaa at position 151 is Ile, Ala, Val, Leu, or Gly
  SITE (157)..(157): Xaa at position 157 is Ile, Ala, Val, Leu, or Gly
  SITE (160)..(160): Xaa at position 160 is Ile, Ala, Val, Leu, or Gly
  SITE (165)..(165): Xaa at position 165 is Phe, Tyr, Met, His, Ile, Leu, Val Ala, or Gly
  SITE (168)..(168): Xaa at position 168 is Leu, Ala, Val, Gly, or Ile
  SITE (173)..(173): Xaa at position 173 is Val, Ala, Gly, Leu, or Ile
  SITE (175)..(175): Xaa at position 175 is Leu, Ala, Val, Gly, or Ile
  SITE (177)..(177): Xaa at position 177 is Leu, Ala, Val, Gly, or Ile
  SITE (182)..(182): Xaa at position 182 is Ile, Ala, Val, Leu, or Gly
  SITE (189)..(189): Xaa at position 189 is Ala, Gly, or Pro
  SITE (190)..(190): Xaa at position 190 is Phe, Tyr, Met, His, Ile, Leu, Val Ala, or Gly
  SITE (195)..(195): Xaa at position 195 is Leu, Ala, Val, Gly, or Ile
  SITE (198)..(198): Xaa at position 198 is Leu, Ala, Val, Gly, or Ile
  SITE (200)..(200): Xaa at position 200 is Leu, Ala, Val, Gly, or Ile
  SITE (206)..(206): Xaa at position 206 is Leu, Ala, Val, Gly, or Ile
  SITE (213)..(213): Xaa at position 213 is Val, Ala, Gly, Leu, or Ile
  SITE (223)..(223): Xaa at position 223 is Leu, Ala, Val, Gly, or Ile
  SITE (225)..(225): Xaa at position 225 is Ile, Ala, Val, Leu, or Gly
  SITE (230)..(230): Xaa at position 230 is Ile, Ala, Val, Leu, or Gly
  SITE (238)..(238): Xaa at position 238 is Leu, Ala, Val, Gly, or Ile
  SITE (241)..(241): Xaa at position 241 is Leu, Ala, Val, Gly, or Ile
  SITE (244)..(244): Xaa at position 244 is Leu, Ala, Val, Gly, or Ile
  SITE (246)..(246): Xaa at position 246 is Ala, Gly, or Pro
  SITE (261)..(261): Xaa at position 261 is Leu, Ala, Val, Gly, or Ile
  SITE (267)..(267): Xaa at position 267 is Ala, Gly, or Pro
MALLLVSLLAFLSLGSGCHHRICHCSNRVXLXQESKXTEIPSDLPRNXIEXRXVLTKXRVXQKGAXSGXGDXEKXEXSQNDVXEVXEADXXSNXPKXHEXRXEKXNNXXYINPEXXQNXPNXQYXLXSNTGXKHXPDXHKXHSLQKXLXDXQDNINXHTXERNSXVGXSFESXIXWXNKNGXQEIHNCXXNGTQXDEXNXSDNNNXEELPNDXFHGASGPVIXDXSRTRXHSLPSYGXENXKKXRXRSTYNLKKLPTLEKXVALMEXSLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTNGSTYILVPLSHLAQN

SEQ ID NO: 413 - protein, 617 aa, Homo sapiens
  SITE (95)..(95): Xaa at position 95 is Leu, Ala, Val, Gly, or Ile
  SITE (109)..(109): Xaa at position 109 is Leu, Ala, Val, Gly, or Ile
  SITE (145)..(145): Xaa at position 145 is Ala, Gly, or Pro
  SITE (156)..(156): Xaa at position 156 is Ile, Ala, Val, Leu, or Gly
  SITE (238)..(238): Xaa at position 238 is Leu, Ala, Val, Gly, or Ile
  SITE (272)..(272): Xaa at position 272 is Phe, Tyr, Met, His, Ile, Leu, Val Ala, or Gly
  SITE (284)..(284): Xaa at position 284 is Leu, Ala, Val, Gly, or Ile
  SITE (291)..(291): Xaa at position 291 is Ile, Ala, Val, Leu, or Gly
  SITE (305)..(305): Xaa at position 305 is Ala, Gly, or Pro
  SITE (309)..(309): Xaa at position 309 is Ile, Ala, Val, Leu, or Gly
  SITE (319)..(319): Xaa at position 319 is Leu, Ala, Val, Gly, or Ile
  SITE (325)..(325): Xaa at position 325 is Val, Ala, Gly, Leu, or Ile
  SITE (367)..(367): Xaa at position 367 is Tyr, Phe, Met, His, Ile, Leu, Val Ala, or Gly
  SITE (379)..(379): Xaa at position 379 is Val, Ala, Gly, Leu, or Ile
  SITE (386)..(386): Xaa at position 386 is Leu, Ala, Val, Gly, or Ile
  SITE (387)..(387): Xaa at position 387 is Val, Ala, Gly, Leu, or Ile
  SITE (388)..(388): Xaa at position 388 is Phe, Tyr, Met, His, Ile, Leu, Val Ala, or Gly
  SITE (389)..(389): Xaa at position 389 is Ile, Ala, Val, Leu, or Gly
  SITE (390)..(390): Xaa at position 390 is Leu, Ala, Val, Gly, or Ile
  SITE (391)..(391): Xaa at position 391 is Tyr, Phe, Met, His, Ile, Leu, Val Ala, or Gly
  SITE (394)..(394): Xaa at position 394 is Ala, Gly, or Pro
  SITE (405)..(405): Xaa at position 405 is Ala, Gly, or Pro
  SITE (428)..(428): Xaa at position 428 is Ile, Ala, Val, Leu, or Gly
  SITE (459)..(459): Xaa at position 459 is Phe, Tyr, Met, His, Ile, Leu, Val Ala, or Gly
  SITE (466)..(466): Xaa at position 466 is Ile, Ala, Val, Leu, or Gly
  SITE (469)..(469): Xaa at position 469 is Leu, Ala, Val, Gly, or Ile
  SITE (472)..(472): Xaa at position 472 is Leu, Ala, Val, Gly, or Ile
  SITE (477)..(477): Xaa at position 477 is Ala, Gly, or Pro
  SITE (486)..(486): Xaa at position 486 is Leu, Ala, Val, Gly, or Ile
  SITE (490)..(490): Xaa at position 490 is Ile, Ala, Val, Leu, or Gly
  SITE (495)..(495): Xaa at position 495 is Phe, Tyr, Met, His, Ile, Leu, Val Ala, or Gly
  SITE (540)..(540): Xaa at position 540 is Phe, Tyr, Met, His, Ile, Leu, Val Ala, or Gly
  SITE (549)..(549): Xaa at position 549 is Ile, Ala, Val, Leu, or Gly
  SITE (554)..(554): Xaa at position 554 is Ala, Gly, or Pro
  SITE (556)..(556): Xaa at position 556 is Trp, Tyr, Phe, Met, His, Ile, Leu Val, Ala, or Gly
  SITE (569)..(569): Xaa at position 569 is Val, Ala, Gly, Leu, or Ile
MLLARMNPQVQPENNGADTGPEQPLRARKTAELLVVKERNGVQCLLAPRDGDAQPRETWGKKIDFLLSVVGFAVDLANVWRFPYLCYKNGGGAFXIPYTLFLIIAGMPXFYMELALGQYNREGAATVWKICPFFKGVGYAVILIXLYVGFYYNVIXAWSLYYLFSSFTLNLPWTDCGHTWNSPNCTDPKLLNGSVLGNHTKYSKYKFTPAAEFYERGVLHLHESSGIHDIGLPQWQLXLCLMVVVIVLYFSLWKGVKTSGKVVWITATLPYXVLFVLLVHGVTXPGASNGXNAYLHIDFYRLKEXTVWXDAATQIFFSXGAGFGXLIAFASYNKFDNNCYRDALLTSSINCITSFVSGFAIFSILGXMAHEHKVNIEDXATEGAGXXXXXXPEXISTLSGSTFWXVVFFVMLLALGLDSSMGGMEAVXTGLADDFQVLKRHRKLFTFGVTFSTFLLALXCITKGGXYVXTLXDTFAXGTSILFAVXMEAXGVSWXYGVDRFSNDIQQMMGFRPGLYWRLCWKFVSPAFLLFVVVVSIINXKPLTYDDYXFPPWXNXVGWGIALSSMVLXPIYVIYKFLSTQGSLWERLAYGITPENEHHLVAQRDIRQFQLQHWLAI

SEQ ID NO: 414 - protein, 683 aa, Homo sapiens
  SITE (360)..(360): Xaa at position 360 is Val, Ala, Gly, Leu, or Ile
  SITE (370)..(370): Xaa at position 370 is Met, Ile, Leu, Val, Ala, or Gly
  SITE (371)..(371): Xaa at position 371 is Leu, Ala, Val, Gly, or Ile
  SITE (372)..(372): Xaa at position 372 is Ala, Gly, or Pro
  SITE (383)..(383): Xaa at position 383 is Val, Ala, Gly, Leu, or Ile
  SITE (390)..(390): Xaa at position 390 is Val, Ala, Gly, Leu, or Ile
  SITE (406)..(406): Xaa at position 406 is Ile, Ala, Val, Leu, or Gly
  SITE (407)..(407): Xaa at position 407 is Leu, Ala, Val, Gly, or Ile
  SITE (410)..(410): Xaa at position 410 is Ala, Gly, or Pro
  SITE (415)..(415): Xaa at position 415 is Phe, Tyr, Met, His, Ile, Leu, Val Ala, or Gly
  SITE (416)..(416): Xaa at position 416 is Leu, Ala, Val, Gly, or Ile
  SITE (429)..(429): Xaa at position 429 is Leu, Ala, Val, Gly, or Ile
  SITE (430)..(430): Xaa at position 430 is Phe, Tyr, Met, His, Ile, Leu, Val Ala, or Gly
  SITE (431)..(431): Xaa at position 431 is Phe, Tyr, Met, His, Ile, Leu, Val Ala, or Gly
  SITE (432)..(432): Xaa at position 432 is Val, Ala, Gly, Leu, or Ile
  SITE (441)..(441): Xaa at position 441 is Leu, Ala, Val, Gly, or Ile
  SITE (456)..(456): Xaa at position 456 is Ala, Gly, or Pro
  SITE (459)..(459): Xaa at position 459 is Tyr, Phe, Met, His, Ile, Leu, Val Ala, or Gly
  SITE (460)..(460): Xaa at position 460 is Ala, Gly, or Pro
  SITE (461)..(461): Xaa at position 461 is Ala, Gly, or Pro
  SITE (463)..(463): Xaa at position 463 is Ile, Ala, Val, Leu, or Gly
  SITE (464)..(464): Xaa at position 464 is Ile, Ala, Val, Leu, or Gly
  SITE (466)..(466): Xaa at position 466 is Ala, Gly, or Pro
  SITE (467)..(467): Xaa at position 467 is Leu, Ala, Val, Gly, or Ile
  SITE (470)..(470): Xaa at position 470 is Leu, Ala, Val, Gly, or Ile
  SITE (475)..(475): Xaa at position 475 is Ile, Ala, Val, Leu, or Gly
  SITE (477)..(477): Xaa at position 477 is Tyr, Phe, Met, His, Ile, Leu, Val Ala, or Gly
  SITE (485)..(485): Xaa at position 485 is Val, Ala, Gly, Leu, or Ile
  SITE (487)..(487): Xaa at position 487 is Leu, Ala, Val, Gly, or Ile
  SITE (493)..(493): Xaa at position 493 is Cys, Ala, Val, Gly, Ser, or Thr
  SITE (495)..(495): Xaa at position 495 is Leu, Ala, Val, Gly, or Ile
  SITE (498)..(498): Xaa at position 498 is Phe, Tyr, Met, His, Ile, Leu, Val Ala, or Gly
  SITE (537)..(537): Xaa at position 537 is Trp, Tyr, Phe, Met, His, Ile, Leu Val, Ala, or Gly
  SITE (540)..(540): Xaa at position 540 is Met, Ile, Leu, Val, Ala, or Gly
  SITE (543)..(543): Xaa at position 543 is Leu, Ala, Val, Gly, or Ile
  SITE (544)..(544): Xaa at position 544 is Leu, Ala, Val, Gly, or Ile
  SITE (547)..(547): Xaa at position 547 is Met, Ile, Leu, Val, Ala, or Gly
  SITE (581)..(581): Xaa at position 581 is Ala, Gly, or Pro
  SITE (584)..(584): Xaa at position 584 is Ile, Ala, Val, Leu, or Gly
  SITE (585)..(585): Xaa at position 585 is Leu, Ala, Val, Gly, or Ile
  SITE (588)..(588): Xaa at position 588 is Phe, Tyr, Met, His, Ile, Leu, Val Ala, or Gly
  SITE (608)..(608): Xaa at position 608 is Ile, Ala, Val, Leu, or Gly
  SITE (613)..(613): Xaa at position 613 is Phe, Tyr, Met, His, Ile, Leu, Val Ala, or Gly
  SITE (614)..(614): Xaa at position 614 is Phe, Tyr, Met, His, Ile, Leu, Val Ala, or Gly
  SITE (641)..(641): Xaa at position 641 is Val, Ala, Gly, Leu, or Ile
  SITE (644)..(644): Xaa at position 644 is Phe, Tyr, Met, His, Ile, Leu, Val Ala, or Gly
  SITE (671)..(671): Xaa at position 671 is Phe, Tyr, Met, His, Ile, Leu, Val Ala, or Gly
  SITE (674)..(674): Xaa at position 674 is Phe, Tyr, Met, His, Ile, Leu, Val Ala, or Gly
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRXLGKGSFGKVXXXRVKETGDLYAXKVLKKDXILQDDDVECTMTEKRXXSLXRNHPXXTQLFCCFQTPDRXXXXMEFVNGGDXMFHIQKSRRFDEARXRFXXXEXXSXXMFXHDKGXIXRDLKLDNXLXDHEGHXKXADXGMCKEGICNGVTTATFCGTPDYIAPEILQEMLYGPAVDXWAXGVXXYEXLCGHAPFEAENEDDLFEAILNDEVVYPTWLHEDXTGXXKSXMTKNPTMRLGSLTQGGEHAXLRHPXXKEIDWAQLNHRQIEPPFRPRIKSREDXSNXDPDFIKEEPVLTPIDEGHLPMINQDEXRNXSYVSPELQP

SEQ ID NO: 415 - protein, 282 aa, Homo sapiens
  SITE (25)..(25): Xaa at position 25 is Ile, Ala, Val, Leu, or Gly
  SITE (26)..(26): Xaa at position 26 is Ala, Gly, or Pro
  SITE (27)..(27): Xaa at position 27 is Ala, Gly, or Pro
  SITE (28)..(28): Xaa at position 28 is Phe, Tyr, Met, His, Ile, Leu, Val Ala, or Gly
  SITE (30)..(30): Xaa at position 30 is Ile, Ala, Val, Leu, or Gly
  SITE (33)..(33): Xaa at position 33 is Phe, Tyr, Met, His, Ile, Leu, Val Ala, or Gly
  SITE (38)..(38): Xaa at position 38 is Met, Ile, Leu, Val, Ala, or Gly
  SITE (44)..(44): Xaa at position 44 is Val, Ala, Gly, Leu, or Ile
  SITE (47)..(47): Xaa at position 47 is Ile, Ala, Val, Leu, or Gly
  SITE (48)..(48): Xaa at position 48 is Val, Ala, Gly, Leu, or Ile
  SITE (50)..(50): Xaa at position 50 is Ile, Ala, Val, Leu, or Gly
  SITE (51)..(51): Xaa at position 51 is Leu, Ala, Val, Gly, or Ile
  SITE (54)..(54): Xaa at position 54 is Tyr, Phe, Met, His, Ile, Leu, Val Ala, or Gly
  SITE (56)..(56): Xaa at position 56 is Ile, Ala, Val, Leu, or Gly
  SITE (57)..(57): Xaa at position 57 is Ala, Gly, or Pro
  SITE (58)..(58): Xaa at position 58 is Leu, Ala, Val, Gly, or Ile
  SITE (59)..(59): Xaa at position 59 is Val, Ala, Gly, Leu, or Ile
  SITE (62)..(62): Xaa at position 62 is Val, Ala, Gly, Leu, or Ile
  SITE (69)..(69): Xaa at position 69 is Ala, Gly, or Pro
  SITE (70)..(70): Xaa at position 70 is Val, Ala, Gly, Leu, or Ile
  SITE (73)..(73): Xaa at position 73 is Leu, Ala, Val, Gly, or Ile
  SITE (77)..(77): Xaa at position 77 is Leu, Ala, Val, Gly, or Ile
  SITE (102)..(102): Xaa at position 102 is Tyr, Phe, Met, His, Ile, Leu, Val Ala, or Gly
  SITE (103)..(103): Xaa at position 103 is Leu, Ala, Val, Gly, or Ile
  SITE (104)..(104): Xaa at position 104 is Phe, Tyr, Met, His, Ile, Leu, Val Ala, or Gly
  SITE (105)..(105): Xaa at position 105 is Val, Ala, Gly, Leu, or Ile
  SITE (111)..(111): Xaa at position 111 is Val, Ala, Gly, Leu, or Ile
  SITE (131)..(131): Xaa at position 131 is Phe, Tyr, Met, His, Ile, Leu, Val Ala, or Gly
  SITE (137)..(137): Xaa at position 137 is Ile, Ala, Val, Leu, or Gly
  SITE (138)..(138): Xaa at position 138 is Val, Ala, Gly, Leu, or Ile
  SITE (140)..(140): Xaa at position 140 is Phe, Tyr, Met, His, Ile, Leu, Val Ala, or Gly
  SITE (147)..(147): Xaa at position 147 is Val, Ala, Gly, Leu, or Ile
  SITE (150)..(150): Xaa at position 150 is Phe, Tyr, Met, His, Ile, Leu, Val Ala, or Gly
  SITE (151)..(151): Xaa at position 151 is Ala, Gly, or Pro
  SITE (152)..(152): Xaa at position 152 is Ile, Ala, Val, Leu, or Gly
  SITE (153)..(153): Xaa at position 153 is Val, Ala, Gly, Leu, or Ile
  SITE (155)..(155): Xaa at position 155 is Leu, Ala, Val, Gly, or Ile
  SITE (157)..(157): Xaa at position 157 is Ala, Gly, or Pro
  SITE (162)..(162): Xaa at position 162 is Ala, Gly, or Pro
  SITE (166)..(166): Xaa at position 166 is Ile, Ala, Val, Leu, or Gly
  SITE (169)..(169): Xaa at position 169 is Leu, Ala, Val, Gly, or Ile
  SITE (172)..(172): Xaa at position 172 is Val, Ala, Gly, Leu, or Ile
  SITE (176)..(176): Xaa at position 176 is Val, Ala, Gly, Leu, or Ile
  SITE (185)..(185): Xaa at position 185 is Val, Ala, Gly, Leu, or Ile
  SITE (186)..(186): Xaa at position 186 is Met, Ile, Leu, Val, Ala, or Gly
  SITE (187)..(187): Xaa at position 187 is Leu, Ala, Val, Gly, or Ile
  SITE (188)..(188): Xaa at position 188 is Met, Ile, Leu, Val, Ala, or Gly
  SITE (191)..(191): Xaa at position 191 is Phe, Tyr, Met, His, Ile, Leu, Val Ala, or Gly
  SITE (193)..(193): Xaa at position 193 is Ala, Gly, or Pro
  SITE (206)..(206): Xaa at position 206 is Ile, Ala, Val, Leu, or Gly
  SITE (208)..(208): Xaa at position 208 is Leu, Ala, Val, Gly, or Ile
  SITE (218)..(218): Xaa at position 218 is Ile, Ala, Val, Leu, or Gly
  SITE (231)..(231): Xaa at position 231 is Cys, Ala, Val, Gly, Ser, or Thr
  SITE (232)..(232): Xaa at position 232 is Ala, Gly, or Pro
  SITE (236)..(236): Xaa at position 236 is Ile, Ala, Val, Leu, or Gly
  SITE (237)..(237): Xaa at position 237 is Val, Ala, Gly, Leu, or Ile
  SITE (238)..(238): Xaa at position 238 is Val, Ala, Gly, Leu, or Ile
  SITE (239)..(239): Xaa at position 239 is Ala, Gly, or Pro
  SITE (243)..(243): Xaa at position 243 is Leu, Ala, Val, Gly, or Ile
  SITE (246)..(246): Xaa at position 246 is Ala, Gly, or Pro
  SITE (257)..(257): Xaa at position 257 is Phe, Tyr, Met, His, Ile, Leu, Val Ala, or Gly
  SITE (268)..(268): Xaa at position 268 is Ala, Gly, or Pro
  SITE (271)..(271): Xaa at position 271 is Ile, Ala, Val, Leu, or Gly
  SITE (277)..(277): Xaa at position 277 is Val, Ala, Gly, Leu, or Ile
  SITE (279)..(279): Xaa at position 279 is Val, Ala, Gly, Leu, or Ile
  SITE (281)..(281): Xaa at position 281 is Leu, Ala, Val, Gly, or Ile
MRGMKLLGALLALAALLQGAVSLKXXXXNXQTXGETKXSNATLXSYXXQXXSRXDXXXXQEXRDSHLTXXGKXLDNXNQDAPDTYHYVVSEPLGRNSYKERXXXXYRPDQXSAVDSYYYDDGCEPCGNDTXNREPAXXRXFSRFTEXREXXXXPXHXAPGDXVAEXDAXYDXYLDXQEKWGLEDXXXXGDXNXGCSYVRPSQWSSXRXWTSPTFQWLXPDSADTTATPTHXXYDRXXXXGMLXRGXVVPDSALPFNXQAAYGLSDQLXQAXSDHYPXEXMXK

SEQ ID NO: 416 - protein, 350 aa, Homo sapiens
  SITE (37)..(37): Xaa at position 37 is Leu, Ala, Val, Gly, or Ile
  SITE (110)..(110): Xaa at position 110 is Cys, Ala, Val, Gly, Ser, or Thr
  SITE (187)..(187): Xaa at position 187 is Cys, Ala, Val, Gly, Ser, or Thr
  SITE (190)..(190): Xaa at position 190 is Val, Ala, Gly, Leu, or Ile
MSNITDPQMWDFDDLNFTGMPPADEDYSPCMLETETXNKYVVIIAYALVFLLSLLGNSLVMLVILYSRVGRSVTDVYLLNLALADLLFALTLPIWAASKVNGWIFGTFLXKVVSLLKEVNFYSGILLLACISVDRYLAIVHATRTLTQKRHLVKFVCLGCWGLSMNLSLPFFLFRQAYHPNNSSPVXYEXLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 417 - protein, 360 aa, Homo sapiens
  SITE (155)..(155): Xaa at position 155 is Leu, Ala, Val, Gly, or Ile
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTXTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 418 - protein, 2843 aa, Homo sapiens
  SITE (137)..(137): Xaa at position 137 is Leu, Ala, Val, Gly, or Ile
  SITE (204)..(204): Xaa at position 204 is Leu, Ala, Val, Gly, or Ile
  SITE (224)..(224): Xaa at position 224 is Ile, Ala, Val, Leu, or Gly
  SITE (344)..(344): Xaa at position 344 is Cys, Ala, Val, Gly, Ser, or Thr
  SITE (356)..(356): Xaa at position 356 is Leu, Ala, Val, Gly, or Ile
  SITE (383)..(383): Xaa at position 383 is Ala, Gly, or Pro
  SITE (386)..(386): Xaa at position 386 is Ala, Gly, or Pro
  SITE (387)..(387): Xaa at position 387 is Leu, Ala, Val, Gly, or Ile
  SITE (391)..(391): Xaa at position 391 is Ile, Ala, Val, Leu, or Gly
  SITE (406)..(406): Xaa at position 406 is Val, Ala, Gly, Leu, or Ile
  SITE (407)..(407): Xaa at position 407 is Leu, Ala, Val, Gly, or Ile
  SITE (410)..(410): Xaa at position 410 is Leu, Ala, Val, Gly, or Ile
  SITE (413)..(413): Xaa at position 413 is Ile, Ala, Val, Leu, or Gly
  SITE (416)..(416): Xaa at position 416 is Tyr, Phe, Met, His, Ile, Leu, Val Ala, or Gly
  SITE (417)..(417): Xaa at position 417 is Cys, Ala, Val, Gly, Ser, or Thr
  SITE (420)..(420): Xaa at position 420 is Cys, Ala, Val, Gly, Ser, or Thr
  SITE (446)..(446): Xaa at position 446 is Ile, Ala, Val, Leu, or Gly
  SITE (450)..(450): Xaa at position 450 is Val, Ala, Gly, Leu, or Ile
  SITE (453)..(453): Xaa at position 453 is Leu, Ala, Val, Gly, or Ile
  SITE (465)..(465): Xaa at position 465 is Ala, Gly, or Pro
  SITE (466)..(466): Xaa at position 466 is Met, Ile, Leu, Val, Ala, or Gly
  SITE (469)..(469): Xaa at position 469 is Leu, Ala, Val, Gly, or Ile
  SITE (472)..(472): Xaa at position 472 is Leu, Ala, Val, Gly, or Ile
  SITE (474)..(474): Xaa at position 474 is Ala, Gly, or Pro
  SITE (475)..(475): Xaa at position 475 is Ile, Ala, Val, Leu, or Gly
  SITE (476)..(476): Xaa at position 476 is Ala, Gly, or Pro
  SITE (478)..(478): Xaa at position 478 is Leu, Ala, Val, Gly, or Ile
  SITE (479)..(479): Xaa at position 479 is Leu, Ala, Val, Gly, or Ile
  SITE (481)..(481): Xaa at position 481 is Val, Ala, Gly, Leu, or Ile
  SITE (497)..(497): Xaa at position 497 is Leu, Ala, Val, Gly, or Ile
  SITE (501)..(501): Xaa at position 501 is Ala, Gly, or Pro
  SITE (504)..(504): Xaa at position 504 is Ala, Gly, or Pro
  SITE (505)..(505): Xaa at position 505 is Leu, Ala, Val, Gly, or Ile
  SITE (508)..(508): Xaa at position 508 is Leu, Ala, Val, Gly, or Ile
  SITE (519)..(519): Xaa at position 519 is Leu, Ala, Val, Gly, or Ile
  SITE (520)..(520): Xaa at position 520 is Cys, Ala, Val, Gly, Ser, or Thr
  SITE (525)..(525): Xaa at position 525 is Cys, Ala, Val, Gly, Ser, or Thr
  SITE (526)..(526): Xaa at position 526 is Met, Ile, Leu, Val, Ala, or Gly
  SITE (529)..(529): Xaa at position 529 is Leu, Ala, Val, Gly, or Ile
  SITE (540)..(540): Xaa at position 540 is Leu, Ala, Val, Gly, or Ile
  SITE (544)..(544): Xaa at position 544 is Ile, Ala, Val, Leu, or Gly
  SITE (545)..(545): Xaa at position 545 is Ala, Gly, or Pro
  SITE (547)..(547): Xaa at position 547 is Val, Ala, Gly, Leu, or Ile
  SITE (548)..(548): Xaa at position 548 is Leu, Ala, Val, Gly, or Ile
  SITE (551)..(551): Xaa at position 551 is Leu, Ala, Val, Gly, or Ile
  SITE (563)..(563): Xaa at position 563 is Leu, Ala, Val, Gly, or Ile
  SITE (569)..(569): Xaa at position 569 is Val, Ala, Gly, Leu, or Ile
  SITE (572)..(572): Xaa at position 572 is Leu, Ala, Val, Gly, or Ile
  SITE (573)..(573): Xaa at position 573 is Met, Ile, Leu, Val, Ala, or Gly
  SITE (575)..(575): Xaa at position 575 is Cys, Ala, Val, Gly, Ser, or Thr
  SITE (576)..(576): Xaa at position 576 is Ala, Gly, or Pro
  SITE (588)..(588): Xaa at position 588 is Val, Ala, Gly, Leu, or Ile
  SITE (589)..(589): Xaa at position 589 is Leu, Ala, Val, Gly, or Ile
  SITE (591)..(591): Xaa at position 591 is Ala, Gly, or Pro
  SITE (592)..(592): Xaa at position 592 is Leu, Ala, Val, Gly, or Ile
  SITE (595)..(595): Xaa at position 595 is Leu, Ala, Val, Gly, or Ile
  SITE (606)..(606): Xaa at position 606 is Ile, Ala, Val, Leu, or Gly
  SITE (612)..(612): Xaa at position 612 is Ala, Gly, or Pro
  SITE (613)..(613): Xaa at position 613 is Leu, Ala, Val, Gly, or Ile
  SITE (616)..(616): Xaa at position 616 is Leu, Ala, Val, Gly, or Ile
  SITE (631)..(631): Xaa at position 631 is Ile, Ala, Val, Leu, or Gly
  SITE (638)..(638): Xaa at position 638 is Ile, Ala, Val, Leu, or Gly
  SITE (639)..(639): Xaa at position 639 is Leu, Ala, Val, Gly, or Ile
  SITE (642)..(642): Xaa at position 642 is Val, Ala, Gly, Leu, or Ile
  SITE (646)..(646): Xaa at position 646 is Ile, Ala, Val, Leu, or Gly
  SITE (656)..(656): Xaa at position 656 is Leu, Ala, Val, Gly, or Ile
  SITE (661)..(661): Xaa at position 661 is Cys, Ala, Val, Gly, Ser, or Thr
  SITE (665)..(665): Xaa at position 665 is Leu, Ala, Val, Gly, or Ile
  SITE (676)..(676): Xaa at position 676 is Ile, Ala, Val, Leu, or Gly
  SITE (680)..(680): Xaa at position 680 is Ala, Gly, or Pro
  SITE (681)..(681): Xaa at position 681 is Cys, Ala, Val, Gly, Ser, or Thr
  SITE (684)..(684): Xaa at position 684 is Leu, Ala, Val, Gly, or Ile
  SITE (687)..(687): Xaa at position 687 is Leu, Ala, Val, Gly, or Ile
  SITE (703)..(703): Xaa at position 703 is Ala, Gly, or Pro
  SITE (707)..(707): Xaa at position 707 is Leu, Ala, Val, Gly, or Ile
  SITE (718)..(718): Xaa at position 718 is Ile, Ala, Val, Leu, or Gly
  SITE (725)..(725): Xaa at position 725 is Ala, Gly, or Pro
  SITE (729)..(729): Xaa at position 729 is Leu, Ala, Val, Gly, or Ile
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEEXEKERSLLLADLDKEEKEKDWYYAQLQNLTKRIDSLPLTENFSLQTDMTRRQLEYEARQIRVAMEEQXGTCQDMEKRAQRRIARIQQXEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSXISMRQSGCLPLXIQLLHGNDKDSVLLGNSRGSKEARARXSAXXHNIXHSQPDDKRGRREIRXXHLXEQXRAXXETXWEWQEAHEPGMDQDKNPMPAPVEHQXCPAXCVXMKLSFDEEHRHXXNEXGGXQXXXEXXQXDCEMYGLTNDHYSITXRRYXGMXXTNXTFGDVANKATXXSMKGXXRAXVAQLKSESEDXQQVXXSXXRNXSWRADVNSKKTXREVGSXKAXXEXXLEVKKESTLKSXXSXXWNXSAHCTENKADXCAVDGXXAFXVGTLTYRSQTNTLAXIESGGGXXRNXSSLXATNEDHRQIXRENNXLQTXLQHLKSHSLTXVSNXXGTXWNXSARNPKDQEALWDMGXVSMXKNLIHSKHKMXAMGSAAXLRNXMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 419 - protein, 248 aa, Homo sapiens
  SITE (48)..(48): Xaa at position 48 is Leu, Ala, Val, Gly, or Ile
  SITE (50)..(50): Xaa at position 50 is Cys, Ala, Val, Gly, Ser, or Thr
  SITE (64)..(64): Xaa at position 64 is Phe, Tyr, Met, His, Ile, Leu, Val Ala, or Gly
  SITE (66)..(66): Xaa at position 66 is Trp, Tyr, Phe, Met, His, Ile, Leu Val, Ala, or Gly
  SITE (80)..(80): Xaa at position 80 is Phe, Tyr, Met, His, Ile, Leu, Val Ala, or Gly
  SITE (95)..(95): Xaa at position 95 is Phe, Tyr, Met, His, Ile, Leu, Val Ala, or Gly
  SITE (112)..(112): Xaa at position 112 is Ile, Ala, Val, Leu, or Gly
  SITE (114)..(114): Xaa at position 114 is Ile, Ala, Val, Leu, or Gly
  SITE (125)..(125): Xaa at position 125 is Phe, Tyr, Met, His, Ile, Leu, Val Ala, or Gly
  SITE (127)..(127): Xaa at position 127 is Cys, Ala, Val, Gly, Ser, or Thr
  SITE (144)..(144): Xaa at position 144 is Leu, Ala, Val, Gly, or Ile
MAPGAPSSSPSPILAVLLFSSLVLSPAQAIVVYTDREVHGAVGSRVTXHXSFWSSEWVSDDISXTXRYQPEGGRDAISIXHYAKGQPYIDEVGTXKERIQWVGDPRWKDGSXVXHNLDYSDNGTXTXDVKNPPDIVGKTSQVTXYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 420 - protein, 335 aa, Homo sapiens
  SITE (63)..(63): Xaa at position 63 is Cys, Ala, Val, Gly, Ser, or Thr
  SITE (73)..(73): Xaa at position 73 is Cys, Ala, Val, Gly, Ser, or Thr
  SITE (85)..(85): Xaa at position 85 is Cys, Ala, Val, Gly, Ser, or Thr
  SITE (119)..(119): Xaa at position 119 is Cys, Ala, Val, Gly, Ser, or Thr
MLGIWTLLPLVLTSVARLSSKSVNAQVTDINSKGLELRKTVTTVETQNLEGLHHDGQFCHKPXPPGERKARDXTVNGDEPDCVPXQEGKEYTDKAHFSSKCRRCRLCDEGHGLEVEINXTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 421 - protein, 798 aa, Homo sapiens
  SITE (54)..(54): Xaa at position 54 is Cys, Ala, Val, Gly, Ser, or Thr
  SITE (55)..(55): Xaa at position 55 is Ile, Ala, Val, Leu, or Gly
  SITE (61)..(61): Xaa at position 61 is Cys, Ala, Val, Gly, Ser, or Thr
  SITE (63)..(63): Xaa at position 63 is Trp, Tyr, Phe, Met, His, Ile, Leu Val, Ala, or Gly
  SITE (64)..(64): Xaa at position 64 is Cys, Ala, Val, Gly, Ser, or Thr
  SITE (86)..(86): Xaa at position 86 is Leu, Ala, Val, Gly, or Ile
  SITE (123)..(123): Xaa at position 123 is Leu, Ala, Val, Gly, or Ile
  SITE (124)..(124): Xaa at position 124 is Ala, Gly, or Pro
  SITE (128)..(128): Xaa at position 128 is Val, Ala, Gly, Leu, or Ile
  SITE (130)..(130): Xaa at position 130 is Val, Ala, Gly, Leu, or Ile
  SITE (132)..(132): Xaa at position 132 is Leu, Ala, Val, Gly, or Ile
  SITE (142)..(142): Xaa at position 142 is Val, Ala, Gly, Leu, or Ile
  SITE (144)..(144): Xaa at position 144 is Phe, Tyr, Met, His, Ile, Leu, Val Ala, or Gly
  SITE (152)..(152): Xaa at position 152 is Val, Ala, Gly, Leu, or Ile
  SITE (154)..(154): Xaa at position 154 is Leu, Ala, Val, Gly, or Ile
  SITE (155)..(155): Xaa at position 155 is Tyr, Phe, Met, His, Ile, Leu, Val Ala, or Gly
  SITE (156)..(156): Xaa at position 156 is Tyr, Phe, Met, His, Ile, Leu, Val Ala, or Gly
  SITE (157)..(157): Xaa at position 157 is Leu, Ala, Val, Gly, or Ile
  SITE (158)..(158): Xaa at position 158 is Met, Ile, Leu, Val, Ala, or Gly
  SITE (160)..(160): Xaa at position 160 is Leu, Ala, Val, Gly, or Ile
  SITE (164)..(164): Xaa at position 164 is Met, Ile, Leu, Val, Ala, or Gly
  SITE (191)..(191): Xaa at position 191 is Ile, Ala, Val, Leu, or Gly
  SITE (193)..(193): Xaa at position 193 is Phe, Tyr, Met, His, Ile, Leu, Val Ala, or Gly
  SITE (196)..(196): Xaa at position 196 is Phe, Tyr, Met, His, Ile, Leu, Val Ala, or Gly
  SITE (197)..(197): Xaa at position 197 is Val, Ala, Gly, Leu, or Ile
  SITE (204)..(204): Xaa at position 204 is Phe, Tyr, Met, His, Ile, Leu, Val Ala, or Gly
  SITE (205)..(205): Xaa at position 205 is Val, Ala, Gly, Leu, or Ile
  SITE (216)..(216): Xaa at position 216 is Cys, Ala, Val, Gly, Ser, or Thr
  SITE (229)..(229): Xaa at position 229 is Phe, Tyr, Met, His, Ile, Leu, Val Ala, or Gly
  SITE (242)..(242): Xaa at position 242 is Phe, Tyr, Met, His, Ile, Leu, Val Ala, or Gly
  SITE (246)..(246): Xaa at position 246 is Val, Ala, Gly, Leu, or Ile
  SITE (251)..(251): Xaa at position 251 is Val, Ala, Gly, Leu, or Ile
  SITE (264)..(264): Xaa at position 264 is Ala, Gly, or Pro
  SITE (265)..(265): Xaa at position 265 is Ile, Ala, Val, Leu, or Gly
  SITE (266)..(266): Xaa at position 266 is Leu, Ala, Val, Gly, or Ile
  SITE (268)..(268): Xaa at position 268 is Ala, Gly, or Pro
  SITE (269)..(269): Xaa at position 269 is Ala, Gly, or Pro
  SITE (271)..(271): Xaa at position 271 is Cys, Ala, Val, Gly, Ser, or Thr
  SITE (275)..(275): Xaa at position 275 is Ile, Ala, Val, Leu, or Gly
  SITE (283)..(283): Xaa at position 283 is Leu, Ala, Val, Gly, or Ile
  SITE (284)..(284): Xaa at position 284 is Leu, Ala, Val, Gly, or Ile
  SITE (285)..(285): Xaa at position 285 is Val, Ala, Gly, Leu, or Ile
  SITE (286)..(286): Xaa at position 286 is Phe, Tyr, Met, His, Ile, Leu, Val Ala, or Gly
  SITE (327)..(327): Xaa at position 327 is Tyr, Phe, Met, His, Ile, Leu, Val Ala, or Gly
  SITE (337)..(337): Xaa at position 337 is Leu, Ala, Val, Gly, or Ile
  SITE (340)..(340): Xaa at position 340 is Ala, Gly, or Pro
  SITE (345)..(345): Xaa at position 345 is Ile, Ala, Val, Leu, or Gly
  SITE (347)..(347): Xaa at position 347 is Ala, Gly, or Pro
  SITE (348)..(348): Xaa at position 348 is Val, Ala, Gly, Leu, or Ile
  SITE (356)..(356): Xaa at position 356 is Tyr, Phe, Met, His, Ile, Leu, Val Ala, or Gly
  SITE (367)..(367): Xaa at position 367 is Ala, Gly, or Pro
  SITE (378)..(378): Xaa at position 378 is Val, Ala, Gly, Leu, or Ile
  SITE (385)..(385): Xaa at position 385 is Ala, Gly, or Pro
  SITE (395)..(395): Xaa at position 395 is Leu, Ala, Val, Gly, or Ile
  SITE (408)..(408): Xaa at position 408 is Tyr, Phe, Met, His, Ile, Leu, Val Ala, or Gly
  SITE (428)..(428): Xaa at position 428 is Cys, Ala, Val, Gly, Ser, or Thr
  SITE (431)..(431): Xaa at position 431 is Val, Ala, Gly, Leu, or Ile
  SITE (437)..(437): Xaa at position 437 is Val, Ala, Gly, Leu, or Ile
  SITE (439)..(439): Xaa at position 439 is Phe, Tyr, Met, His, Ile, Leu, Val Ala, or Gly
  SITE (441)..(441): Xaa at position 441 is Val, Ala, Gly, Leu, or Ile
  SITE (443)..(443): Xaa at position 443 is Leu, Ala, Val, Gly, or Ile
  SITE (445)..(445): Xaa at position 445 is Ala, Gly, or Pro
  SITE (455)..(455): Xaa at position 455 is Leu, Ala, Val, Gly, or Ile
  SITE (457)..(457): Xaa at position 457 is Leu, Ala, Val, Gly, or Ile
  SITE (459)..(459): Xaa at position 459 is Ala, Gly, or Pro
  SITE (466)..(466): Xaa at position 466 is Leu, Ala, Val, Gly, or Ile
  SITE (468)..(468): Xaa at position 468 is Val, Ala, Gly, Leu, or Ile
  SITE (470)..(470): Xaa at position 470 is Leu, Ala, Val, Gly, or Ile
MVALPMVLVLLLVLSRGESELDAKIPSTGDATEWRNPHLSMLGSCQPAPSCQKXXLSHPSXAXXKQLNFTASGEAEARRCARREEXLARGCPLEELEEPRGQQEVLQDQPLSQGARGEGATQXXPQRXRXTXRPGEPQQLQXRXLRAEGYPXDXXXXXDXSYSXKDDLERVRQLGHALLVRLQEVTHSVRXGXGSXXDKTVLPXXSTVPSKLRHPXPTRLERCQSPFSXHHVLSLTGDAQAXEREXGRQSXSGNLDSPEGGFDXXXQXXLXQEQXGWRNVSRXXXXTSDDTFHTAGDGKLGGIFMPSDGHCHLDSNGLYSRSTEFDXPSVGQVAQAXSAXNIQPXFXXTSAALPVXQELSKLIPKSXVGELSEDSSNXVQLIMDXYNSLSSTVTXEHSSLPPGVHISXESQCEGPEKREGKAEDRGQXNHXRINQTXTXWXSXQXTHCLPEPHLXRXRXLGFSEEXIXEXHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 422 - protein, 568 aa, Influenza A virus
  strain A/Mallard/Astrakhan/263/1982 H14N5 (Influenza A virus (strain A/Mallard/Gurjev/263/1982 H14N5) )
  SITE (29)..(29): Xaa at position 29 is Ile, Ala, Val, Leu, or Gly
  SITE (30)..(30): Xaa at position 30 is Cys, Ala, Val, Gly, Ser, or Thr
  SITE (31)..(31): Xaa at position 31 is Leu, Ala, Val, Gly, or Ile
  SITE (35)..(35): Xaa at position 35 is Ala, Gly, or Pro
  SITE (42)..(42): Xaa at position 42 is Val, Ala, Gly, Leu, or Ile
  SITE (52)..(52): Xaa at position 52 is Val, Ala, Gly, Leu, or Ile
  SITE (58)..(58): Xaa at position 58 is Leu, Ala, Val, Gly, or Ile
  SITE (59)..(59): Xaa at position 59 is Val, Ala, Gly, Leu, or Ile
  SITE (67)..(67): Xaa at position 67 is Leu, Ala, Val, Gly, or Ile
  SITE (68)..(68): Xaa at position 68 is Cys, Ala, Val, Gly, Ser, or Thr
  SITE (74)..(74): Xaa at position 74 is Leu, Ala, Val, Gly, or Ile
  SITE (80)..(80): Xaa at position 80 is Cys, Ala, Val, Gly, Ser, or Thr
  SITE (82)..(82): Xaa at position 82 is Leu, Ala, Val, Gly, or Ile
  SITE (83)..(83): Xaa at position 83 is Ile, Ala, Val, Leu, or Gly
  SITE (86)..(86): Xaa at position 86 is Ala, Gly, or Pro
  SITE (87)..(87): Xaa at position 87 is Leu, Ala, Val, Gly, or Ile
  SITE (92)..(92): Xaa at position 92 is Cys, Ala, Val, Gly, Ser, or Thr
  SITE (95)..(95): Xaa at position 95 is Leu, Ala, Val, Gly, or Ile
  SITE (102)..(102): Xaa at position 102 is Val, Ala, Gly, Leu, or Ile
  SITE (103)..(103): Xaa at position 103 is Phe, Tyr, Met, His, Ile, Leu, Val Ala, or Gly
  SITE (104)..(104): Xaa at position 104 is Ile, Ala, Val, Leu, or Gly
  SITE (110)..(110): Xaa at position 110 is Val, Ala, Gly, Leu, or Ile
  SITE (113)..(113): Xaa at position 113 is Cys, Ala, Val, Gly, Ser, or Thr
  SITE (114)..(114): Xaa at position 114 is Tyr, Phe, Met, His, Ile, Leu, Val Ala, or Gly
  SITE (116)..(116): Xaa at position 116 is Phe, Tyr, Met, His, Ile, Leu, Val Ala, or Gly
  SITE (121)..(121): Xaa at position 121 is Tyr, Phe, Met, His, Ile, Leu, Val Ala, or Gly
  SITE (124)..(124): Xaa at position 124 is Leu, Ala, Val, Gly, or Ile
  SITE (128)..(128): Xaa at position 128 is Leu, Ala, Val, Gly, or Ile
  SITE (129)..(129): Xaa at position 129 is Ala, Gly, or Pro
  SITE (134)..(134): Xaa at position 134 is Leu, Ala, Val, Gly, or Ile
  SITE (141)..(141): Xaa at position 141 is Phe, Tyr, Met, His, Ile, Leu, Val Ala, or Gly
  SITE (154)..(154): Xaa at position 154 is Ala, Gly, or Pro
  SITE (155)..(155): Xaa at position 155 is Cys, Ala, Val, Gly, Ser, or Thr
  SITE (163)..(163): Xaa at position 163 is Phe, Tyr, Met, His, Ile, Leu, Val Ala, or Gly
  SITE (164)..(164): Xaa at position 164 is Phe, Tyr, Met, His, Ile, Leu, Val Ala, or Gly
  SITE (167)..(167): Xaa at position 167 is Leu, Ala, Val, Gly, or Ile
  SITE (170)..(170): Xaa at position 170 is Leu, Ala, Val, Gly, or Ile
  SITE (181)..(181): Xaa at position 181 is Ile, Ala, Val, Leu, or Gly
  SITE (195)..(195): Xaa at position 195 is Tyr, Phe, Met, His, Ile, Leu, Val Ala, or Gly
  SITE (197)..(197): Xaa at position 197 is Trp, Tyr, Phe, Met, His, Ile, Leu Val, Ala, or Gly
  SITE (199)..(199): Xaa at position 199 is Val, Ala, Gly, Leu, or Ile
  SITE (200)..(200): Xaa at position 200 is His, Phe, Tyr, Lys, Arg, Gly, Ser Thr, Ala, Val, Leu, Ile, Asn, Met, or Gln
  SITE (201)..(201): Xaa at position 201 is His, Phe, Tyr, Lys, Arg, Gly, Ser Thr, Ala, Val, Leu, Ile, Asn, Met, or Gln
  SITE (212)..(212): Xaa at position 212 is Tyr, Phe, Met, His, Ile, Leu, Val Ala, or Gly
  SITE (219)..(219): Xaa at position 219 is Val, Ala, Gly, Leu, or Ile
  SITE (221)..(221): Xaa at position 221 is Val, Ala, Gly, Leu, or Ile
  SITE (247)..(247): Xaa at position 247 is Ile, Ala, Val, Leu, or Gly
  SITE (249)..(249): Xaa at position 249 is Ile, Ala, Val, Leu, or Gly
  SITE (250)..(250): Xaa at position 250 is Tyr, Phe, Met, His, Ile, Leu, Val Ala, or Gly
  SITE (253)..(253): Xaa at position 253 is Leu, Ala, Val, Gly, or Ile
  SITE (254)..(254): Xaa at position 254 is Val, Ala, Gly, Leu, or Ile
  SITE (260)..(260): Xaa at position 260 is Ile, Ala, Val, Leu, or Gly
  SITE (262)..(262): Xaa at position 262 is Phe, Tyr, Met, His, Ile, Leu, Val Ala, or Gly
  SITE (268)..(268): Xaa at position 268 is Leu, Ala, Val, Gly, or Ile
  SITE (269)..(269): Xaa at position 269 is Ile, Ala, Val, Leu, or Gly
  SITE (270)..(270): Xaa at position 270 is Ala, Gly, or Pro
  SITE (275)..(275): Xaa at position 275 is Tyr, Phe, Met, His, Ile, Leu, Val Ala, or Gly
  SITE (292)..(292): Xaa at position 292 is Ile, Ala, Val, Leu, or Gly
  SITE (299)..(299): Xaa at position 299 is Cys, Ala, Val, Gly, Ser, or Thr
  SITE (300)..(300): Xaa at position 300 is Leu, Ala, Val, Gly, or Ile
  SITE (306)..(306): Xaa at position 306 is Ile, Ala, Val, Leu, or Gly
  SITE (327)..(327): Xaa at position 327 is Val, Ala, Gly, Leu, or Ile
  SITE (334)..(334): Xaa at position 334 is Leu, Ala, Val, Gly, or Ile
  SITE (335)..(335): Xaa at position 335 is Ala, Gly, or Pro
  SITE (352)..(352): Xaa at position 352 is Ala, Gly, or Pro
  SITE (361)..(361): Xaa at position 361 is Trp, Tyr, Phe, Met, His, Ile, Leu Val, Ala, or Gly
  SITE (369)..(369): Xaa at position 369 is Tyr, Phe, Met, His, Ile, Leu, Val Ala, or Gly
  SITE (391)..(391): Xaa at position 391 is Ala, Gly, or Pro
  SITE (443)..(443): Xaa at position 443 is Ala, Gly, or Pro
  SITE (465)..(465): Xaa at position 465 is Leu, Ala, Val, Gly, or Ile
  SITE (473)..(473): Xaa at position 473 is Leu, Ala, Val, Gly, or Ile
  SITE (484)..(484): Xaa at position 484 is Cys, Ala, Val, Gly, Ser, or Thr
  SITE (485)..(485): Xaa at position 485 is Phe, Tyr, Met, His, Ile, Leu, Val Ala, or Gly
  SITE (487)..(487): Xaa at position 487 is Ile, Ala, Val, Leu, or Gly
  SITE (489)..(489): Xaa at position 489 is His, Phe, Tyr, Lys, Arg, Gly, Ser Thr, Ala, Val, Leu, Ile, Asn, Met, or Gln
  SITE (491)..(491): Xaa at position 491 is Cys, Ala, Val, Gly, Ser, or Thr
  SITE (495)..(495): Xaa at position 495 is Cys, Ala, Val, Gly, Ser, or Thr
  SITE (496)..(496): Xaa at position 496 is Ile, Ala, Val, Leu, or Gly
  SITE (499)..(499): Xaa at position 499 is Ile, Ala, Val, Leu, or Gly
  SITE (513)..(513): Xaa at position 513 is Ala, Gly, or Pro
MIALILVALALSHTAYSQITNGTTGNPIXXXGHHXVENGTSXKTLTDNHVEXVSAKEXXETNHTDEXXPSPLKXVDGQDXHXXNGXXGSPGXDRXQDTTWDXXXERPTAXDTXXPXDVPDXQSXRSIXXSSGSXEFIAEQXTWNGVKVDGSSSXXLRGGRNSXXSRXNWXTKATNGNYGPXNVTKENTGSYVRLXLXGXXXPSSDNEQTDLXKVATGRXTXSTRSDQISIVPNIGSRPRVRNQSGRXSXXWTXXNPGDSXIXNSIGNXXXPRGHXKISKSTKSTVLKSDKRXGSCTSPXXTDKGSXQSDKPFQNVSRIAIGNCPKYXKQGSLMXXTGMRNIPGKQAKGLFGXIAGFIENGXQGLIDGWXGFRHQNAEGTGTAADLKSTQAXIDQINGKLNRLIEKTNEKYHQIEKEFEQVEGRIQDLEKYVEDTKIDLWSYNXELLVALENQHTIDVTDSEMNKXFERVRRQXRENAEDQGNGXXEXFXQXDNNXXESXRNGTYDHNIYRDEXINNRIKINPVTLTMGYKDIILWISFSMSCFVFVALILGFVLWACQNGNIRCQICI

SEQ ID NO: 423 - protein, 711 aa, Homo sapiens
  SITE (157)..(157): Xaa at position 157 is Cys, Ala, Val, Gly, Ser, or Thr
  SITE (169)..(169): Xaa at position 169 is Cys, Ala, Val, Gly, Ser, or Thr
  SITE (199)..(199): Xaa at position 199 is Tyr, Phe, Met, His, Ile, Leu, Val Ala, or Gly
  SITE (215)..(215): Xaa at position 215 is Trp, Tyr, Phe, Met, His, Ile, Leu Val, Ala, or Gly
  SITE (240)..(240): Xaa at position 240 is Cys, Ala, Val, Gly, Ser, or Thr
  SITE (250)..(250): Xaa at position 250 is Trp, Tyr, Phe, Met, His, Ile, Leu Val, Ala, or Gly
  SITE (251)..(251): Xaa at position 251 is Cys, Ala, Val, Gly, Ser, or Thr
  SITE (252)..(252): Xaa at position 252 is Tyr, Phe, Met, His, Ile, Leu, Val Ala, or Gly
  SITE (263)..(263): Xaa at position 263 is Cys, Ala, Val, Gly, Ser, or Thr
  SITE (265)..(265): Xaa at position 265 is Leu, Ala, Val, Gly, or Ile
  SITE (391)..(391): Xaa at position 391 is Cys, Ala, Val, Gly, Ser, or Thr
  SITE (394)..(394): Xaa at position 394 is Trp, Tyr, Phe, Met, His, Ile, Leu Val, Ala, or Gly
  SITE (400)..(400): Xaa at position 400 is His, Phe, Tyr, Lys, Arg, Gly, Ser Thr, Ala, Val, Leu, Ile, Asn, Met, or Gln
  SITE (414)..(414): Xaa at position 414 is Leu, Ala, Val, Gly, or Ile
  SITE (419)..(419): Xaa at position 419 is Cys, Ala, Val, Gly, Ser, or Thr
  SITE (431)..(431): Xaa at position 431 is Cys, Ala, Val, Gly, Ser, or Thr
  SITE (443)..(443): Xaa at position 443 is Cys, Ala, Val, Gly, Ser, or Thr
  SITE (484)..(484): Xaa at position 484 is Val, Ala, Gly, Leu, or Ile
  SITE (494)..(494): Xaa at position 494 is Trp, Tyr, Phe, Met, His, Ile, Leu Val, Ala, or Gly
  SITE (496)..(496): Xaa at position 496 is Val, Ala, Gly, Leu, or Ile
  SITE (498)..(498): Xaa at position 498 is Leu, Ala, Val, Gly, or Ile
  SITE (511)..(511): Xaa at position 511 is Leu, Ala, Val, Gly, or Ile
  SITE (517)..(517): Xaa at position 517 is Ile, Ala, Val, Leu, or Gly
  SITE (518)..(518): Xaa at position 518 is Leu, Ala, Val, Gly, or Ile
  SITE (520)..(520): Xaa at position 520 is Ala, Gly, or Pro
  SITE (536)..(536): Xaa at position 536 is Val, Ala, Gly, Leu, or Ile
  SITE (538)..(538): Xaa at position 538 is Leu, Ala, Val, Gly, or Ile
  SITE (555)..(555): Xaa at position 555 is Val, Ala, Gly, Leu, or Ile
  SITE (569)..(569): Xaa at position 569 is Leu, Ala, Val, Gly, or Ile
  SITE (570)..(570): Xaa at position 570 is Val, Ala, Gly, Leu, or Ile
  SITE (571)..(571): Xaa at position 571 is Leu, Ala, Val, Gly, or Ile
  SITE (572)..(572): Xaa at position 572 is Leu, Ala, Val, Gly, or Ile
  SITE (584)..(584): Xaa at position 584 is Val, Ala, Gly, Leu, or Ile
  SITE (602)..(602): Xaa at position 602 is Cys, Ala, Val, Gly, Ser, or Thr
  SITE (604)..(604): Xaa at position 604 is Ile, Ala, Val, Leu, or Gly
  SITE (605)..(605): Xaa at position 605 is Ala, Gly, or Pro
  SITE (624)..(624): Xaa at position 624 is Leu, Ala, Val, Gly, or Ile
  SITE (632)..(632): Xaa at position 632 is Cys, Ala, Val, Gly, Ser, or Thr
  SITE (645)..(645): Xaa at position 645 is Met, Ile, Leu, Val, Ala, or Gly
  SITE (646)..(646): Xaa at position 646 is Cys, Ala, Val, Gly, Ser, or Thr
  SITE (665)..(665): Xaa at position 665 is Leu, Ala, Val, Gly, or Ile
  SITE (666)..(666): Xaa at position 666 is Ala, Gly, or Pro
  SITE (667)..(667): Xaa at position 667 is Cys, Ala, Val, Gly, Ser, or Thr
  SITE (675)..(675): Xaa at position 675 is Leu, Ala, Val, Gly, or Ile
  SITE (678)..(678): Xaa at position 678 is Ile, Ala, Val, Leu, or Gly
  SITE (679)..(679): Xaa at position 679 is Ile, Ala, Val, Leu, or Gly
  SITE (697)..(697): Xaa at position 697 is Val, Ala, Gly, Leu, or Ile
  SITE (704)..(704): Xaa at position 704 is Ile, Ala, Val, Leu, or Gly
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFXRNPDGDPGGPWXYTTDPAVRFQSCGIKSCREAACVWCNGEEXRGAVDRTESGRECQRXDLQHPHQHPFEPGKFLDQGLDDNYXRNPDGSERPXXXTTDPQIEREFXDXPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQXQRXSAETPXKPQFTFTSEPHAQXEENFXRNPDGDSHGPWXYTMDPRTPFDYXALRRCADDQPPSILDPPDQVQFEKCGKRVDRLDQRRSKLRXVGGHPGNSPXTXSXRNRQGQHFCGGSXVKEQWXXTXRQCFSSCHMPLTGYEXWXGTLFQNPQHGEPSLQRXPVAKMVCGPSGSQXXXXKLERSVTLNQRXALICLPPEWYVVPPGTKXEXXGWGETKGTGNDTVLNVALXNVISNQEXNIKHRGRVRESEXXTEGLLAPVGACEGDYGGPXXXFTHNCWVXEGXXIPNRVCARSRWPAVFTRXSVFVDWXHKVMRLG

SEQ ID NO: 424 - protein, 355 aa, Homo sapiens
  SITE (28)..(28): Xaa at position 28 is Leu, Ala, Val, Gly, or Ile
  SITE (48)..(48): Xaa at position 48 is Ile, Ala, Val, Leu, or Gly
  SITE (63)..(63): Xaa at position 63 is Ala, Gly, or Pro
  SITE (64)..(64): Xaa at position 64 is Phe, Tyr, Met, His, Ile, Leu, Val Ala, or Gly
  SITE (65)..(65): Xaa at position 65 is Ile, Ala, Val, Leu, or Gly
  SITE (85)..(85): Xaa at position 85 is Ile, Ala, Val, Leu, or Gly
  SITE (88)..(88): Xaa at position 88 is Met, Ile, Leu, Val, Ala, or Gly
  SITE (129)..(129): Xaa at position 129 is Leu, Ala, Val, Gly, or Ile
  SITE (130)..(130): Xaa at position 130 is Leu, Ala, Val, Gly, or Ile
  SITE (131)..(131): Xaa at position 131 is Val, Ala, Gly, Leu, or Ile
  SITE (132)..(132): Xaa at position 132 is Val, Ala, Gly, Leu, or Ile
  SITE (141)..(141): Xaa at position 141 is Val, Ala, Gly, Leu, or Ile
  SITE (143)..(143): Xaa at position 143 is Leu, Ala, Val, Gly, or Ile
  SITE (144)..(144): Xaa at position 144 is Phe, Tyr, Met, His, Ile, Leu, Val Ala, or Gly
  SITE (153)..(153): Xaa at position 153 is Leu, Ala, Val, Gly, or Ile
  SITE (159)..(159): Xaa at position 159 is Ile, Ala, Val, Leu, or Gly
  SITE (167)..(167): Xaa at position 167 is Leu, Ala, Val, Gly, or Ile
  SITE (170)..(170): Xaa at position 170 is Ile, Ala, Val, Leu, or Gly
  SITE (178)..(178): Xaa at position 178 is Phe, Tyr, Met, His, Ile, Leu, Val Ala, or Gly
  SITE (179)..(179): Xaa at position 179 is Tyr, Phe, Met, His, Ile, Leu, Val Ala, or Gly
  SITE (180)..(180): Xaa at position 180 is Gly, Ala, or Pro
  SITE (205)..(205): Xaa at position 205 is Val, Ala, Gly, Leu, or Ile
  SITE (220)..(220): Xaa at position 220 is Phe, Tyr, Met, His, Ile, Leu, Val Ala, or Gly
  SITE (223)..(223): Xaa at position 223 is Ala, Gly, or Pro
  SITE (226)..(226): Xaa at position 226 is Ile, Ala, Val, Leu, or Gly
  SITE (235)..(235): Xaa at position 235 is Val, Ala, Gly, Leu, or Ile
  SITE (237)..(237): Xaa at position 237 is Ile, Ala, Val, Leu, or Gly
  SITE (238)..(238): Xaa at position 238 is Ala, Gly, or Pro
  SITE (245)..(245): Xaa at position 245 is Ile, Ala, Val, Leu, or Gly
  SITE (247)..(247): Xaa at position 247 is Val, Ala, Gly, Leu, or Ile
  SITE (267)..(267): Xaa at position 267 is Leu, Ala, Val, Gly, or Ile
  SITE (268)..(268): Xaa at position 268 is Val, Ala, Gly, Leu, or Ile
  SITE (280)..(280): Xaa at position 280 is Leu, Ala, Val, Gly, or Ile
  SITE (282)..(282): Xaa at position 282 is Val, Ala, Gly, Leu, or Ile
  SITE (284)..(284): Xaa at position 284 is Cys, Ala, Val, Gly, Ser, or Thr
  SITE (285)..(285): Xaa at position 285 is His, Phe, Tyr, Lys, Arg, Gly, Ser Thr, Ala, Val, Leu, Ile, Asn, Met, or Gln
  SITE (304)..(304): Xaa at position 304 is Val, Ala, Gly, Leu, or Ile
  SITE (307)..(307): Xaa at position 307 is Ile, Ala, Val, Leu, or Gly
  SITE (322)..(322): Xaa at position 322 is Ala, Gly, or Pro
  SITE (328)..(328): Xaa at position 328 is Leu, Ala, Val, Gly, or Ile
  SITE (333)..(333): Xaa at position 333 is Val, Ala, Gly, Leu, or Ile
  SITE (334)..(334): Xaa at position 334 is Ala, Gly, or Pro
  SITE (341)..(341): Xaa at position 341 is Leu, Ala, Val, Gly, or Ile
  SITE (342)..(342): Xaa at position 342 is Leu, Ala, Val, Gly, or Ile
  SITE (343)..(343): Xaa at position 343 is Ile, Ala, Val, Leu, or Gly
  SITE (350)..(350): Xaa at position 350 is Ala, Gly, or Pro
  SITE (351)..(351): Xaa at position 351 is Leu, Ala, Val, Gly, or Ile
  SITE (353)..(353): Xaa at position 353 is Cys, Ala, Val, Gly, Ser, or Thr
MAKLIALTLLGMGLALFRNHQSSYQTRXNALREVQPVELPNCNLVKGXETGSEDLEILPNGLXXXSSGLKYPGIKSFNPNSPGKXLLXDLNEEDPTVLELGITGSKFDVSSFNPHGISTFTDEDNAMYXXXXNHPDAKSTXEXXKFQEEEKSXLHLKTXRHKLLPNXNDXVAVGPEHXXXTNDHYFLDPYLQSWEMYLGLAWSYXVYYSPSEVRVVAEGXDFXNGXNISPDGKYXYXXELLAHKXHXYEKHANWTLTPLKSLDFNTXXDNISVDPETGDXWXGXXPNGMKIFFYDSENPPASEXLRXQNILTEEPKVTQVYXENGTVXQGSTXXSVYKGKXXXGTVFHKXXYXEL

SEQ ID NO: 425 - protein, 766 aa, Homo sapiens
  SITE (43)..(43): Xaa at position 43 is Tyr, Phe, Met, His, Ile, Leu, Val Ala, or Gly
  SITE (68)..(68): Xaa at position 68 is Tyr, Phe, Met, His, Ile, Leu, Val Ala, or Gly
  SITE (69)..(69): Xaa at position 69 is Leu, Ala, Val, Gly, or Ile
  SITE (81)..(81): Xaa at position 81 is Ala, Gly, or Pro
  SITE (90)..(90): Xaa at position 90 is Leu, Ala, Val, Gly, or Ile
  SITE (114)..(114): Xaa at position 114 is Ile, Ala, Val, Leu, or Gly
  SITE (116)..(116): Xaa at position 116 is Leu, Ala, Val, Gly, or Ile
  SITE (130)..(130): Xaa at position 130 is Ala, Gly, or Pro
  SITE (132)..(132): Xaa at position 132 is Tyr, Phe, Met, His, Ile, Leu, Val Ala, or Gly
  SITE (134)..(134): Xaa at position 134 is Ile, Ala, Val, Leu, or Gly
  SITE (142)..(142): Xaa at position 142 is Leu, Ala, Val, Gly, or Ile
  SITE (164)..(164): Xaa at position 164 is Leu, Ala, Val, Gly, or Ile
  SITE (165)..(165): Xaa at position 165 is Ala, Gly, or Pro
  SITE (167)..(167): Xaa at position 167 is Val, Ala, Gly, Leu, or Ile
  SITE (172)..(172): Xaa at position 172 is Ile, Ala, Val, Leu, or Gly
  SITE (174)..(174): Xaa at position 174 is Val, Ala, Gly, Leu, or Ile
  SITE (198)..(198): Xaa at position 198 is Ile, Ala, Val, Leu, or Gly
  SITE (201)..(201): Xaa at position 201 is Trp, Tyr, Phe, Met, His, Ile, Leu Val, Ala, or Gly
  SITE (202)..(202): Xaa at position 202 is Val, Ala, Gly, Leu, or Ile
  SITE (203)..(203): Xaa at position 203 is Tyr, Phe, Met, His, Ile, Leu, Val Ala, or Gly
  SITE (207)..(207): Xaa at position 207 is Val, Ala, Gly, Leu, or Ile
  SITE (213)..(213): Xaa at position 213 is Ala, Gly, or Pro
  SITE (223)..(223): Xaa at position 223 is Leu, Ala, Val, Gly, or Ile
  SITE (224)..(224): Xaa at position 224 is Ala, Gly, or Pro
  SITE (225)..(225): Xaa at position 225 is Tyr, Phe, Met, His, Ile, Leu, Val Ala, or Gly
  SITE (226)..(226): Xaa at position 226 is Ala, Gly, or Pro
  SITE (228)..(228): Xaa at position 228 is Phe, Tyr, Met, His, Ile, Leu, Val Ala, or Gly
  SITE (236)..(236): Xaa at position 236 is Ile, Ala, Val, Leu, or Gly
  SITE (238)..(238): Xaa at position 238 is Tyr, Phe, Met, His, Ile, Leu, Val Ala, or Gly
  SITE (241)..(241): Xaa at position 241 is Tyr, Phe, Met, His, Ile, Leu, Val Ala, or Gly
  SITE (259)..(259): Xaa at position 259 is Ala, Gly, or Pro
  SITE (261)..(261): Xaa at position 261 is Ala, Gly, or Pro
  SITE (268)..(268): Xaa at position 268 is Phe, Tyr, Met, His, Ile, Leu, Val Ala, or Gly
  SITE (270)..(270): Xaa at position 270 is Val, Ala, Gly, Leu, or Ile
  SITE (271)..(271): Xaa at position 271 is Val, Ala, Gly, Leu, or Ile
  SITE (287)..(287): Xaa at position 287 is Ile, Ala, Val, Leu, or Gly
  SITE (293)..(293): Xaa at position 293 is Met, Ile, Leu, Val, Ala, or Gly
  SITE (299)..(299): Xaa at position 299 is Tyr, Phe, Met, His, Ile, Leu, Val Ala, or Gly
  SITE (300)..(300): Xaa at position 300 is Leu, Ala, Val, Gly, or Ile
  SITE (301)..(301): Xaa at position 301 is Cys, Ala, Val, Gly, Ser, or Thr
  SITE (303)..(303): Xaa at position 303 is Val, Ala, Gly, Leu, or Ile
  SITE (311)..(311): Xaa at position 311 is Ile, Ala, Val, Leu, or Gly
  SITE (313)..(313): Xaa at position 313 is Leu, Ala, Val, Gly, or Ile
  SITE (315)..(315): Xaa at position 315 is Trp, Tyr, Phe, Met, His, Ile, Leu Val, Ala, or Gly
  SITE (324)..(324): Xaa at position 324 is Val, Ala, Gly, Leu, or Ile
  SITE (325)..(325): Xaa at position 325 is Met, Ile, Leu, Val, Ala, or Gly
  SITE (327)..(327): Xaa at position 327 is Ile, Ala, Val, Leu, or Gly
  SITE (328)..(328): Xaa at position 328 is Cys, Ala, Val, Gly, Ser, or Thr
  SITE (339)..(339): Xaa at position 339 is Cys, Ala, Val, Gly, Ser, or Thr
  SITE (340)..(340): Xaa at position 340 is Leu, Ala, Val, Gly, or Ile
  SITE (346)..(346): Xaa at position 346 is Ile, Ala, Val, Leu, or Gly
  SITE (353)..(353): Xaa at position 353 is Trp, Tyr, Phe, Met, His, Ile, Leu Val, Ala, or Gly
  SITE (354)..(354): Xaa at position 354 is Val, Ala, Gly, Leu, or Ile
  SITE (371)..(371): Xaa at position 371 is Phe, Tyr, Met, His, Ile, Leu, Val Ala, or Gly
  SITE (383)..(383): Xaa at position 383 is His, Phe, Tyr, Lys, Arg, Gly, Ser Thr, Ala, Val, Leu, Ile, Asn, Met, or Gln
  SITE (384)..(384): Xaa at position 384 is Ile, Ala, Val, Leu, or Gly
  SITE (385)..(385): Xaa at position 385 is Cys, Ala, Val, Gly, Ser, or Thr
  SITE (389)..(389): Xaa at position 389 is Ile, Ala, Val, Leu, or Gly
  SITE (404)..(404): Xaa at position 404 is Val, Ala, Gly, Leu, or Ile
  SITE (415)..(415): Xaa at position 415 is Leu, Ala, Val, Gly, or Ile
  SITE (416)..(416): Xaa at position 416 is Tyr, Phe, Met, His, Ile, Leu, Val Ala, or Gly
  SITE (417)..(417): Xaa at position 417 is Tyr, Phe, Met, His, Ile, Leu, Val Ala, or Gly
  SITE (418)..(418): Xaa at position 418 is Ile, Ala, Val, Leu, or Gly
  SITE (431)..(431): Xaa at position 431 is Leu, Ala, Val, Gly, or Ile
  SITE (434)..(434): Xaa at position 434 is Ile, Ala, Val, Leu, or Gly
  SITE (442)..(442): Xaa at position 442 is Val, Ala, Gly, Leu, or Ile
  SITE (445)..(445): Xaa at position 445 is Leu, Ala, Val, Gly, or Ile
  SITE (447)..(447): Xaa at position 447 is Cys, Ala, Val, Gly, Ser, or Thr
  SITE (454)..(454): Xaa at position 454 is Cys, Ala, Val, Gly, Ser, or Thr
  SITE (468)..(468): Xaa at position 468 is Tyr, Phe, Met, His, Ile, Leu, Val Ala, or Gly
  SITE (470)..(470): Xaa at position 470 is Leu, Ala, Val, Gly, or Ile
  SITE (472)..(472): Xaa at position 472 is Cys, Ala, Val, Gly, Ser, or Thr
  SITE (482)..(482): Xaa at position 482 is Leu, Ala, Val, Gly, or Ile
  SITE (500)..(500): Xaa at position 500 is Leu, Ala, Val, Gly, or Ile
  SITE (507)..(507): Xaa at position 507 is Val, Ala, Gly, Leu, or Ile
  SITE (514)..(514): Xaa at position 514 is Leu, Ala, Val, Gly, or Ile
  SITE (519)..(519): Xaa at position 519 is Leu, Ala, Val, Gly, or Ile
  SITE (528)..(528): Xaa at position 528 is Met, Ile, Leu, Val, Ala, or Gly
  SITE (530)..(530): Xaa at position 530 is Leu, Ala, Val, Gly, or Ile
  SITE (542)..(542): Xaa at position 542 is Leu, Ala, Val, Gly, or Ile
  SITE (543)..(543): Xaa at position 543 is Leu, Ala, Val, Gly, or Ile
  SITE (544)..(544): Xaa at position 544 is Leu, Ala, Val, Gly, or Ile
  SITE (546)..(546): Xaa at position 546 is Val, Ala, Gly, Leu, or Ile
  SITE (548)..(548): Xaa at position 548 is Ala, Gly, or Pro
  SITE (551)..(551): Xaa at position 551 is Cys, Ala, Val, Gly, Ser, or Thr
  SITE (555)..(555): Xaa at position 555 is Ala, Gly, or Pro
  SITE (567)..(567): Xaa at position 567 is Leu, Ala, Val, Gly, or Ile
  SITE (568)..(568): Xaa at position 568 is Ala, Gly, or Pro
  SITE (573)..(573): Xaa at position 573 is Ile, Ala, Val, Leu, or Gly
  SITE (574)..(574): Xaa at position 574 is Ile, Ala, Val, Leu, or Gly
  SITE (575)..(575): Xaa at position 575 is Val, Ala, Gly, Leu, or Ile
  SITE (576)..(576): Xaa at position 576 is Ala, Gly, or Pro
  SITE (578)..(578): Xaa at position 578 is Phe, Tyr, Met, His, Ile, Leu, Val Ala, or Gly
  SITE (591)..(591): Xaa at position 591 is Met, Ile, Leu, Val, Ala, or Gly
  SITE (593)..(593): Xaa at position 593 is Ala, Gly, or Pro
  SITE (594)..(594): Xaa at position 594 is Ile, Ala, Val, Leu, or Gly
  SITE (598)..(598): Xaa at position 598 is Leu, Ala, Val, Gly, or Ile
  SITE (603)..(603): Xaa at position 603 is Val, Ala, Gly, Leu, or Ile
  SITE (607)..(607): Xaa at position 607 is Ile, Ala, Val, Leu, or Gly
  SITE (609)..(609): Xaa at position 609 is Ala, Gly, or Pro
  SITE (610)..(610): Xaa at position 610 is Ala, Gly, or Pro
  SITE (613)..(613): Xaa at position 613 is Phe, Tyr, Met, His, Ile, Leu, Val Ala, or Gly
  SITE (619)..(619): Xaa at position 619 is Val, Ala, Gly, Leu, or Ile
  SITE (624)..(624): Xaa at position 624 is Ile, Ala, Val, Leu, or Gly
  SITE (625)..(625): Xaa at position 625 is Ala, Gly, or Pro
  SITE (626)..(626): Xaa at position 626 is Ile, Ala, Val, Leu, or Gly
  SITE (631)..(631): Xaa at position 631 is Tyr, Phe, Met, His, Ile, Leu, Val Ala, or Gly
  SITE (634)..(634): Xaa at position 634 is Tyr, Phe, Met, His, Ile, Leu, Val Ala, or Gly
  SITE (635)..(635): Xaa at position 635 is Val, Ala, Gly, Leu, or Ile
  SITE (638)..(638): Xaa at position 638 is Met, Ile, Leu, Val, Ala, or Gly
  SITE (639)..(639): Xaa at position 639 is Val, Ala, Gly, Leu, or Ile
  SITE (640)..(640): Xaa at position 640 is Leu, Ala, Val, Gly, or Ile
  SITE (649)..(649): Xaa at position 649 is Cys, Ala, Val, Gly, Ser, or Thr
  SITE (651)..(651): Xaa at position 651 is Ile, Ala, Val, Leu, or Gly
  SITE (652)..(652): Xaa at position 652 is Ala, Gly, or Pro
  SITE (653)..(653): Xaa at position 653 is Val, Ala, Gly, Leu, or Ile
  SITE (654)..(654): Xaa at position 654 is Ala, Gly, or Pro
  SITE (656)..(656): Xaa at position 656 is Val, Ala, Gly, Leu, or Ile
  SITE (659)..(659): Xaa at position 659 is Trp, Tyr, Phe, Met, His, Ile, Leu Val, Ala, or Gly
  SITE (661)..(661): Xaa at position 661 is Tyr, Phe, Met, His, Ile, Leu, Val Ala, or Gly
  SITE (662)..(662): Xaa at position 662 is Tyr, Phe, Met, His, Ile, Leu, Val Ala, or Gly
  SITE (665)..(665): Xaa at position 665 is Val, Ala, Gly, Leu, or Ile
  SITE (666)..(666): Xaa at position 666 is Tyr, Phe, Met, His, Ile, Leu, Val Ala, or Gly
  SITE (670)..(670): Xaa at position 670 is Tyr, Phe, Met, His, Ile, Leu, Val Ala, or Gly
  SITE (671)..(671): Xaa at position 671 is Met, Ile, Leu, Val, Ala, or Gly
  SITE (683)..(683): Xaa at position 683 is Tyr, Phe, Met, His, Ile, Leu, Val Ala, or Gly
  SITE (688)..(688): Xaa at position 688 is Val, Ala, Gly, Leu, or Ile
  SITE (692)..(692): Xaa at position 692 is Ala, Gly, or Pro
  SITE (695)..(695): Xaa at position 695 is Phe, Tyr, Met, His, Ile, Leu, Val Ala, or Gly
  SITE (700)..(700): Xaa at position 700 is Tyr, Phe, Met, His, Ile, Leu, Val Ala, or Gly
  SITE (701)..(701): Xaa at position 701 is Leu, Ala, Val, Gly, or Ile
  SITE (702)..(702): Xaa at position 702 is Leu, Ala, Val, Gly, or Ile
  SITE (703)..(703): Xaa at position 703 is Ile, Ala, Val, Leu, or Gly
  SITE (704)..(704): Xaa at position 704 is His, Phe, Tyr, Lys, Arg, Gly, Ser Thr, Ala, Val, Leu, Ile, Asn, Met, or Gln
  SITE (711)..(711): Xaa at position 711 is Val, Ala, Gly, Leu, or Ile
  SITE (719)..(719): Xaa at position 719 is Ile, Ala, Val, Leu, or Gly
  SITE (723)..(723): Xaa at position 723 is Leu, Ala, Val, Gly, or Ile
  SITE (724)..(724): Xaa at position 724 is Val, Ala, Gly, Leu, or Ile
  SITE (726)..(726): Xaa at position 726 is Val, Ala, Gly, Leu, or Ile
  SITE (730)..(730): Xaa at position 730 is Phe, Tyr, Met, His, Ile, Leu, Val Ala, or Gly
  SITE (735)..(735): Xaa at position 735 is Tyr, Phe, Met, His, Ile, Leu, Val Ala, or Gly
  SITE (740)..(740): Xaa at position 740 is His, Phe, Tyr, Lys, Arg, Gly, Ser Thr, Ala, Val, Leu, Ile, Asn, Met, or Gln
  SITE (742)..(742): Xaa at position 742 is Ile, Ala, Val, Leu, or Gly
  SITE (751)..(751): Xaa at position 751 is Ile, Ala, Val, Leu, or Gly
  SITE (755)..(755): Xaa at position 755 is Met, Ile, Leu, Val, Ala, or Gly
  SITE (758)..(758): Xaa at position 758 is Phe, Tyr, Met, His, Ile, Leu, Val Ala, or Gly
  SITE (759)..(759): Xaa at position 759 is Ile, Ala, Val, Leu, or Gly
  SITE (762)..(762): Xaa at position 762 is Cys, Ala, Val, Gly, Ser, or Thr
  SITE (763)..(763): Xaa at position 763 is Phe, Tyr, Met, His, Ile, Leu, Val Ala, or Gly
MKTPWKVLLGLLGAAALVTIITVPVVLLNKGTDDATADSRKTXTLTDYLKNTYRLKLYSLRWISDHEXXYKQENNILVFNXEYGNSSVFXENSTFDEFGHSINDYSISPDGQFXLXEYNYVKQWRHSYTXSXDXYDLNKRQXITEERIPNNTQWVTWSPVGHKXXYXWNNDXYXKIEPNLPSYRITWTGKEDIIYNGXTDXXXEEEXFSAYSXLWWSPNGTFXXXXQXNDTEVPLXEXSFXSDESLQYPKTVRVPYPKXGXVNPTVKXFXXNTDSLSSVTNATSIQXTAPASXLIGDHXXXDXTWATQERXSXQXLRRIQNYSXXDXXDYDESSGRWNXXVARQHXEMSTTGXXGRFRPSEPHFTLDGNSXYKIISNEEGYRXXXYFQXDKKDCTFITKGTWEXIGIEALTSDYXXXXSNEYKGMPGGRNXYKXQLSDYTKXTCXSXELNPERXQYYSVSFSKEAKYXQXRXSGPGLPLYTXHSSVNDKGLRVLEDNSAXDKMLQNXQMPSKKXDFIIXNETKFWYQXIXPPHFDKSKKYPXXXDXYXGPXSQKXDTVFRLNWATYXXSTENXXXXSXDGRGSGYQGDKIXHXXNRRXGTFEXEDQXEXXRQXSKMGFXDNKRXXXWGWSXGGXXTSXXXGSGSGVFKXGXXXXPXSRXEXXDSXXTERXXGLPTPEDNLDHXRNSTXMSRXENXKQVEXXXXXGTADDNXHFQQSAQXSKAXXDXGVDXQAMWXTDEDXGXASSTAHQHXYTHXSHXXKQXXSLP

SEQ ID NO: 426 - protein, 3392 aa, Dengue virus type 1
  strain Brazil/97-11/1997 (DENV-1)
  SITE (29)..(29): Xaa at position 29 is Leu, Ala, Val, Gly, or Ile
  SITE (48)..(48): Xaa at position 48 is Met, Ile, Leu, Val, Ala, or Gly
  SITE (126)..(126): Xaa at position 126 is Met, Ile, Leu, Val, Ala, or Gly
  SITE (128)..(128): Xaa at position 128 is Val, Ala, Gly, Leu, or Ile
  SITE (148)..(148): Xaa at position 148 is Cys, Ala, Val, Gly, Ser, or Thr
  SITE (167)..(167): Xaa at position 167 is Cys, Ala, Val, Gly, Ser, or Thr
  SITE (180)..(180): Xaa at position 180 is Cys, Ala, Val, Gly, Ser, or Thr
  SITE (182)..(182): Xaa at position 182 is Cys, Ala, Val, Gly, Ser, or Thr
  SITE (189)..(189): Xaa at position 189 is Val, Ala, Gly, Leu, or Ile
  SITE (191)..(191): Xaa at position 191 is Tyr, Phe, Met, His, Ile, Leu, Val Ala, or Gly
  SITE (251)..(251): Xaa at position 251 is Ala, Gly, or Pro
  SITE (255)..(255): Xaa at position 255 is Ala, Gly, or Pro
  SITE (281)..(281): Xaa at position 281 is Met, Ile, Leu, Val, Ala, or Gly
  SITE (283)..(283): Xaa at position 283 is Cys, Ala, Val, Gly, Ser, or Thr
  SITE (301)..(301): Xaa at position 301 is Val, Ala, Gly, Leu, or Ile
  SITE (303)..(303): Xaa at position 303 is Val, Ala, Gly, Leu, or Ile
  SITE (304)..(304): Xaa at position 304 is Val, Ala, Gly, Leu, or Ile
  SITE (305)..(305): Xaa at position 305 is Leu, Ala, Val, Gly, or Ile
  SITE (310)..(310): Xaa at position 310 is Cys, Ala, Val, Gly, Ser, or Thr
  SITE (311)..(311): Xaa at position 311 is Val, Ala, Gly, Leu, or Ile
  SITE (314)..(314): Xaa at position 314 is Met, Ile, Leu, Val, Ala, or Gly
  SITE (315)..(315): Xaa at position 315 is Ala, Gly, or Pro
  SITE (321)..(321): Xaa at position 321 is Leu, Ala, Val, Gly, or Ile
  SITE (323)..(323): Xaa at position 323 is Ile, Ala, Val, Leu, or Gly
  SITE (325)..(325): Xaa at position 325 is Leu, Ala, Val, Gly, or Ile
  SITE (330)..(330): Xaa at position 330 is Val, Ala, Gly, Leu, or Ile
  SITE (339)..(339): Xaa at position 339 is Leu, Ala, Val, Gly, or Ile
  SITE (340)..(340): Xaa at position 340 is Cys, Ala, Val, Gly, Ser, or Thr
  SITE (341)..(341): Xaa at position 341 is Ile, Ala, Val, Leu, or Gly
  SITE (360)..(360): Xaa at position 360 is Ala, Gly, or Pro
  SITE (385)..(385): Xaa at position 385 is Cys, Ala, Val, Gly, Ser, or Thr
  SITE (394)..(394): Xaa at position 394 is Leu, Ala, Val, Gly, or Ile
  SITE (396)..(396): Xaa at position 396 is Cys, Ala, Val, Gly, Ser, or Thr
  SITE (397)..(397): Xaa at position 397 is Ala, Gly, or Pro
  SITE (399)..(399): Xaa at position 399 is Phe, Tyr, Met, His, Ile, Leu, Val Ala, or Gly
  SITE (405)..(405): Xaa at position 405 is Leu, Ala, Val, Gly, or Ile
  SITE (410)..(410): Xaa at position 410 is Val, Ala, Gly, Leu, or Ile
  SITE (415)..(415): Xaa at position 415 is Leu, Ala, Val, Gly, or Ile
  SITE (417)..(417): Xaa at position 417 is Tyr, Phe, Met, His, Ile, Leu, Val Ala, or Gly
  SITE (419)..(419): Xaa at position 419 is Val, Ala, Gly, Leu, or Ile
  SITE (421)..(421): Xaa at position 421 is Val, Ala, Gly, Leu, or Ile
  SITE (444)..(444): Xaa at position 444 is Ile, Ala, Val, Leu, or Gly
  SITE (453)..(453): Xaa at position 453 is Ile, Ala, Val, Leu, or Gly
  SITE (455)..(455): Xaa at position 455 is Leu, Ala, Val, Gly, or Ile
  SITE (461)..(461): Xaa at position 461 is Leu, Ala, Val, Gly, or Ile
  SITE (463)..(463): Xaa at position 463 is Leu, Ala, Val, Gly, or Ile
  SITE (465)..(465): Xaa at position 465 is Cys, Ala, Val, Gly, Ser, or Thr
  SITE (471)..(471): Xaa at position 471 is Leu, Ala, Val, Gly, or Ile
  SITE (477)..(477): Xaa at position 477 is Val, Ala, Gly, Leu, or Ile
  SITE (478)..(478): Xaa at position 478 is Leu, Ala, Val, Gly, or Ile
  SITE (479)..(479): Xaa at position 479 is Leu, Ala, Val, Gly, or Ile
  SITE (481)..(481): Xaa at position 481 is Met, Ile, Leu, Val, Ala, or Gly
  SITE (488)..(488): Xaa at position 488 is Val, Ala, Gly, Leu, or Ile
  SITE (493)..(493): Xaa at position 493 is Phe, Tyr, Met, His, Ile, Leu, Val Ala, or Gly
  SITE (517)..(517): Xaa at position 517 is Leu, Ala, Val, Gly, or Ile
  SITE (518)..(518): Xaa at position 518 is Val, Ala, Gly, Leu, or Ile
  SITE (544)..(544): Xaa at position 544 is Leu, Ala, Val, Gly, or Ile
  SITE (562)..(562): Xaa at position 562 is His, Phe, Tyr, Lys, Arg, Gly, Ser Thr, Ala, Val, Leu, Ile, Asn, Met, or Gln
  SITE (563)..(563): Xaa at position 563 is Leu, Ala, Val, Gly, or Ile
  SITE (565)..(565): Xaa at position 565 is Cys, Ala, Val, Gly, Ser, or Thr
  SITE (567)..(567): Xaa at position 567 is Leu, Ala, Val, Gly, or Ile
  SITE (569)..(569): Xaa at position 569 is Met, Ile, Leu, Val, Ala, or Gly
  SITE (572)..(572): Xaa at position 572 is Leu, Ala, Val, Gly, or Ile
  SITE (582)..(582): Xaa at position 582 is Cys, Ala, Val, Gly, Ser, or Thr
  SITE (586)..(586): Xaa at position 586 is Phe, Tyr, Met, His, Ile, Leu, Val Ala, or Gly
  SITE (592)..(592): Xaa at position 592 is Val, Ala, Gly, Leu, or Ile
  SITE (600)..(600): Xaa at position 600 is Val, Ala, Gly, Leu, or Ile
  SITE (602)..(602): Xaa at position 602 is Val, Ala, Gly, Leu, or Ile
  SITE (604)..(604): Xaa at position 604 is Val, Ala, Gly, Leu, or Ile
  SITE (606)..(606): Xaa at position 606 is Tyr, Phe, Met, His, Ile, Leu, Val Ala, or Gly
  SITE (613)..(613): Xaa at position 613 is Cys, Ala, Val, Gly, Ser, or Thr
  SITE (615)..(615): Xaa at position 615 is Ile, Ala, Val, Leu, or Gly
  SITE (632)..(632): Xaa at position 632 is Ile, Ala, Val, Leu, or Gly
  SITE (638)..(638): Xaa at position 638 is Val, Ala, Gly, Leu, or Ile
  SITE (647)..(647): Xaa at position 647 is Ile, Ala, Val, Leu, or Gly
  SITE (658)..(658): Xaa at position 658 is Ile, Ala, Val, Leu, or Gly
  SITE (660)..(660): Xaa at position 660 is Val, Ala, Gly, Leu, or Ile
  SITE (671)..(671): Xaa at position 671 is Trp, Tyr, Phe, Met, His, Ile, Leu Val, Ala, or Gly
  SITE (963)..(963): Xaa at position 963 is Ile, Ala, Val, Leu, or Gly
  SITE (993)..(993): Xaa at position 993 is Ile, Ala, Val, Leu, or Gly
  SITE (1396)..(1396): Xaa at position 1396 is Leu, Ala, Val, Gly, or Ile
  SITE (1398)..(1398): Xaa at position 1398 is Leu, Ala, Val, Gly, or Ile
  SITE (1497)..(1497): Xaa at position 1497 is Ile, Ala, Val, Leu, or Gly
  SITE (1498)..(1498): Xaa at position 1498 is Tyr, Phe, Met, His, Ile, Leu Val, Ala, or Gly
  SITE (1500)..(1500): Xaa at position 1500 is Ile, Ala, Val, Leu, or Gly
  SITE (1513)..(1513): Xaa at position 1513 is Val, Ala, Gly, Leu, or Ile
  SITE (1515)..(1515): Xaa at position 1515 is Val, Ala, Gly, Leu, or Ile
  SITE (1516)..(1516): Xaa at position 1516 is Phe, Tyr, Met, His, Ile, Leu Val, Ala, or Gly
  SITE (1520)..(1520): Xaa at position 1520 is Val, Ala, Gly, Leu, or Ile
  SITE (1521)..(1521): Xaa at position 1521 is Phe, Tyr, Met, His, Ile, Leu Val, Ala, or Gly
  SITE (1522)..(1522): Xaa at position 1522 is His, Phe, Tyr, Lys, Arg, Gly Ser, Thr, Ala, Val, Leu, Ile, Asn, Met, or Gln
  SITE (1524)..(1524): Xaa at position 1524 is Met, Ile, Leu, Val, Ala, or Gly
  SITE (1533)..(1533): Xaa at position 1533 is Leu, Ala, Val, Gly, or Ile
  SITE (1534)..(1534): Xaa at position 1534 is Met, Ile, Leu, Val, Ala, or Gly
  SITE (1547)..(1547): Xaa at position 1547 is Val, Ala, Gly, Leu, or Ile
  SITE (1551)..(1551): Xaa at position 1551 is Leu, Ala, Val, Gly, or Ile
  SITE (1552)..(1552): Xaa at position 1552 is Ile, Ala, Val, Leu, or Gly
  SITE (1554)..(1554): Xaa at position 1554 is Tyr, Phe, Met, His, Ile, Leu Val, Ala, or Gly
  SITE (1558)..(1558): Xaa at position 1558 is Trp, Tyr, Phe, Met, His, Ile Leu, Val, Ala, or Gly
  SITE (1560)..(1560): Xaa at position 1560 is Phe, Tyr, Met, His, Ile, Leu Val, Ala, or Gly
  SITE (1570)..(1570): Xaa at position 1570 is Val, Ala, Gly, Leu, or Ile
  SITE (1572)..(1572): Xaa at position 1572 is Val, Ala, Gly, Leu, or Ile
  SITE (1573)..(1573): Xaa at position 1573 is Ile, Ala, Val, Leu, or Gly
  SITE (1574)..(1574): Xaa at position 1574 is Ala, Gly, or Pro
  SITE (1575)..(1575): Xaa at position 1575 is Val, Ala, Gly, Leu, or Ile
  SITE (1584)..(1584): Xaa at position 1584 is Val, Ala, Gly, Leu, or Ile
  SITE (1591)..(1591): Xaa at position 1591 is Phe, Tyr, Met, His, Ile, Leu Val, Ala, or Gly
  SITE (1600)..(1600): Xaa at position 1600 is Ala, Gly, or Pro
  SITE (1601)..(1601): Xaa at position 1601 is Ile, Ala, Val, Leu, or Gly
  SITE (1614)..(1614): Xaa at position 1614 is Ile, Ala, Val, Leu, or Gly
  SITE (1615)..(1615): Xaa at position 1615 is Val, Ala, Gly, Leu, or Ile
  SITE (1622)..(1622): Xaa at position 1622 is Val, Ala, Gly, Leu, or Ile
  SITE (1624)..(1624): Xaa at position 1624 is Leu, Ala, Val, Gly, or Ile
  SITE (1625)..(1625): Xaa at position 1625 is Tyr, Phe, Met, His, Ile, Leu Val, Ala, or Gly
  SITE (1630)..(1630): Xaa at position 1630 is Val, Ala, Gly, Leu, or Ile
  SITE (1636)..(1636): Xaa at position 1636 is Tyr, Phe, Met, His, Ile, Leu Val, Ala, or Gly
  SITE (1637)..(1637): Xaa at position 1637 is Val, Ala, Gly, Leu, or Ile
  SITE (1643)..(1643): Xaa at position 1643 is Ala, Gly, or Pro
  SITE (1680)..(1680): Xaa at position 1680 is Leu, Ala, Val, Gly, or Ile
  SITE (1683)..(1683): Xaa at position 1683 is Ile, Ala, Val, Leu, or Gly
  SITE (1684)..(1684): Xaa at position 1684 is Val, Ala, Gly, Leu, or Ile
  SITE (1687)..(1687): Xaa at position 1687 is Ala, Gly, or Pro
  SITE (1695)..(1695): Xaa at position 1695 is Leu, Ala, Val, Gly, or Ile
  SITE (1696)..(1696): Xaa at position 1696 is Ile, Ala, Val, Leu, or Gly
  SITE (1697)..(1697): Xaa at position 1697 is Leu, Ala, Val, Gly, or Ile
  SITE (1698)..(1698): Xaa at position 1698 is Ala, Gly, or Pro
  SITE (1703)..(1703): Xaa at position 1703 is Val, Ala, Gly, Leu, or Ile
  SITE (1704)..(1704): Xaa at position 1704 is Ala, Gly, or Pro
  SITE (1707)..(1707): Xaa at position 1707 is Met, Ile, Leu, Val, Ala, or Gly
  SITE (1708)..(1708): Xaa at position 1708 is Ala, Gly, or Pro
  SITE (1711)..(1711): Xaa at position 1711 is Leu, Ala, Val, Gly, or Ile
  SITE (1733)..(1733): Xaa at position 1733 is Val, Ala, Gly, Leu, or Ile
  SITE (1735)..(1735): Xaa at position 1735 is Leu, Ala, Val, Gly, or Ile
  SITE (1736)..(1736): Xaa at position 1736 is Met, Ile, Leu, Val, Ala, or Gly
  SITE (1738)..(1738): Xaa at position 1738 is His, Phe, Tyr, Lys, Arg, Gly Ser, Thr, Ala, Val, Leu, Ile, Asn, Met, or Gln
  SITE (1741)..(1741): Xaa at position 1741 is Phe, Tyr, Met, His, Ile, Leu Val, Ala, or Gly
  SITE (1754)..(1754): Xaa at position 1754 is Tyr, Phe, Met, His, Ile, Leu Val, Ala, or Gly
  SITE (1756)..(1756): Xaa at position 1756 is Met, Ile, Leu, Val, Ala, or Gly
  SITE (1757)..(1757): Xaa at position 1757 is Ile, Ala, Val, Leu, or Gly
  SITE (1758)..(1758): Xaa at position 1758 is Ile, Ala, Val, Leu, or Gly
  SITE (1759)..(1759): Xaa at position 1759 is Met, Ile, Leu, Val, Ala, or Gly
  SITE (1762)..(1762): Xaa at position 1762 is Ala, Gly, or Pro
  SITE (1770)..(1770): Xaa at position 1770 is Ile, Ala, Val, Leu, or Gly
  SITE (1771)..(1771): Xaa at position 1771 is Ala, Gly, or Pro
  SITE (1772)..(1772): Xaa at position 1772 is Ala, Gly, or Pro
  SITE (1776)..(1776): Xaa at position 1776 is Ile, Ala, Val, Leu, or Gly
  SITE (1785)..(1785): Xaa at position 1785 is Ala, Gly, or Pro
  SITE (1786)..(1786): Xaa at position 1786 is Ala, Gly, or Pro
  SITE (1787)..(1787): Xaa at position 1787 is Ala, Gly, or Pro
  SITE (1788)..(1788): Xaa at position 1788 is Ile, Ala, Val, Leu, or Gly
  SITE (1789)..(1789): Xaa at position 1789 is Phe, Tyr, Met, His, Ile, Leu Val, Ala, or Gly
  SITE (1790)..(1790): Xaa at position 1790 is Met, Ile, Leu, Val, Ala, or Gly
  SITE (1827)..(1827): Xaa at position 1827 is Ile, Ala, Val, Leu, or Gly
  SITE (1835)..(1835): Xaa at position 1835 is Val, Ala, Gly, Leu, or Ile
  SITE (1836)..(1836): Xaa at position 1836 is Trp, Tyr, Phe, Met, His, Ile Leu, Val, Ala, or Gly
  SITE (1837)..(1837): Xaa at position 1837 is Phe, Tyr, Met, His, Ile, Leu Val, Ala, or Gly
  SITE (1838)..(1838): Xaa at position 1838 is Val, Ala, Gly, Leu, or Ile
  SITE (1847)..(1847): Xaa at position 1847 is Ile, Ala, Val, Leu, or Gly
  SITE (1848)..(1848): Xaa at position 1848 is Ala, Gly, or Pro
  SITE (1850)..(1850): Xaa at position 1850 is Cys, Ala, Val, Gly, Ser, or Thr
  SITE (1851)..(1851): Xaa at position 1851 is Leu, Ala, Val, Gly, or Ile
  SITE (1859)..(1859): Xaa at position 1859 is Ile, Ala, Val, Leu, or Gly
  SITE (1861)..(1861): Xaa at position 1861 is Leu, Ala, Val, Gly, or Ile
  SITE (1866)..(1866): Xaa at position 1866 is Phe, Tyr, Met, His, Ile, Leu Val, Ala, or Gly
  SITE (1878)..(1878): Xaa at position 1878 is Trp, Tyr, Phe, Met, His, Ile Leu, Val, Ala, or Gly
  SITE (1880)..(1880): Xaa at position 1880 is Tyr, Phe, Met, His, Ile, Leu Val, Ala, or Gly
  SITE (1881)..(1881): Xaa at position 1881 is Val, Ala, Gly, Leu, or Ile
  SITE (1882)..(1882): Xaa at position 1882 is Val, Ala, Gly, Leu, or Ile
  SITE (1891)..(1891): Xaa at position 1891 is Ala, Gly, or Pro
  SITE (1898)..(1898): Xaa at position 1898 is Val, Ala, Gly, Leu, or Ile
  SITE (1899)..(1899): Xaa at position 1899 is Ile, Ala, Val, Leu, or Gly
  SITE (1917)..(1917): Xaa at position 1917 is Val, Ala, Gly, Leu, or Ile
  SITE (1925)..(1925): Xaa at position 1925 is Val, Ala, Gly, Leu, or Ile
  SITE (1928)..(1928): Xaa at position 1928 is Ala, Gly, or Pro
  SITE (1930)..(1930): Xaa at position 1930 is Ala, Gly, or Pro
  SITE (1931)..(1931): Xaa at position 1931 is Ala, Gly, or Pro
  SITE (1937)..(1937): Xaa at position 1937 is Ile, Ala, Val, Leu, or Gly
  SITE (1948)..(1948): Xaa at position 1948 is Tyr, Phe, Met, His, Ile, Leu Val, Ala, or Gly
  SITE (1949)..(1949): Xaa at position 1949 is Val, Ala, Gly, Leu, or Ile
  SITE (1955)..(1955): Xaa at position 1955 is Leu, Ala, Val, Gly, or Ile
  SITE (1962)..(1962): Xaa at position 1962 is Ala, Gly, or Pro
  SITE (1967)..(1967): Xaa at position 1967 is Ala, Gly, or Pro
  SITE (1970)..(1970): Xaa at position 1970 is Leu, Ala, Val, Gly, or Ile
  SITE (1971)..(1971): Xaa at position 1971 is Leu, Ala, Val, Gly, or Ile
  SITE (1974)..(1974): Xaa at position 1974 is Ile, Ala, Val, Leu, or Gly
  SITE (1984)..(1984): Xaa at position 1984 is Leu, Ala, Val, Gly, or Ile
  SITE (2009)..(2009): Xaa at position 2009 is Phe, Tyr, Met, His, Ile, Leu Val, Ala, or Gly
  SITE (2010)..(2010): Xaa at position 2010 is Val, Ala, Gly, Leu, or Ile
  SITE (2012)..(2012): Xaa at position 2012 is Leu, Ala, Val, Gly, or Ile
  SITE (2018)..(2018): Xaa at position 2018 is Leu, Ala, Val, Gly, or Ile
  SITE (2021)..(2021): Xaa at position 2021 is Trp, Tyr, Phe, Met, His, Ile Leu, Val, Ala, or Gly
  SITE (2022)..(2022): Xaa at position 2022 is Leu, Ala, Val, Gly, or Ile
  SITE (2026)..(2026): Xaa at position 2026 is Val, Ala, Gly, Leu, or Ile
  SITE (2027)..(2027): Xaa at position 2027 is Ala, Gly, or Pro
  SITE (2038)..(2038): Xaa at position 2038 is Trp, Tyr, Phe, Met, His, Ile Leu, Val, Ala, or Gly
  SITE (2039)..(2039): Xaa at position 2039 is Cys, Ala, Val, Gly, Ser, or Thr
  SITE (2048)..(2048): Xaa at position 2048 is Val, Ala, Gly, Leu, or Ile
  SITE (2057)..(2057): Xaa at position 2057 is Ile, Ala, Val, Leu, or Gly
  SITE (2067)..(2067): Xaa at position 2067 is Leu, Ala, Val, Gly, or Ile
  SITE (2074)..(2074): Xaa at position 2074 is Ala, Gly, or Pro
  SITE (2086)..(2086): Xaa at position 2086 is Phe, Tyr, Met, His, Ile, Leu Val, Ala, or Gly
  SITE (2089)..(2089): Xaa at position 2089 is Phe, Tyr, Met, His, Ile, Leu Val, Ala, or Gly
  SITE (2090)..(2090): Xaa at position 2090 is Ala, Gly, or Pro
  SITE (2506)..(2506): Xaa at position 2506 is Trp, Tyr, Phe, Met, His, Ile Leu, Val, Ala, or Gly
  SITE (2521)..(2521): Xaa at position 2521 is Tyr, Phe, Met, His, Ile, Leu Val, Ala, or Gly
  SITE (2526)..(2526): Xaa at position 2526 is Ile, Ala, Val, Leu, or Gly
  SITE (2529)..(2529): Xaa at position 2529 is Val, Ala, Gly, Leu, or Ile
  SITE (2538)..(2538): Xaa at position 2538 is Leu, Ala, Val, Gly, or Ile
  SITE (2547)..(2547): Xaa at position 2547 is Ala, Gly, or Pro
  SITE (2548)..(2548): Xaa at position 2548 is Val, Ala, Gly, Leu, or Ile
  SITE (2553)..(2553): Xaa at position 2553 is Ala, Gly, or Pro
  SITE (2555)..(2555): Xaa at position 2555 is Leu, Ala, Val, Gly, or Ile
  SITE (2558)..(2558): Xaa at position 2558 is Phe, Tyr, Met, His, Ile, Leu Val, Ala, or Gly
  SITE (2559)..(2559): Xaa at position 2559 is Val, Ala, Gly, Leu, or Ile
  SITE (2564)..(2564): Xaa at position 2564 is Val, Ala, Gly, Leu, or Ile
  SITE (2570)..(2570): Xaa at position 2570 is Val, Ala, Gly, Leu, or Ile
  SITE (2571)..(2571): Xaa at position 2571 is Ile, Ala, Val, Leu, or Gly
  SITE (2573)..(2573): Xaa at position 2573 is Leu, Ala, Val, Gly, or Ile
  SITE (2575)..(2575): Xaa at position 2575 is Cys, Ala, Val, Gly, Ser, or Thr
  SITE (2584)..(2584): Xaa at position 2584 is Cys, Ala, Val, Gly, Ser, or Thr
  SITE (2585)..(2585): Xaa at position 2585 is Ala, Gly, or Pro
  SITE (2590)..(2590): Xaa at position 2590 is Val, Ala, Gly, Leu, or Ile
  SITE (2593)..(2593): Xaa at position 2593 is Val, Ala, Gly, Leu, or Ile
  SITE (2596)..(2596): Xaa at position 2596 is Tyr, Phe, Met, His, Ile, Leu Val, Ala, or Gly
  SITE (2625)..(2625): Xaa at position 2625 is Val, Ala, Gly, Leu, or Ile
  SITE (2633)..(2633): Xaa at position 2633 is Cys, Ala, Val, Gly, Ser, or Thr
  SITE (2636)..(2636): Xaa at position 2636 is Leu, Ala, Val, Gly, or Ile
  SITE (2637)..(2637): Xaa at position 2637 is Leu, Ala, Val, Gly, or Ile
  SITE (2638)..(2638): Xaa at position 2638 is Cys, Ala, Val, Gly, Ser, or Thr
  SITE (2649)..(2649): Xaa at position 2649 is Ile, Ala, Val, Leu, or Gly
  SITE (2655)..(2655): Xaa at position 2655 is Leu, Ala, Val, Gly, or Ile
  SITE (2657)..(2657): Xaa at position 2657 is Val, Ala, Gly, Leu, or Ile
  SITE (2658)..(2658): Xaa at position 2658 is Leu, Ala, Val, Gly, or Ile
  SITE (2661)..(2661): Xaa at position 2661 is Val, Ala, Gly, Leu, or Ile
  SITE (2664)..(2664): Xaa at position 2664 is Trp, Tyr, Phe, Met, His, Ile Leu, Val, Ala, or Gly
  SITE (2665)..(2665): Xaa at position 2665 is Leu, Ala, Val, Gly, or Ile
  SITE (2671)..(2671): Xaa at position 2671 is Cys, Ala, Val, Gly, Ser, or Thr
  SITE (2672)..(2672): Xaa at position 2672 is Ile, Ala, Val, Leu, or Gly
  SITE (2674)..(2674): Xaa at position 2674 is Ile, Ala, Val, Leu, or Gly
  SITE (2675)..(2675): Xaa at position 2675 is Leu, Ala, Val, Gly, or Ile
  SITE (2678)..(2678): Xaa at position 2678 is Tyr, Phe, Met, His, Ile, Leu Val, Ala, or Gly
  SITE (2682)..(2682): Xaa at position 2682 is Val, Ala, Gly, Leu, or Ile
  SITE (2686)..(2686): Xaa at position 2686 is Leu, Ala, Val, Gly, or Ile
  SITE (2689)..(2689): Xaa at position 2689 is Met, Ile, Leu, Val, Ala, or Gly
  SITE (2696)..(2696): Xaa at position 2696 is Met, Ile, Leu, Val, Ala, or Gly
  SITE (2697)..(2697): Xaa at position 2697 is Leu, Ala, Val, Gly, or Ile
  SITE (2708)..(2708): Xaa at position 2708 is His, Phe, Tyr, Lys, Arg, Gly Ser, Thr, Ala, Val, Leu, Ile, Asn, Met, or Gln
  SITE (2710)..(2710): Xaa at position 2710 is Met, Ile, Leu, Val, Ala, or Gly
  SITE (2711)..(2711): Xaa at position 2711 is Tyr, Phe, Met, His, Ile, Leu Val, Ala, or Gly
  SITE (2712)..(2712): Xaa at position 2712 is Trp, Tyr, Phe, Met, His, Ile Leu, Val, Ala, or Gly
  SITE (2713)..(2713): Xaa at position 2713 is Val, Ala, Gly, Leu, or Ile
  SITE (2720)..(2720): Xaa at position 2720 is Ile, Ala, Val, Leu, or Gly
  SITE (2724)..(2724): Xaa at position 2724 is Val, Ala, Gly, Leu, or Ile
  SITE (2730)..(2730): Xaa at position 2730 is Met, Ile, Leu, Val, Ala, or Gly
  SITE (2731)..(2731): Xaa at position 2731 is Leu, Ala, Val, Gly, or Ile
  SITE (2769)..(2769): Xaa at position 2769 is Ile, Ala, Val, Leu, or Gly
  SITE (2776)..(2776): Xaa at position 2776 is Ile, Ala, Val, Leu, or Gly
  SITE (2817)..(2817): Xaa at position 2817 is Val, Ala, Gly, Leu, or Ile
  SITE (2820)..(2820): Xaa at position 2820 is Leu, Ala, Val, Gly, or Ile
  SITE (2824)..(2824): Xaa at position 2824 is Trp, Tyr, Phe, Met, His, Ile Leu, Val, Ala, or Gly
  SITE (2865)..(2865): Xaa at position 2865 is Ile, Ala, Val, Leu, or Gly
  SITE (2866)..(2866): Xaa at position 2866 is Met, Ile, Leu, Val, Ala, or Gly
  SITE (2870)..(2870): Xaa at position 2870 is Ala, Gly, or Pro
  SITE (2873)..(2873): Xaa at position 2873 is Leu, Ala, Val, Gly, or Ile
  SITE (2904)..(2904): Xaa at position 2904 is Val, Ala, Gly, Leu, or Ile
  SITE (2914)..(2914): Xaa at position 2914 is Ala, Gly, or Pro
  SITE (2917)..(2917): Xaa at position 2917 is Ala, Gly, or Pro
  SITE (2923)..(2923): Xaa at position 2923 is Phe, Tyr, Met, His, Ile, Leu Val, Ala, or Gly
  SITE (2939)..(2939): Xaa at position 2939 is Cys, Ala, Val, Gly, Ser, or Thr
  SITE (2942)..(2942): Xaa at position 2942 is Cys, Ala, Val, Gly, Ser, or Thr
  SITE (2943)..(2943): Xaa at position 2943 is Val, Ala, Gly, Leu, or Ile
  SITE (2944)..(2944): Xaa at position 2944 is Tyr, Phe, Met, His, Ile, Leu Val, Ala, or Gly
  SITE (2969)..(2969): Xaa at position 2969 is Met, Ile, Leu, Val, Ala, or Gly
  SITE (2971)..(2971): Xaa at position 2971 is Leu, Ala, Val, Gly, or Ile
  SITE (2973)..(2973): Xaa at position 2973 is Ala, Gly, or Pro
  SITE (2976)..(2976): Xaa at position 2976 is Leu, Ala, Val, Gly, or Ile
  SITE (2980)..(2980): Xaa at position 2980 is Ala, Gly, or Pro
  SITE (2983)..(2983): Xaa at position 2983 is Phe, Tyr, Met, His, Ile, Leu Val, Ala, or Gly
  SITE (2984)..(2984): Xaa at position 2984 is Met, Ile, Leu, Val, Ala, or Gly
  SITE (2989)..(2989): Xaa at position 2989 is Trp, Tyr, Phe, Met, His, Ile Leu, Val, Ala, or Gly
  SITE (2990)..(2990): Xaa at position 2990 is Phe, Tyr, Met, His, Ile, Leu Val, Ala, or Gly
  SITE (2999)..(2999): Xaa at position 2999 is Val, Ala, Gly, Leu, or Ile
  SITE (3007)..(3007): Xaa at position 3007 is Leu, Ala, Val, Gly, or Ile
  SITE (3009)..(3009): Xaa at position 3009 is Tyr, Phe, Met, His, Ile, Leu Val, Ala, or Gly
  SITE (3011)..(3011): Xaa at position 3011 is Leu, Ala, Val, Gly, or Ile
  SITE (3014)..(3014): Xaa at position 3014 is Ile, Ala, Val, Leu, or Gly
  SITE (3017)..(3017): Xaa at position 3017 is Ile, Ala, Val, Leu, or Gly
  SITE (3022)..(3022): Xaa at position 3022 is Met, Ile, Leu, Val, Ala, or Gly
  SITE (3034)..(3034): Xaa at position 3034 is Ile, Ala, Val, Leu, or Gly
  SITE (3057)..(3057): Xaa at position 3057 is Ala, Gly, or Pro
  SITE (3060)..(3060): Xaa at position 3060 is Ile, Ala, Val, Leu, or Gly
  SITE (3065)..(3065): Xaa at position 3065 is Tyr, Phe, Met, His, Ile, Leu Val, Ala, or Gly
  SITE (3069)..(3069): Xaa at position 3069 is Val, Ala, Gly, Leu, or Ile
  SITE (3070)..(3070): Xaa at position 3070 is Val, Ala, Gly, Leu, or Ile
  SITE (3072)..(3072): Xaa at position 3072 is Val, Ala, Gly, Leu, or Ile
  SITE (3081)..(3081): Xaa at position 3081 is Val, Ala, Gly, Leu, or Ile
  SITE (3084)..(3084): Xaa at position 3084 is Val, Ala, Gly, Leu, or Ile
  SITE (3085)..(3085): Xaa at position 3085 is Ile, Ala, Val, Leu, or Gly
  SITE (3101)..(3101): Xaa at position 3101 is Leu, Ala, Val, Gly, or Ile
  SITE (3104)..(3104): Xaa at position 3104 is Phe, Tyr, Met, His, Ile, Leu Val, Ala, or Gly
  SITE (3107)..(3107): Xaa at position 3107 is Met, Ile, Leu, Val, Ala, or Gly
  SITE (3109)..(3109): Xaa at position 3109 is Val, Ala, Gly, Leu, or Ile
  SITE (3111)..(3111): Xaa at position 3111 is Leu, Ala, Val, Gly, or Ile
  SITE (3112)..(3112): Xaa at position 3112 is Ile, Ala, Val, Leu, or Gly
  SITE (3115)..(3115): Xaa at position 3115 is Met, Ile, Leu, Val, Ala, or Gly
  SITE (3126)..(3126): Xaa at position 3126 is Leu, Ala, Val, Gly, or Ile
  SITE (3135)..(3135): Xaa at position 3135 is Val, Ala, Gly, Leu, or Ile
  SITE (3139)..(3139): Xaa at position 3139 is Leu, Ala, Val, Gly, or Ile
  SITE (3147)..(3147): Xaa at position 3147 is Leu, Ala, Val, Gly, or Ile
  SITE (3150)..(3150): Xaa at position 3150 is Met, Ile, Leu, Val, Ala, or Gly
  SITE (3151)..(3151): Xaa at position 3151 is Ala, Gly, or Pro
  SITE (3152)..(3152): Xaa at position 3152 is Ile, Ala, Val, Leu, or Gly
  SITE (3158)..(3158): Xaa at position 3158 is Val, Ala, Gly, Leu, or Ile
  SITE (3159)..(3159): Xaa at position 3159 is Val, Ala, Gly, Leu, or Ile
  SITE (3166)..(3166): Xaa at position 3166 is Phe, Tyr, Met, His, Ile, Leu Val, Ala, or Gly
  SITE (3169)..(3169): Xaa at position 3169 is Ala, Gly, or Pro
  SITE (3170)..(3170): Xaa at position 3170 is Leu, Ala, Val, Gly, or Ile
  SITE (3172)..(3172): Xaa at position 3172 is Ala, Gly, or Pro
  SITE (3173)..(3173): Xaa at position 3173 is Leu, Ala, Val, Gly, or Ile
  SITE (3176)..(3176): Xaa at position 3176 is Met, Ile, Leu, Val, Ala, or Gly
  SITE (3198)..(3198): Xaa at position 3198 is Val, Ala, Gly, Leu, or Ile
  SITE (3200)..(3200): Xaa at position 3200 is Phe, Tyr, Met, His, Ile, Leu Val, Ala, or Gly
  SITE (3205)..(3205): Xaa at position 3205 is Phe, Tyr, Met, His, Ile, Leu Val, Ala, or Gly
  SITE (3216)..(3216): Xaa at position 3216 is Ile, Ala, Val, Leu, or Gly
  SITE (3217)..(3217): Xaa at position 3217 is Val, Ala, Gly, Leu, or Ile
  SITE (3218)..(3218): Xaa at position 3218 is Val, Ala, Gly, Leu, or Ile
  SITE (3220)..(3220): Xaa at position 3220 is Cys, Ala, Val, Gly, Ser, or Thr
  SITE (3227)..(3227): Xaa at position 3227 is Val, Ala, Gly, Leu, or Ile
  SITE (3230)..(3230): Xaa at position 3230 is Ala, Gly, or Pro
  SITE (3236)..(3236): Xaa at position 3236 is Ala, Gly, or Pro
  SITE (3244)..(3244): Xaa at position 3244 is Ala, Gly, or Pro
  SITE (3251)..(3251): Xaa at position 3251 is Ala, Gly, or Pro
  SITE (3254)..(3254): Xaa at position 3254 is Trp, Tyr, Phe, Met, His, Ile Leu, Val, Ala, or Gly
  SITE (3256)..(3256): Xaa at position 3256 is Leu, Ala, Val, Gly, or Ile
  SITE (3259)..(3259): Xaa at position 3259 is Phe, Tyr, Met, His, Ile, Leu Val, Ala, or Gly
  SITE (3260)..(3260): Xaa at position 3260 is His, Phe, Tyr, Lys, Arg, Gly Ser, Thr, Ala, Val, Leu, Ile, Asn, Met, or Gln
  SITE (3264)..(3264): Xaa at position 3264 is Leu, Ala, Val, Gly, or Ile
  SITE (3267)..(3267): Xaa at position 3267 is Ala, Gly, or Pro
  SITE (3268)..(3268): Xaa at position 3268 is Ala, Gly, or Pro
  SITE (3270)..(3270): Xaa at position 3270 is Ala, Gly, or Pro
  SITE (3271)..(3271): Xaa at position 3271 is Ile, Ala, Val, Leu, or Gly
  SITE (3274)..(3274): Xaa at position 3274 is Ala, Gly, or Pro
  SITE (3275)..(3275): Xaa at position 3275 is Val, Ala, Gly, Leu, or Ile
  SITE (3277)..(3277): Xaa at position 3277 is Val, Ala, Gly, Leu, or Ile
  SITE (3290)..(3290): Xaa at position 3290 is His, Phe, Tyr, Lys, Arg, Gly Ser, Thr, Ala, Val, Leu, Ile, Asn, Met, or Gln
  SITE (3302)..(3302): Xaa at position 3302 is Leu, Ala, Val, Gly, or Ile
  SITE (3305)..(3305): Xaa at position 3305 is Trp, Tyr, Phe, Met, His, Ile Leu, Val, Ala, or Gly
  SITE (3308)..(3308): Xaa at position 3308 is Val, Ala, Gly, Leu, or Ile
  SITE (3309)..(3309): Xaa at position 3309 is Trp, Tyr, Phe, Met, His, Ile Leu, Val, Ala, or Gly
  SITE (3315)..(3315): Xaa at position 3315 is Trp, Tyr, Phe, Met, His, Ile Leu, Val, Ala, or Gly
  SITE (3328)..(3328): Xaa at position 3328 is Val, Ala, Gly, Leu, or Ile
  SITE (3331)..(3331): Xaa at position 3331 is Leu, Ala, Val, Gly, or Ile
  SITE (3352)..(3352): Xaa at position 3352 is Ala, Gly, or Pro
  SITE (3355)..(3355): Xaa at position 3355 is Ile, Ala, Val, Leu, or Gly
  SITE (3359)..(3359): Xaa at position 3359 is Ile, Ala, Val, Leu, or Gly
  SITE (3365)..(3365): Xaa at position 3365 is Leu, Ala, Val, Gly, or Ile
  SITE (3372)..(3372): Xaa at position 3372 is Leu, Ala, Val, Gly, or Ile
  SITE (3375)..(3375): Xaa at position 3375 is Met, Ile, Leu, Val, Ala, or Gly
  SITE (3378)..(3378): Xaa at position 3378 is Met, Ile, Leu, Val, Ala, or Gly
MNNQRKKTGRPSFNMLKRARNRVSTGSQXAKRFSKGLLSGQGPMKLVXAFIAFLRFLAIPPTAGILARWSSFKKNGAIKVLRGFKKEISSMLNIMNRRKRSVTMLLMLLPTALAFHLTTRGGEPHXIXSKQERGKSLLFKTSAGVNMXTLIAMDLGELCEDTMTYKXPRITEAEPDDVDXWXNATDTWXTXGTCSQTGEHRRDKRSVALAPHVGLGLETRTETWMSSEGAWKQIQKVETWALRHPGFTVIXLFLXHAIGTSITQKGIIFILLMLVTPSMAXRXVGIGNRDFVEGLSGATWXDXXXEHGSXXTTXXKNKPTXDXEXLKTEXTNPAVLRKXXXEAKISNTTTDSRCPTQGEXTLVEEQDANFVCRRTFVDRGWGNGXGLFGKGSLXTXXKXKCVTKXEGKIXQYENXKXSXIXTVHTGDQHQVGNETTEHGTIATXTPQAPTSEXQXTDYGAXTXDXSPRTGXDFNEMXXXTXKEKSWLXHKQWXLDLPLPWTSGASTSQETWNRQDLXXTFKTAHAKKQEVVVLGSQEGAMHTAXTGATEIQTSGTTTIFAGXXKXRXKXDKXTLKGTSYVMXTGSXKLEKEXAETQHGTXLXQXKXEGTDAPXKXPFSTQDEKGVTQNGRLXTANPIXTDKEKPVNXETEPPFGESYXVXGAGEKALKLSXFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAXKDSKAVHADMGYWIESEKNETWKLARASFXEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADXSXEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGXXRXLQRGLLGRSQVGXGXXQDGXXXTXWHVTRGAVXXYQGKRLEPSWASXKKDXXSXGGGXRXQGSWNTGEEXQXXXXEPGKNPKNXQTTPGTXKTPEGEVGXXALDFKPGTSGSPXXNREGKIXGXXGNGVXTTSGTXXSAIAQXKASQEGPLPEIEDEVFKKRNLTIMDLHPGSGKTRRYXPAXXREXIKRKLRTXXXXPTRVXXSEXXEAXKGMPIRYQTTAVKSEHTGREIXDXXCXATXTMRLLSPVRVPNXNXXXXDEXHFTDPASXXXRGYXSTRVGMGEXXXXXXTATPPGSVEAFPQSNAVIQDEERDIPERSWNSGYDWXTDFPGKTXXXXPSIKSGNDXXNXXRKNGKRVXQXSRKTXDTEYQKTKNNDXDXXXTTDISEMGXNFRADRXXDPRRCLKPVILKDGPERXILAGPMPXTVXSXXQRRGRXGRNQNKEGDQXXYMGQPXNNDEDHXHWTEXKMXXDNXNTPEGIIPAXFEPEREKSAAIDGEYRLRGEARKTXXEXMRRGDXPVXXSYKXXSEGFQYSDRRXXFDGERNNQXLEENMDVEXWTKEGERKKXRPRWLDXRTYSDPLALREXKEXXAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATILDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKXKRQLNQLSKSEFNTXKRSGXMEXDRSEAKEGXKRGETTKHXXSRGTXKXRWXXERNLXKPEGKXXDXGXGRGGWSYYXXGLKKXTEXKGXTKGGPGHEEPIPMATYGWNLVKLHSGKDXFFMPPEKXDTXXXDIGESSPNPTXEEGRTXRXXKMXEPXXRGNQFXXKXXNPXMPSXVETXEQXQRKHGGXXVRNPLSRNSTXEXXXXSCGTGNXVSAXNMTSRXXLNRFTMAHRKPTYERDVDLGAGTRHVAVEPEVANLDIXGQRIENXKNEHKSTWHYDEDNPYKTWAYHGSYEVKPSGSASSMVNGVXRLXTKPXDVIPMVTQIAMTDTTPFGQQRVFKEKVDTRTPRAKRGTAQXXEVTXKWXWGFLSRNKKPRICTREEFTRKVRSNAAIGAXFVDENQWNSXKEXVEDERXWDLVHRERELHKQGKXATXXXNMMGKREKKLGEFGKAKGSRAIWYXWXGXRFXEFEXLGXXNEDHXXSRENSLSGXEGEGLHKXGXIXRDXSKXPGGNXYADDTAGWDTRXTEDDLQNEAKITDIMEPEHALLXTSXFKLTXQNKXXRXQRPAKNGTXMDXXSRRDQRGSGQVGTYGXNTXTNXEXQXXRQXESEGIFFPSEXESPNLAERXLDWXEKHGAERXKRXXXSGDDCXXKPIDDRXATXXIXXNDXGKVRKDIPQWEPSKGWNDWQQXPXCSHHXHQLIMKDGREXXXPXRNQDELXGRXRVSQGXGWSLRETXCLGKSYXQMXQXMYXXRRDXRLXXNXXCSXXPXDWVPTSRTTWSIXAHHQWMTTEDMXSVXNRXXIEENPXMEDKTHVSSWEEXPYXGKREDQWCGSLIGLTARATWXTNXQVAXNQVRRXIGNENYXDYXTSXKRFKNESDPEGALW

SEQ ID NO: 427 - protein, 398 aa, Homo sapiens
  SITE (46)..(46): Xaa at position 46 is Val, Ala, Gly, Leu, or Ile
  SITE (48)..(48): Xaa at position 48 is Leu, Ala, Val, Gly, or Ile
  SITE (69)..(69): Xaa at position 69 is Trp, Tyr, Phe, Met, His, Ile, Leu Val, Ala, or Gly
  SITE (92)..(92): Xaa at position 92 is Ala, Gly, or Pro
  SITE (93)..(93): Xaa at position 93 is Leu, Ala, Val, Gly, or Ile
  SITE (95)..(95): Xaa at position 95 is Leu, Ala, Val, Gly, or Ile
  SITE (98)..(98): Xaa at position 98 is Ala, Gly, or Pro
  SITE (108)..(108): Xaa at position 108 is Cys, Ala, Val, Gly, Ser, or Thr
  SITE (121)..(121): Xaa at position 121 is Ile, Ala, Val, Leu, or Gly
  SITE (150)..(150): Xaa at position 150 is Leu, Ala, Val, Gly, or Ile
  SITE (169)..(169): Xaa at position 169 is Trp, Tyr, Phe, Met, His, Ile, Leu Val, Ala, or Gly
  SITE (192)..(192): Xaa at position 192 is Leu, Ala, Val, Gly, or Ile
  SITE (194)..(194): Xaa at position 194 is Val, Ala, Gly, Leu, or Ile
  SITE (205)..(205): Xaa at position 205 is Tyr, Phe, Met, His, Ile, Leu, Val Ala, or Gly
  SITE (207)..(207): Xaa at position 207 is Cys, Ala, Val, Gly, Ser, or Thr
  SITE (220)..(220): Xaa at position 220 is Ile, Ala, Val, Leu, or Gly
  SITE (224)..(224): Xaa at position 224 is Ile, Ala, Val, Leu, or Gly
  SITE (258)..(258): Xaa at position 258 is Cys, Ala, Val, Gly, Ser, or Thr
  SITE (260)..(260): Xaa at position 260 is Val, Ala, Gly, Leu, or Ile
  SITE (262)..(262): Xaa at position 262 is Leu, Ala, Val, Gly, or Ile
  SITE (276)..(276): Xaa at position 276 is Ala, Gly, or Pro
  SITE (281)..(281): Xaa at position 281 is Ile, Ala, Val, Leu, or Gly
  SITE (328)..(328): Xaa at position 328 is Val, Ala, Gly, Leu, or Ile
MLRLYVLVMGVSAFTLQPAAHTGAARSCRFRGRHYKREFRLEGEPXAXRCPQVPYWLWASVSPRINLTXHKNDSARTVPGEEETRMWAQDGXXWXLPXLQEDSGTYVXTTRNASYCDKMSXELRVFENTDAFLPFISYPQILTLSTSGVXVCPDLSEFTRDKTDVKIQXYKDSLLLDKDNEKFLSVRGTTHXLXHDVALEDAGYXRXVLTFAHEGQQYNXTRSXELRIKKKKEETIPVIISPLKTISASLGSRLTIPXKXFXGTGTPLTTMLWWTXNDTHXESAYPGGRVTEGPRQEYSENNENYIEVPLIFDPVTREDLHMDFKCVXHNTLSFQTLRTTVKEASSTFSWGIVLAPLSLAFLVLGGIWMHRRCKHRTGKADGLTVLWPHHQDFQSYPK

SEQ ID NO: 428 - protein, 3011 aa, Hepatitis C virus
  genotype 1a (isolate H) (HCV)
  SITE (194)..(194): Xaa at position 194 is Val, Ala, Gly, Leu, or Ile
  SITE (203)..(203): Xaa at position 203 is Val, Ala, Gly, Leu, or Ile
  SITE (207)..(207): Xaa at position 207 is Cys, Ala, Val, Gly, Ser, or Thr
  SITE (226)..(226): Xaa at position 226 is Cys, Ala, Val, Gly, Ser, or Thr
  SITE (229)..(229): Xaa at position 229 is Cys, Ala, Val, Gly, Ser, or Thr
  SITE (230)..(230): Xaa at position 230 is Val, Ala, Gly, Leu, or Ile
  SITE (238)..(238): Xaa at position 238 is Cys, Ala, Val, Gly, Ser, or Thr
  SITE (239)..(239): Xaa at position 239 is Trp, Tyr, Phe, Met, His, Ile, Leu Val, Ala, or Gly
  SITE (240)..(240): Xaa at position 240 is Val, Ala, Gly, Leu, or Ile
  SITE (258)..(258): Xaa at position 258 is Leu, Ala, Val, Gly, or Ile
  SITE (262)..(262): Xaa at position 262 is Ile, Ala, Val, Leu, or Gly
  SITE (265)..(265): Xaa at position 265 is Leu, Ala, Val, Gly, or Ile
  SITE (269)..(269): Xaa at position 269 is Ala, Gly, or Pro
  SITE (272)..(272): Xaa at position 272 is Cys, Ala, Val, Gly, Ser, or Thr
  SITE (275)..(275): Xaa at position 275 is Leu, Ala, Val, Gly, or Ile
  SITE (281)..(281): Xaa at position 281 is Cys, Ala, Val, Gly, Ser, or Thr
  SITE (286)..(286): Xaa at position 286 is Leu, Ala, Val, Gly, or Ile
  SITE (291)..(291): Xaa at position 291 is Phe, Tyr, Met, His, Ile, Leu, Val Ala, or Gly
  SITE (353)..(353): Xaa at position 353 is Trp, Tyr, Phe, Met, His, Ile, Leu Val, Ala, or Gly
  SITE (355)..(355): Xaa at position 355 is Val, Ala, Gly, Leu, or Ile
  SITE (426)..(426): Xaa at position 426 is Ala, Gly, or Pro
  SITE (427)..(427): Xaa at position 427 is Leu, Ala, Val, Gly, or Ile
  SITE (437)..(437): Xaa at position 437 is Trp, Tyr, Phe, Met, His, Ile, Leu Val, Ala, or Gly
  SITE (442)..(442): Xaa at position 442 is Phe, Tyr, Met, His, Ile, Leu, Val Ala, or Gly
  SITE (459)..(459): Xaa at position 459 is Cys, Ala, Val, Gly, Ser, or Thr
  SITE (465)..(465): Xaa at position 465 is Phe, Tyr, Met, His, Ile, Leu, Val Ala, or Gly
  SITE (486)..(486): Xaa at position 486 is Cys, Ala, Val, Gly, Ser, or Thr
  SITE (494)..(494): Xaa at position 494 is Cys, Ala, Val, Gly, Ser, or Thr
  SITE (499)..(499): Xaa at position 499 is Ala, Gly, or Pro
  SITE (502)..(502): Xaa at position 502 is Val, Ala, Gly, Leu, or Ile
  SITE (503)..(503): Xaa at position 503 is Cys, Ala, Val, Gly, Ser, or Thr
  SITE (506)..(506): Xaa at position 506 is Val, Ala, Gly, Leu, or Ile
  SITE (508)..(508): Xaa at position 508 is Cys, Ala, Val, Gly, Ser, or Thr
  SITE (509)..(509): Xaa at position 509 is Phe, Tyr, Met, His, Ile, Leu, Val Ala, or Gly
  SITE (537)..(537): Xaa at position 537 is Phe, Tyr, Met, His, Ile, Leu, Val Ala, or Gly
  SITE (539)..(539): Xaa at position 539 is Leu, Ala, Val, Gly, or Ile
  SITE (549)..(549): Xaa at position 549 is Trp, Tyr, Phe, Met, His, Ile, Leu Val, Ala, or Gly
  SITE (552)..(552): Xaa at position 552 is Cys, Ala, Val, Gly, Ser, or Thr
  SITE (554)..(554): Xaa at position 554 is Trp, Tyr, Phe, Met, His, Ile, Leu Val, Ala, or Gly
  SITE (564)..(564): Xaa at position 564 is Cys, Ala, Val, Gly, Ser, or Thr
  SITE (566)..(566): Xaa at position 566 is Ala, Gly, or Pro
  SITE (569)..(569): Xaa at position 569 is Cys, Ala, Val, Gly, Ser, or Thr
  SITE (581)..(581): Xaa at position 581 is Cys, Ala, Val, Gly, Ser, or Thr
  SITE (585)..(585): Xaa at position 585 is Cys, Ala, Val, Gly, Ser, or Thr
  SITE (586)..(586): Xaa at position 586 is Phe, Tyr, Met, His, Ile, Leu, Val Ala, or Gly
  SITE (592)..(592): Xaa at position 592 is Ala, Gly, or Pro
  SITE (594)..(594): Xaa at position 594 is Tyr, Phe, Met, His, Ile, Leu, Val Ala, or Gly
  SITE (597)..(597): Xaa at position 597 is Cys, Ala, Val, Gly, Ser, or Thr
  SITE (603)..(603): Xaa at position 603 is Ile, Ala, Val, Leu, or Gly
  SITE (607)..(607): Xaa at position 607 is Cys, Ala, Val, Gly, Ser, or Thr
  SITE (608)..(608): Xaa at position 608 is Met, Ile, Leu, Val, Ala, or Gly
  SITE (609)..(609): Xaa at position 609 is Val, Ala, Gly, Leu, or Ile
  SITE (611)..(611): Xaa at position 611 is Tyr, Phe, Met, His, Ile, Leu, Val Ala, or Gly
  SITE (629)..(629): Xaa at position 629 is Val, Ala, Gly, Leu, or Ile
  SITE (631)..(631): Xaa at position 631 is Met, Ile, Leu, Val, Ala, or Gly
  SITE (642)..(642): Xaa at position 642 is Ala, Gly, or Pro
  SITE (643)..(643): Xaa at position 643 is Ala, Gly, or Pro
  SITE (644)..(644): Xaa at position 644 is Cys, Ala, Val, Gly, Ser, or Thr
  SITE (652)..(652): Xaa at position 652 is Cys, Ala, Val, Gly, Ser, or Thr
  SITE (665)..(665): Xaa at position 665 is Leu, Ala, Val, Gly, or Ile
  SITE (674)..(674): Xaa at position 674 is Val, Ala, Gly, Leu, or Ile
  SITE (684)..(684): Xaa at position 684 is Ala, Gly, or Pro
  SITE (690)..(690): Xaa at position 690 is Ile, Ala, Val, Leu, or Gly
  SITE (692)..(692): Xaa at position 692 is Leu, Ala, Val, Gly, or Ile
  SITE (699)..(699): Xaa at position 699 is Val, Ala, Gly, Leu, or Ile
  SITE (701)..(701): Xaa at position 701 is Tyr, Phe, Met, His, Ile, Leu, Val Ala, or Gly
  SITE (720)..(720): Xaa at position 720 is Val, Ala, Gly, Leu, or Ile
  SITE (724)..(724): Xaa at position 724 is Leu, Ala, Val, Gly, or Ile
  SITE (725)..(725): Xaa at position 725 is Leu, Ala, Val, Gly, or Ile
  SITE (754)..(754): Xaa at position 754 is Leu, Ala, Val, Gly, or Ile
  SITE (922)..(922): Xaa at position 922 is Cys, Ala, Val, Gly, Ser, or Thr
  SITE (949)..(949): Xaa at position 949 is Val, Ala, Gly, Leu, or Ile
  SITE (964)..(964): Xaa at position 964 is Leu, Ala, Val, Gly, or Ile
  SITE (1004)..(1004): Xaa at position 1004 is Ala, Gly, or Pro
  SITE (1061)..(1061): Xaa at position 1061 is Ile, Ala, Val, Leu, or Gly
  SITE (1070)..(1070): Xaa at position 1070 is Leu, Ala, Val, Gly, or Ile
  SITE (1071)..(1071): Xaa at position 1071 is Ala, Gly, or Pro
  SITE (1073)..(1073): Xaa at position 1073 is Cys, Ala, Val, Gly, Ser, or Thr
  SITE (1074)..(1074): Xaa at position 1074 is Ile, Ala, Val, Leu, or Gly
  SITE (1077)..(1077): Xaa at position 1077 is Val, Ala, Gly, Leu, or Ile
  SITE (1078)..(1078): Xaa at position 1078 is Cys, Ala, Val, Gly, Ser, or Thr
  SITE (1079)..(1079): Xaa at position 1079 is Trp, Tyr, Phe, Met, His, Ile Leu, Val, Ala, or Gly
  SITE (1081)..(1081): Xaa at position 1081 is Val, Ala, Gly, Leu, or Ile
  SITE (1085)..(1085): Xaa at position 1085 is Ala, Gly, or Pro
  SITE (1097)..(1097): Xaa at position 1097 is Val, Ala, Gly, Leu, or Ile
  SITE (1108)..(1108): Xaa at position 1108 is Leu, Ala, Val, Gly, or Ile
  SITE (1109)..(1109): Xaa at position 1109 is Val, Ala, Gly, Leu, or Ile
  SITE (1120)..(1120): Xaa at position 1120 is Leu, Ala, Val, Gly, or Ile
  SITE (1130)..(1130): Xaa at position 1130 is Leu, Ala, Val, Gly, or Ile
  SITE (1132)..(1132): Xaa at position 1132 is Leu, Ala, Val, Gly, or Ile
  SITE (1140)..(1140): Xaa at position 1140 is Ile, Ala, Val, Leu, or Gly
  SITE (1142)..(1142): Xaa at position 1142 is Val, Ala, Gly, Leu, or Ile
  SITE (1158)..(1158): Xaa at position 1158 is Ile, Ala, Val, Leu, or Gly
  SITE (1161)..(1161): Xaa at position 1161 is Leu, Ala, Val, Gly, or Ile
  SITE (1169)..(1169): Xaa at position 1169 is Leu, Ala, Val, Gly, or Ile
  SITE (1171)..(1171): Xaa at position 1171 is Cys, Ala, Val, Gly, Ser, or Thr
  SITE (1176)..(1176): Xaa at position 1176 is Ala, Gly, or Pro
  SITE (1177)..(1177): Xaa at position 1177 is Val, Ala, Gly, Leu, or Ile
  SITE (1179)..(1179): Xaa at position 1179 is Leu, Ala, Val, Gly, or Ile
  SITE (1180)..(1180): Xaa at position 1180 is Phe, Tyr, Met, His, Ile, Leu Val, Ala, or Gly
  SITE (1190)..(1190): Xaa at position 1190 is Ala, Gly, or Pro
  SITE (1192)..(1192): Xaa at position 1192 is Ala, Gly, or Pro
  SITE (1193)..(1193): Xaa at position 1193 is Val, Ala, Gly, Leu, or Ile
  SITE (1195)..(1195): Xaa at position 1195 is Phe, Tyr, Met, His, Ile, Leu Val, Ala, or Gly
  SITE (1196)..(1196): Xaa at position 1196 is Ile, Ala, Val, Leu, or Gly
  SITE (1198)..(1198): Xaa at position 1198 is Val, Ala, Gly, Leu, or Ile
  SITE (1201)..(1201): Xaa at position 1201 is Leu, Ala, Val, Gly, or Ile
  SITE (1228)..(1228): Xaa at position 1228 is Leu, Ala, Val, Gly, or Ile
  SITE (1251)..(1251): Xaa at position 1251 is Val, Ala, Gly, Leu, or Ile
  SITE (1252)..(1252): Xaa at position 1252 is Leu, Ala, Val, Gly, or Ile
  SITE (1253)..(1253): Xaa at position 1253 is Val, Ala, Gly, Leu, or Ile
  SITE (1254)..(1254): Xaa at position 1254 is Leu, Ala, Val, Gly, or Ile
  SITE (1268)..(1268): Xaa at position 1268 is Met, Ile, Leu, Val, Ala, or Gly
  SITE (1291)..(1291): Xaa at position 1291 is Ile, Ala, Val, Leu, or Gly
  SITE (1293)..(1293): Xaa at position 1293 is Tyr, Phe, Met, His, Ile, Leu Val, Ala, or Gly
  SITE (1296)..(1296): Xaa at position 1296 is Tyr, Phe, Met, His, Ile, Leu Val, Ala, or Gly
  SITE (1301)..(1301): Xaa at position 1301 is Ala, Gly, or Pro
  SITE (1312)..(1312): Xaa at position 1312 is Ile, Ala, Val, Leu, or Gly
  SITE (1314)..(1314): Xaa at position 1314 is Ile, Ala, Val, Leu, or Gly
  SITE (1315)..(1315): Xaa at position 1315 is Cys, Ala, Val, Gly, Ser, or Thr
  SITE (1318)..(1318): Xaa at position 1318 is Cys, Ala, Val, Gly, Ser, or Thr
  SITE (1326)..(1326): Xaa at position 1326 is Ile, Ala, Val, Leu, or Gly
  SITE (1329)..(1329): Xaa at position 1329 is Ile, Ala, Val, Leu, or Gly
  SITE (1332)..(1332): Xaa at position 1332 is Val, Ala, Gly, Leu, or Ile
  SITE (1336)..(1336): Xaa at position 1336 is Ala, Gly, or Pro
  SITE (1343)..(1343): Xaa at position 1343 is Leu, Ala, Val, Gly, or Ile
  SITE (1344)..(1344): Xaa at position 1344 is Val, Ala, Gly, Leu, or Ile
  SITE (1345)..(1345): Xaa at position 1345 is Val, Ala, Gly, Leu, or Ile
  SITE (1346)..(1346): Xaa at position 1346 is Leu, Ala, Val, Gly, or Ile
  SITE (1347)..(1347): Xaa at position 1347 is Ala, Gly, or Pro
  SITE (1362)..(1362): Xaa at position 1362 is Ile, Ala, Val, Leu, or Gly
  SITE (1373)..(1373): Xaa at position 1373 is Ile, Ala, Val, Leu, or Gly
  SITE (1375)..(1375): Xaa at position 1375 is Phe, Tyr, Met, His, Ile, Leu Val, Ala, or Gly
  SITE (1380)..(1380): Xaa at position 1380 is Ile, Ala, Val, Leu, or Gly
  SITE (1384)..(1384): Xaa at position 1384 is Val, Ala, Gly, Leu, or Ile
  SITE (1385)..(1385): Xaa at position 1385 is Ile, Ala, Val, Leu, or Gly
  SITE (1391)..(1391): Xaa at position 1391 is Leu, Ala, Val, Gly, or Ile
  SITE (1392)..(1392): Xaa at position 1392 is Ile, Ala, Val, Leu, or Gly
  SITE (1393)..(1393): Xaa at position 1393 is Phe, Tyr, Met, His, Ile, Leu Val, Ala, or Gly
  SITE (1394)..(1394): Xaa at position 1394 is Cys, Ala, Val, Gly, Ser, or Thr
  SITE (1400)..(1400): Xaa at position 1400 is Cys, Ala, Val, Gly, Ser, or Thr
  SITE (1403)..(1403): Xaa at position 1403 is Leu, Ala, Val, Gly, or Ile
  SITE (1407)..(1407): Xaa at position 1407 is Leu, Ala, Val, Gly, or Ile
  SITE (1412)..(1412): Xaa at position 1412 is Ile, Ala, Val, Leu, or Gly
  SITE (1432)..(1432): Xaa at position 1432 is Val, Ala, Gly, Leu, or Ile
  SITE (1433)..(1433): Xaa at position 1433 is Val, Ala, Gly, Leu, or Ile
  SITE (1434)..(1434): Xaa at position 1434 is Val, Ala, Gly, Leu, or Ile
  SITE (1435)..(1435): Xaa at position 1435 is Val, Ala, Gly, Leu, or Ile
  SITE (1440)..(1440): Xaa at position 1440 is Leu, Ala, Val, Gly, or Ile
  SITE (1444)..(1444): Xaa at position 1444 is Phe, Tyr, Met, His, Ile, Leu Val, Ala, or Gly
  SITE (1448)..(1448): Xaa at position 1448 is Phe, Tyr, Met, His, Ile, Leu Val, Ala, or Gly
  SITE (1451)..(1451): Xaa at position 1451 is Val, Ala, Gly, Leu, or Ile
  SITE (1452)..(1452): Xaa at position 1452 is Ile, Ala, Val, Leu, or Gly
  SITE (1470)..(1470): Xaa at position 1470 is Phe, Tyr, Met, His, Ile, Leu Val, Ala, or Gly
  SITE (1481)..(1481): Xaa at position 1481 is Ala, Gly, or Pro
  SITE (1499)..(1499): Xaa at position 1499 is Tyr, Phe, Met, His, Ile, Leu Val, Ala, or Gly
  SITE (1517)..(1517): Xaa at position 1517 is Leu, Ala, Val, Gly, or Ile
  SITE (1518)..(1518): Xaa at position 1518 is Cys, Ala, Val, Gly, Ser, or Thr
  SITE (1520)..(1520): Xaa at position 1520 is Cys, Ala, Val, Gly, Ser, or Thr
  SITE (1521)..(1521): Xaa at position 1521 is Tyr, Phe, Met, His, Ile, Leu Val, Ala, or Gly
  SITE (1526)..(1526): Xaa at position 1526 is Ala, Gly, or Pro
  SITE (1528)..(1528): Xaa at position 1528 is Tyr, Phe, Met, His, Ile, Leu Val, Ala, or Gly
  SITE (1539)..(1539): Xaa at position 1539 is Leu, Ala, Val, Gly, or Ile
  SITE (1542)..(1542): Xaa at position 1542 is Tyr, Phe, Met, His, Ile, Leu Val, Ala, or Gly
  SITE (1555)..(1555): Xaa at position 1555 is Leu, Ala, Val, Gly, or Ile
  SITE (1557)..(1557): Xaa at position 1557 is Phe, Tyr, Met, His, Ile, Leu Val, Ala, or Gly
  SITE (1558)..(1558): Xaa at position 1558 is Trp, Tyr, Phe, Met, His, Ile Leu, Val, Ala, or Gly
  SITE (1561)..(1561): Xaa at position 1561 is Val, Ala, Gly, Leu, or Ile
  SITE (1565)..(1565): Xaa at position 1565 is Leu, Ala, Val, Gly, or Ile
  SITE (1568)..(1568): Xaa at position 1568 is Ile, Ala, Val, Leu, or Gly
  SITE (1572)..(1572): Xaa at position 1572 is Phe, Tyr, Met, His, Ile, Leu Val, Ala, or Gly
  SITE (1586)..(1586): Xaa at position 1586 is Leu, Ala, Val, Gly, or Ile
  SITE (1587)..(1587): Xaa at position 1587 is Val, Ala, Gly, Leu, or Ile
  SITE (1588)..(1588): Xaa at position 1588 is Ala, Gly, or Pro
  SITE (1591)..(1591): Xaa at position 1591 is Ala, Gly, or Pro
  SITE (1594)..(1594): Xaa at position 1594 is Cys, Ala, Val, Gly, Ser, or Thr
  SITE (1599)..(1599): Xaa at position 1599 is Ala, Gly, or Pro
  SITE (1611)..(1611): Xaa at position 1611 is Leu, Ala, Val, Gly, or Ile
  SITE (1619)..(1619): Xaa at position 1619 is His, Phe, Tyr, Lys, Arg, Gly Ser, Thr, Ala, Val, Leu, Ile, Asn, Met, or Gln
  SITE (1624)..(1624): Xaa at position 1624 is Leu, Ala, Val, Gly, or Ile
  SITE (1625)..(1625): Xaa at position 1625 is Leu, Ala, Val, Gly, or Ile
  SITE (1628)..(1628): Xaa at position 1628 is Leu, Ala, Val, Gly, or Ile
  SITE (1641)..(1641): Xaa at position 1641 is Ile, Ala, Val, Leu, or Gly
  SITE (1645)..(1645): Xaa at position 1645 is Ile, Ala, Val, Leu, or Gly
  SITE (2128)..(2128): Xaa at position 2128 is Val, Ala, Gly, Leu, or Ile
  SITE (2441)..(2441): Xaa at position 2441 is Leu, Ala, Val, Gly, or Ile
  SITE (2450)..(2450): Xaa at position 2450 is Leu, Ala, Val, Gly, or Ile
  SITE (2451)..(2451): Xaa at position 2451 is Leu, Ala, Val, Gly, or Ile
  SITE (2457)..(2457): Xaa at position 2457 is Val, Ala, Gly, Leu, or Ile
  SITE (2458)..(2458): Xaa at position 2458 is Tyr, Phe, Met, His, Ile, Leu Val, Ala, or Gly
  SITE (2465)..(2465): Xaa at position 2465 is Ala, Gly, or Pro
  SITE (2484)..(2484): Xaa at position 2484 is Tyr, Phe, Met, His, Ile, Leu Val, Ala, or Gly
  SITE (2487)..(2487): Xaa at position 2487 is Val, Ala, Gly, Leu, or Ile
  SITE (2491)..(2491): Xaa at position 2491 is Val, Ala, Gly, Leu, or Ile
  SITE (2493)..(2493): Xaa at position 2493 is Ala, Gly, or Pro
  SITE (2494)..(2494): Xaa at position 2494 is Ala, Gly, or Pro
  SITE (2495)..(2495): Xaa at position 2495 is Ala, Gly, or Pro
  SITE (2498)..(2498): Xaa at position 2498 is Val, Ala, Gly, Leu, or Ile
  SITE (2500)..(2500): Xaa at position 2500 is Ala, Gly, or Pro
  SITE (2508)..(2508): Xaa at position 2508 is Ala, Gly, or Pro
  SITE (2509)..(2509): Xaa at position 2509 is Cys, Ala, Val, Gly, Ser, or Thr
  SITE (2523)..(2523): Xaa at position 2523 is Tyr, Phe, Met, His, Ile, Leu Val, Ala, or Gly
  SITE (2525)..(2525): Xaa at position 2525 is Ala, Gly, or Pro
  SITE (2528)..(2528): Xaa at position 2528 is Val, Ala, Gly, Leu, or Ile
  SITE (2532)..(2532): Xaa at position 2532 is Ala, Gly, or Pro
  SITE (2535)..(2535): Xaa at position 2535 is Ala, Gly, or Pro
  SITE (2539)..(2539): Xaa at position 2539 is Ile, Ala, Val, Leu, or Gly
  SITE (2546)..(2546): Xaa at position 2546 is Leu, Ala, Val, Gly, or Ile
  SITE (2547)..(2547): Xaa at position 2547 is Leu, Ala, Val, Gly, or Ile
  SITE (2558)..(2558): Xaa at position 2558 is Ile, Ala, Val, Leu, or Gly
  SITE (2566)..(2566): Xaa at position 2566 is Cys, Ala, Val, Gly, Ser, or Thr
  SITE (2577)..(2577): Xaa at position 2577 is Ala, Gly, or Pro
  SITE (2579)..(2579): Xaa at position 2579 is Leu, Ala, Val, Gly, or Ile
  SITE (2581)..(2581): Xaa at position 2581 is Val, Ala, Gly, Leu, or Ile
  SITE (2585)..(2585): Xaa at position 2585 is Leu, Ala, Val, Gly, or Ile
  SITE (2587)..(2587): Xaa at position 2587 is Val, Ala, Gly, Leu, or Ile
  SITE (2589)..(2589): Xaa at position 2589 is Val, Ala, Gly, Leu, or Ile
  SITE (2590)..(2590): Xaa at position 2590 is Cys, Ala, Val, Gly, Ser, or Thr
  SITE (2594)..(2594): Xaa at position 2594 is Ala, Gly, or Pro
  SITE (2595)..(2595): Xaa at position 2595 is Leu, Ala, Val, Gly, or Ile
  SITE (2598)..(2598): Xaa at position 2598 is Val, Ala, Gly, Leu, or Ile
  SITE (2599)..(2599): Xaa at position 2599 is Val, Ala, Gly, Leu, or Ile
  SITE (2602)..(2602): Xaa at position 2602 is Leu, Ala, Val, Gly, or Ile
  SITE (2605)..(2605): Xaa at position 2605 is Ala, Gly, or Pro
  SITE (2606)..(2606): Xaa at position 2606 is Val, Ala, Gly, Leu, or Ile
  SITE (2611)..(2611): Xaa at position 2611 is Tyr, Phe, Met, His, Ile, Leu Val, Ala, or Gly
  SITE (2621)..(2621): Xaa at position 2621 is Val, Ala, Gly, Leu, or Ile
  SITE (2624)..(2624): Xaa at position 2624 is Leu, Ala, Val, Gly, or Ile
  SITE (2627)..(2627): Xaa at position 2627 is Ala, Gly, or Pro
  SITE (2635)..(2635): Xaa at position 2635 is Met, Ile, Leu, Val, Ala, or Gly
  SITE (2637)..(2637): Xaa at position 2637 is Leu, Ala, Val, Gly, or Ile
  SITE (2639)..(2639): Xaa at position 2639 is Tyr, Phe, Met, His, Ile, Leu Val, Ala, or Gly
  SITE (2648)..(2648): Xaa at position 2648 is Val, Ala, Gly, Leu, or Ile
  SITE (2653)..(2653): Xaa at position 2653 is Ile, Ala, Val, Leu, or Gly
  SITE (2659)..(2659): Xaa at position 2659 is Ile, Ala, Val, Leu, or Gly
  SITE (2660)..(2660): Xaa at position 2660 is Tyr, Phe, Met, His, Ile, Leu Val, Ala, or Gly
  SITE (2662)..(2662): Xaa at position 2662 is Cys, Ala, Val, Gly, Ser, or Thr
  SITE (2663)..(2663): Xaa at position 2663 is Cys, Ala, Val, Gly, Ser, or Thr
  SITE (2669)..(2669): Xaa at position 2669 is Ala, Gly, or Pro
  SITE (2672)..(2672): Xaa at position 2672 is Ala, Gly, or Pro
  SITE (2673)..(2673): Xaa at position 2673 is Ile, Ala, Val, Leu, or Gly
  SITE (2676)..(2676): Xaa at position 2676 is Leu, Ala, Val, Gly, or Ile
  SITE (2680)..(2680): Xaa at position 2680 is Leu, Ala, Val, Gly, or Ile
  SITE (2681)..(2681): Xaa at position 2681 is Tyr, Phe, Met, His, Ile, Leu Val, Ala, or Gly
  SITE (2686)..(2686): Xaa at position 2686 is Leu, Ala, Val, Gly, or Ile
  SITE (2694)..(2694): Xaa at position 2694 is Cys, Ala, Val, Gly, Ser, or Thr
  SITE (2699)..(2699): Xaa at position 2699 is Cys, Ala, Val, Gly, Ser, or Thr
  SITE (2701)..(2701): Xaa at position 2701 is Ala, Gly, or Pro
  SITE (2704)..(2704): Xaa at position 2704 is Val, Ala, Gly, Leu, or Ile
  SITE (2705)..(2705): Xaa at position 2705 is Leu, Ala, Val, Gly, or Ile
  SITE (2709)..(2709): Xaa at position 2709 is Cys, Ala, Val, Gly, Ser, or Thr
  SITE (2713)..(2713): Xaa at position 2713 is Leu, Ala, Val, Gly, or Ile
  SITE (2719)..(2719): Xaa at position 2719 is Ala, Gly, or Pro
  SITE (2721)..(2721): Xaa at position 2721 is Ala, Gly, or Pro
  SITE (2722)..(2722): Xaa at position 2722 is Ala, Gly, or Pro
  SITE (2723)..(2723): Xaa at position 2723 is Cys, Ala, Val, Gly, Ser, or Thr
  SITE (2726)..(2726): Xaa at position 2726 is Ala, Gly, or Pro
  SITE (2728)..(2728): Xaa at position 2728 is Leu, Ala, Val, Gly, or Ile
  SITE (2733)..(2733): Xaa at position 2733 is Met, Ile, Leu, Val, Ala, or Gly
  SITE (2734)..(2734): Xaa at position 2734 is Leu, Ala, Val, Gly, or Ile
  SITE (2735)..(2735): Xaa at position 2735 is Val, Ala, Gly, Leu, or Ile
  SITE (2740)..(2740): Xaa at position 2740 is Leu, Ala, Val, Gly, or Ile
  SITE (2741)..(2741): Xaa at position 2741 is Val, Ala, Gly, Leu, or Ile
  SITE (2742)..(2742): Xaa at position 2742 is Val, Ala, Gly, Leu, or Ile
  SITE (2743)..(2743): Xaa at position 2743 is Ile, Ala, Val, Leu, or Gly
  SITE (2744)..(2744): Xaa at position 2744 is Cys, Ala, Val, Gly, Ser, or Thr
  SITE (2754)..(2754): Xaa at position 2754 is Ala, Gly, or Pro
  SITE (2756)..(2756): Xaa at position 2756 is Leu, Ala, Val, Gly, or Ile
  SITE (2759)..(2759): Xaa at position 2759 is Phe, Tyr, Met, His, Ile, Leu Val, Ala, or Gly
  SITE (2762)..(2762): Xaa at position 2762 is Ala, Gly, or Pro
  SITE (2763)..(2763): Xaa at position 2763 is Met, Ile, Leu, Val, Ala, or Gly
  SITE (2766)..(2766): Xaa at position 2766 is Tyr, Phe, Met, His, Ile, Leu Val, Ala, or Gly
  SITE (2768)..(2768): Xaa at position 2768 is Ala, Gly, or Pro
  SITE (2783)..(2783): Xaa at position 2783 is Ile, Ala, Val, Leu, or Gly
  SITE (2790)..(2790): Xaa at position 2790 is Val, Ala, Gly, Leu, or Ile
  SITE (2793)..(2793): Xaa at position 2793 is Ala, Gly, or Pro
  SITE (2802)..(2802): Xaa at position 2802 is Tyr, Phe, Met, His, Ile, Leu Val, Ala, or Gly
  SITE (2804)..(2804): Xaa at position 2804 is Leu, Ala, Val, Gly, or Ile
  SITE (2812)..(2812): Xaa at position 2812 is Leu, Ala, Val, Gly, or Ile
  SITE (2813)..(2813): Xaa at position 2813 is Ala, Gly, or Pro
  SITE (2815)..(2815): Xaa at position 2815 is Ala, Gly, or Pro
  SITE (2816)..(2816): Xaa at position 2816 is Ala, Gly, or Pro
  SITE (2829)..(2829): Xaa at position 2829 is Leu, Ala, Val, Gly, or Ile
  SITE (2832)..(2832): Xaa at position 2832 is Ile, Ala, Val, Leu, or Gly
  SITE (2833)..(2833): Xaa at position 2833 is Ile, Ala, Val, Leu, or Gly
  SITE (2836)..(2836): Xaa at position 2836 is Ala, Gly, or Pro
  SITE (2839)..(2839): Xaa at position 2839 is Leu, Ala, Val, Gly, or Ile
  SITE (2840)..(2840): Xaa at position 2840 is Trp, Tyr, Phe, Met, His, Ile Leu, Val, Ala, or Gly
  SITE (2841)..(2841): Xaa at position 2841 is Ala, Gly, or Pro
  SITE (2844)..(2844): Xaa at position 2844 is Ile, Ala, Val, Leu, or Gly
  SITE (2845)..(2845): Xaa at position 2845 is Leu, Ala, Val, Gly, or Ile
  SITE (2846)..(2846): Xaa at position 2846 is Met, Ile, Leu, Val, Ala, or Gly
  SITE (2848)..(2848): Xaa at position 2848 is His, Phe, Tyr, Lys, Arg, Gly Ser, Thr, Ala, Val, Leu, Ile, Asn, Met, or Gln
  SITE (2849)..(2849): Xaa at position 2849 is Phe, Tyr, Met, His, Ile, Leu Val, Ala, or Gly
  SITE (2850)..(2850): Xaa at position 2850 is Phe, Tyr, Met, His, Ile, Leu Val, Ala, or Gly
  SITE (2859)..(2859): Xaa at position 2859 is Leu, Ala, Val, Gly, or Ile
  SITE (2862)..(2862): Xaa at position 2862 is Ala, Gly, or Pro
  SITE (2865)..(2865): Xaa at position 2865 is Cys, Ala, Val, Gly, Ser, or Thr
  SITE (2867)..(2867): Xaa at position 2867 is Ile, Ala, Val, Leu, or Gly
  SITE (2870)..(2870): Xaa at position 2870 is Ala, Gly, or Pro
  SITE (2871)..(2871): Xaa at position 2871 is Cys, Ala, Val, Gly, Ser, or Thr
  SITE (2872)..(2872): Xaa at position 2872 is Tyr, Phe, Met, His, Ile, Leu Val, Ala, or Gly
  SITE (2874)..(2874): Xaa at position 2874 is Ile, Ala, Val, Leu, or Gly
  SITE (2877)..(2877): Xaa at position 2877 is Leu, Ala, Val, Gly, or Ile
  SITE (2879)..(2879): Xaa at position 2879 is Leu, Ala, Val, Gly, or Ile
  SITE (2882)..(2882): Xaa at position 2882 is Ile, Ala, Val, Leu, or Gly
  SITE (2883)..(2883): Xaa at position 2883 is Ile, Ala, Val, Leu, or Gly
  SITE (2886)..(2886): Xaa at position 2886 is Leu, Ala, Val, Gly, or Ile
  SITE (2891)..(2891): Xaa at position 2891 is Ala, Gly, or Pro
  SITE (2892)..(2892): Xaa at position 2892 is Phe, Tyr, Met, His, Ile, Leu Val, Ala, or Gly
  SITE (2905)..(2905): Xaa at position 2905 is Val, Ala, Gly, Leu, or Ile
  SITE (2906)..(2906): Xaa at position 2906 is Ala, Gly, or Pro
  SITE (2908)..(2908): Xaa at position 2908 is Cys, Ala, Val, Gly, Ser, or Thr
  SITE (2909)..(2909): Xaa at position 2909 is Leu, Ala, Val, Gly, or Ile
  SITE (2912)..(2912): Xaa at position 2912 is Leu, Ala, Val, Gly, or Ile
  SITE (2914)..(2914): Xaa at position 2914 is Val, Ala, Gly, Leu, or Ile
  SITE (2919)..(2919): Xaa at position 2919 is Ala, Gly, or Pro
  SITE (2920)..(2920): Xaa at position 2920 is Trp, Tyr, Phe, Met, His, Ile Leu, Val, Ala, or Gly
  SITE (2924)..(2924): Xaa at position 2924 is Ala, Gly, or Pro
  SITE (2927)..(2927): Xaa at position 2927 is Val, Ala, Gly, Leu, or Ile
  SITE (2931)..(2931): Xaa at position 2931 is Leu, Ala, Val, Gly, or Ile
  SITE (2932)..(2932): Xaa at position 2932 is Leu, Ala, Val, Gly, or Ile
  SITE (2938)..(2938): Xaa at position 2938 is Ala, Gly, or Pro
  SITE (2939)..(2939): Xaa at position 2939 is Ala, Gly, or Pro
  SITE (2941)..(2941): Xaa at position 2941 is Cys, Ala, Val, Gly, Ser, or Thr
  SITE (2945)..(2945): Xaa at position 2945 is Leu, Ala, Val, Gly, or Ile
  SITE (2946)..(2946): Xaa at position 2946 is Phe, Tyr, Met, His, Ile, Leu Val, Ala, or Gly
  SITE (2949)..(2949): Xaa at position 2949 is Ala, Gly, or Pro
  SITE (2961)..(2961): Xaa at position 2961 is Ala, Gly, or Pro
  SITE (2962)..(2962): Xaa at position 2962 is Ala, Gly, or Pro
  SITE (2971)..(2971): Xaa at position 2971 is Phe, Tyr, Met, His, Ile, Leu Val, Ala, or Gly
  SITE (2973)..(2973): Xaa at position 2973 is Ala, Gly, or Pro
  SITE (2975)..(2975): Xaa at position 2975 is Tyr, Phe, Met, His, Ile, Leu Val, Ala, or Gly
  SITE (2980)..(2980): Xaa at position 2980 is Ile, Ala, Val, Leu, or Gly
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQXRNSSGLYHXTNDXPNSSVVYEAADAILHTPGXVPXXREGNASRXXXAVTPTVATRDGKLPTTQXRRHXDLXVGSXTLXSAXYVGDLXGSVFXVGQLXTFSPRHHWTTQDCNCSIYPGHITGHRMAWNMMMNWSPTAALVVAQLLRIPQAIMDMIAGAHXGXLAGIKYFSMVGNWAKVLVVLLLFAGVDAETHVTGGNAGRTTAGLVGLLTPGAKQNIQLINTNGSWHINSTXXNCNESLNTGXLAGLXYQHKFNSSGCPERLASXRRLTDXAQGWGPISYANGSGLDERPYXWHYPPRPXGIVPXKSXXGPXYXXTPSPVVVGTTDRSGAPTYSWGANDTDVXVXNNTRPPLGNXFGXTXMNSTGFTKVXGXPPXVIGGVGNNTLLXPTDXXRKYPEXTXSRXGSGPRXTPRXXXDXPYRLWHYPCTINYTIFKXRXYVGGVEHRLEXXXNWTRGERXDLEDRDRSELSPXLLSTTQWQXLPCSFTTLPXLSTGLXHXHQNIVDXQXLYGVGSSIASWAIKWEYVXLLFXXLADARVCSCLWMMLLISQAEAALENLVIXNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLTCVVHPALVFDITKLLLAIFGPLWILQASLLKVPYFVRVQGLLRIXALARKIAGGHYVQMAIIKLGALTGTCXYNHLAPLRDWAHNGXRDLAVAVEPVVFSRMETKLITWGADTAACGDIINGLPVSXRRGQEILLGPADGMVSKGWRLLAPITAYAQQTRGLLGCIITSLTGRDKNQVEGEVQXVSTATQTFXXTXXNGXXXTXYHGXGTRTIASPKGPXIQTYTNVDQDXXGWPAPQGSRSXTPCTCGSSDXYXVTRHADVXPXRRRGDSRGSLLSPRPXSYXKGSSGGPXLXPTGHXXGXXRAAVCTRGVXKXXDXXPXENXETTMRSPVFTDNSSPPAVPQSFQVAHXHAPTGSGKSTKVPAAYAAKGYKXXXXNPSVAATLGFGAYXSKAHGVDPNIRTGVRTITTGSPXTXSTXGKFLXDAGCSGGAYDXIXXDEXHSTDATSXSGXGTXLDQXETAGARXXXXXTATPPGSVTVSHPNXEEVALSTTGEXPXYGKAXPLEXXKGGRHXXXXHSKKKXDEXAAKXVALGXNAVAYYRGLDVSVIPTSGDXXXXSTDAXMTGXTGDXDSXXDCNTCVTQTVDFSLDPTXTIETTTLPQDXVSRTQRRGRTGRGKPGIXRFVAPGERPSGMFDSSVXXEXXDAGCXWXELTPAETTVRXRAXMNTPGLPVCQDHXGXXEGXFTGXTHXDAHXLSQTKQSGENFPYXXXYQXTVXARAQXPPPSWDQMRKCXIRLKPTLXGPTPXXYRXGAVQNEVTLTHPXTKYXMTCMSADLEVVTSTWVLVGGVLAALAAYCLSTGCVVIVGRIVLSGKPAIIPDREVLYQEFDEMEECSQHLPYIEQGMMLAEQFKQKALGLLQTASRHAEVITPAVQTNWQKLEVFWAKHMWNFISGIQYLAGLSTLPGNPAIASLMAFTAAVTSPLTTGQTLLFNILGGWVAAQLAAPGAATAFVGAGLAGAALDSVGLGKVLVDILAGYGAGVAGALVAFKIMSGEVPSTEDLVNLLPAILSPGALAVGVVFASILRRRVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCKNMWSGTFFINAYTTGPCTPLPAPNYKFALWRVSAEEYVEIRRVGDFHYVSGMTTDNLKCPCQIPSPEFFTELDGXRLHRFAPPCKPLLREEVSFRVGLHEYPVGSQLPCEPEPDVAVLTSMLTDPSHITAEAAGRRLARGSPPSMASSSASQLSAPSLKATCTANHDSPDAELIEANLLWRQEMGGNITRVESENKVVILDSFDPLVAEEDEREVSVPAEILRKSRRFAPALPVWARPDYNPLLVETWKKPDYEPPVVHGCPLPPPRSPPVPPPRKKRTVVLTESTLPTALAELATKSFGSSSTSGITGDNTTTSSEPAPSGCPPDSDVESYSSMPPLEGEPGDPDLSDGSWSTVSSGADTEDVVCCSMSYSWTGALVTPCAAEEQKXPINALSNSXXRHHNLXXSTTSRSXCQRKKKVTFDRLQVLDSHXQDXLKEXKXXXSKXKXNLLSVEEXXSLAPPHSAKSKFGXGXKDXRCHXRKXVAHXNSVWKDXXEDSVTPIDTTXMAKNEVFXVQPEKGGRKPXRXIXFPDXGXRXXEKMXXYDXXSKXPLXXMGSSXGFQYSPGQRXEFXVQXWKSKKTPXGXSXDTRCFDSTXTESDXRTEEAXXQXXDLDPQXRVXXKSXTERXXVGGPXTNSRGENXGYRRXRXSRXXTTSXGNTXTRYIKXRXXXRAXGXQDCTXXXCGDDXXXXXESAGVQEDAXSXRAXTEXXTRXSXPPGDPPQPEYDLELXTSCSSNXSVXHDGAGKRVXYXTRDPTTPXXRXXWETARHTPVNSWXGNXXMFXPTXXXRMXXXTXXXSVLIARDQXEQXLNXEXYGXXXSXEPXDXPPXXQRXHGLSXXSLHSYSPGEINRXXAXXRKXGXPPLRXXRHRXWSXRARXXARGGKXXIXGKYXXNWXVRTKLKLTPITXXGRLDLSGWXTXGXSGGDXYHSVSHARPRWFWFCLLLLAAGVGIYLLPNR

SEQ ID NO: 429 - protein, 276 aa, Homo sapiens
  SITE (76)..(76): Xaa at position 76 is Leu, Ala, Val, Gly, or Ile
  SITE (77)..(77): Xaa at position 77 is Ala, Gly, or Pro
  SITE (78)..(78): Xaa at position 78 is Phe, Tyr, Met, His, Ile, Leu, Val Ala, or Gly
  SITE (80)..(80): Xaa at position 80 is Phe, Tyr, Met, His, Ile, Leu, Val Ala, or Gly
  SITE (84)..(84): Xaa at position 84 is Val, Ala, Gly, Leu, or Ile
  SITE (85)..(85): Xaa at position 85 is Ile, Ala, Val, Leu, or Gly
  SITE (86)..(86): Xaa at position 86 is Ala, Gly, or Pro
  SITE (87)..(87): Xaa at position 87 is Ala, Gly, or Pro
  SITE (88)..(88): Xaa at position 88 is Val, Ala, Gly, Leu, or Ile
  SITE (92)..(92): Xaa at position 92 is Ala, Gly, or Pro
  SITE (94)..(94): Xaa at position 94 is Ala, Gly, or Pro
  SITE (106)..(106): Xaa at position 106 is Val, Ala, Gly, Leu, or Ile
  SITE (107)..(107): Xaa at position 107 is Ile, Ala, Val, Leu, or Gly
  SITE (113)..(113): Xaa at position 113 is Leu, Ala, Val, Gly, or Ile
  SITE (114)..(114): Xaa at position 114 is Leu, Ala, Val, Gly, or Ile
  SITE (117)..(117): Xaa at position 117 is Met, Ile, Leu, Val, Ala, or Gly
  SITE (124)..(124): Xaa at position 124 is Cys, Ala, Val, Gly, Ser, or Thr
  SITE (131)..(131): Xaa at position 131 is Leu, Ala, Val, Gly, or Ile
  SITE (135)..(135): Xaa at position 135 is Cys, Ala, Val, Gly, Ser, or Thr
  SITE (137)..(137): Xaa at position 137 is Leu, Ala, Val, Gly, or Ile
  SITE (146)..(146): Xaa at position 146 is Ile, Ala, Val, Leu, or Gly
  SITE (148)..(148): Xaa at position 148 is Val, Ala, Gly, Leu, or Ile
  SITE (150)..(150): Xaa at position 150 is Ala, Gly, or Pro
  SITE (151)..(151): Xaa at position 151 is Ala, Gly, or Pro
  SITE (155)..(155): Xaa at position 155 is Leu, Ala, Val, Gly, or Ile
  SITE (159)..(159): Xaa at position 159 is Met, Ile, Leu, Val, Ala, or Gly
  SITE (169)..(169): Xaa at position 169 is Met, Ile, Leu, Val, Ala, or Gly
  SITE (172)..(172): Xaa at position 172 is Met, Ile, Leu, Val, Ala, or Gly
  SITE (173)..(173): Xaa at position 173 is Ile, Ala, Val, Leu, or Gly
  SITE (174)..(174): Xaa at position 174 is Cys, Ala, Val, Gly, Ser, or Thr
  SITE (183)..(183): Xaa at position 183 is Leu, Ala, Val, Gly, or Ile
  SITE (186)..(186): Xaa at position 186 is Val, Ala, Gly, Leu, or Ile
  SITE (207)..(207): Xaa at position 207 is Ala, Gly, or Pro
  SITE (211)..(211): Xaa at position 211 is Met, Ile, Leu, Val, Ala, or Gly
  SITE (224)..(224): Xaa at position 224 is Ala, Gly, or Pro
  SITE (227)..(227): Xaa at position 227 is Leu, Ala, Val, Gly, or Ile
  SITE (231)..(231): Xaa at position 231 is Ala, Gly, or Pro
  SITE (232)..(232): Xaa at position 232 is Ile, Ala, Val, Leu, or Gly
  SITE (233)..(233): Xaa at position 233 is Ala, Gly, or Pro
  SITE (235)..(235): Xaa at position 235 is Ala, Gly, or Pro
  SITE (245)..(245): Xaa at position 245 is Val, Ala, Gly, Leu, or Ile
  SITE (246)..(246): Xaa at position 246 is Val, Ala, Gly, Leu, or Ile
  SITE (248)..(248): Xaa at position 248 is Met, Ile, Leu, Val, Ala, or Gly
  SITE (249)..(249): Xaa at position 249 is Tyr, Phe, Met, His, Ile, Leu, Val Ala, or Gly
  SITE (250)..(250): Xaa at position 250 is His, Phe, Tyr, Lys, Arg, Gly, Ser Thr, Ala, Val, Leu, Ile, Asn, Met, or Gln
  SITE (251)..(251): Xaa at position 251 is Met, Ile, Leu, Val, Ala, or Gly
MALLDVCGAPRGQRPESALPVAGSGRRSDPGHYSFSMRSPELALPRGMQPTEFFQSLGGDGERNVQIEMAHGTTTXXXKXQHGXXXXXDSRXSXGSYISALRVNKXXEINPYXXGTXSGCAADXQYWERLXAKEXRXYYLRNGERXSXSXXSKLXSNMXCQYRGMGLSXGSXXXGWDKKGPGXYYXDEHGTRLSGNMFSTGSGNTYXYGVXDSGYRPNLSPEEXYDXGRRXXXYXTHRDSYSGGXXNXXXXKEDGWVKVESTDVSDLLHQYREANQ

SEQ ID NO: 430 - protein, 263 aa, Homo sapiens
  SITE (51)..(51): Xaa at position 51 is Leu, Ala, Val, Gly, or Ile
  SITE (61)..(61): Xaa at position 61 is Met, Ile, Leu, Val, Ala, or Gly
  SITE (73)..(73): Xaa at position 73 is Ala, Gly, or Pro
  SITE (90)..(90): Xaa at position 90 is Leu, Ala, Val, Gly, or Ile
  SITE (97)..(97): Xaa at position 97 is Cys, Ala, Val, Gly, Ser, or Thr
  SITE (117)..(117): Xaa at position 117 is Val, Ala, Gly, Leu, or Ile
  SITE (119)..(119): Xaa at position 119 is Val, Ala, Gly, Leu, or Ile
  SITE (132)..(132): Xaa at position 132 is Met, Ile, Leu, Val, Ala, or Gly
  SITE (133)..(133): Xaa at position 133 is Leu, Ala, Val, Gly, or Ile
  SITE (134)..(134): Xaa at position 134 is Ala, Gly, or Pro
  SITE (135)..(135): Xaa at position 135 is Cys, Ala, Val, Gly, Ser, or Thr
  SITE (137)..(137): Xaa at position 137 is Val, Ala, Gly, Leu, or Ile
  SITE (140)..(140): Xaa at position 140 is Phe, Tyr, Met, His, Ile, Leu, Val Ala, or Gly
  SITE (149)..(149): Xaa at position 149 is Trp, Tyr, Phe, Met, His, Ile, Leu Val, Ala, or Gly
  SITE (192)..(192): Xaa at position 192 is Cys, Ala, Val, Gly, Ser, or Thr
  SITE (194)..(194): Xaa at position 194 is Val, Ala, Gly, Leu, or Ile
MITFLPLLLGLSLGCTGAGGFVAHVESTCLLDDAGTPKDFTYCISFNKDLXTCWDPEENKXAPCEFGVLNSLXNVLSQHLNQKDTLMQRXRNGLQNXATHTQPFWGSLTNRTRPPSXQXAKTTPFNTREPVXXXXYXWGXYPAEVTITXRKNGKLVMPHSSAHKTAQPNGDWTYQTLSHLALTPSYGDTYTXVXEHIGAPEPILRDWTPGLSPMQTLKVSVSAVTLGLGLIIFSLGVISWRRAGHSSYTPLPGSNYSEGWHIS

SEQ ID NO: 431 - protein, 473 aa, Homo sapiens
  SITE (63)..(63): Xaa at position 63 is Val, Ala, Gly, Leu, or Ile
  SITE (65)..(65): Xaa at position 65 is Met, Ile, Leu, Val, Ala, or Gly
  SITE (67)..(67): Xaa at position 67 is Ile, Ala, Val, Leu, or Gly
  SITE (69)..(69): Xaa at position 69 is Ile, Ala, Val, Leu, or Gly
  SITE (82)..(82): Xaa at position 82 is Tyr, Phe, Met, His, Ile, Leu, Val Ala, or Gly
  SITE (84)..(84): Xaa at position 84 is Leu, Ala, Val, Gly, or Ile
  SITE (86)..(86): Xaa at position 86 is Met, Ile, Leu, Val, Ala, or Gly
  SITE (92)..(92): Xaa at position 92 is Trp, Tyr, Phe, Met, His, Ile, Leu Val, Ala, or Gly
  SITE (97)..(97): Xaa at position 97 is Leu, Ala, Val, Gly, or Ile
  SITE (141)..(141): Xaa at position 141 is Ile, Ala, Val, Leu, or Gly
  SITE (149)..(149): Xaa at position 149 is Val, Ala, Gly, Leu, or Ile
  SITE (159)..(159): Xaa at position 159 is Ala, Gly, or Pro
  SITE (165)..(165): Xaa at position 165 is Leu, Ala, Val, Gly, or Ile
  SITE (175)..(175): Xaa at position 175 is Cys, Ala, Val, Gly, Ser, or Thr
  SITE (177)..(177): Xaa at position 177 is Leu, Ala, Val, Gly, or Ile
  SITE (179)..(179): Xaa at position 179 is Ile, Ala, Val, Leu, or Gly
  SITE (189)..(189): Xaa at position 189 is Ile, Ala, Val, Leu, or Gly
  SITE (199)..(199): Xaa at position 199 is Ala, Gly, or Pro
  SITE (233)..(233): Xaa at position 233 is Leu, Ala, Val, Gly, or Ile
  SITE (235)..(235): Xaa at position 235 is Leu, Ala, Val, Gly, or Ile
  SITE (237)..(237): Xaa at position 237 is Phe, Tyr, Met, His, Ile, Leu, Val Ala, or Gly
MWGLAGGRLFGIFSAPVLVAVVCCAQSVNDPGNMSFVKETVDKLLKGYDIRLRPDFGGPPVCXGXNXDXASIDMVSEVNMDXTXTXYFQQYXRDKRXAYSGIPLNLTLDNRVADQLWVPDTYFLNDKKSFVHGVTVKNRMXRLHPDGTXLYGLRITTTXACMMDXRRYPLDEQNXTXEXESYGYTTDDXEFYWRGGDKXVTGVERIELPQFSIVEHRLVSRNVVFATGAYPRXSXSXRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 432 - protein, 360 aa, Homo sapiens
  SITE (9)..(9): Xaa at position 9 is Ala, Gly, or Pro
  SITE (14)..(14): Xaa at position 14 is Val, Ala, Gly, Leu, or Ile
  SITE (19)..(19): Xaa at position 19 is Phe, Tyr, Met, His, Ile, Leu, Val Ala, or Gly
  SITE (21)..(21): Xaa at position 21 is Val, Ala, Gly, Leu, or Ile
  SITE (25)..(25): Xaa at position 25 is Tyr, Phe, Met, His, Ile, Leu, Val Ala, or Gly
  SITE (31)..(31): Xaa at position 31 is Ile, Ala, Val, Leu, or Gly
  SITE (35)..(35): Xaa at position 35 is Ala, Gly, or Pro
  SITE (36)..(36): Xaa at position 36 is Tyr, Phe, Met, His, Ile, Leu, Val Ala, or Gly
  SITE (38)..(38): Xaa at position 38 is Met, Ile, Leu, Val, Ala, or Gly
  SITE (40)..(40): Xaa at position 40 is Cys, Ala, Val, Gly, Ser, or Thr
  SITE (42)..(42): Xaa at position 42 is Ala, Gly, or Pro
  SITE (49)..(49): Xaa at position 49 is Val, Ala, Gly, Leu, or Ile
  SITE (51)..(51): Xaa at position 51 is Val, Ala, Gly, Leu, or Ile
  SITE (52)..(52): Xaa at position 52 is Ala, Gly, or Pro
  SITE (53)..(53): Xaa at position 53 is Ile, Ala, Val, Leu, or Gly
  SITE (56)..(56): Xaa at position 56 is Ile, Ala, Val, Leu, or Gly
  SITE (65)..(65): Xaa at position 65 is Cys, Ala, Val, Gly, Ser, or Thr
  SITE (69)..(69): Xaa at position 69 is Leu, Ala, Val, Gly, or Ile
  SITE (72)..(72): Xaa at position 72 is Ile, Ala, Val, Leu, or Gly
  SITE (74)..(74): Xaa at position 74 is Ile, Ala, Val, Leu, or Gly
  SITE (75)..(75): Xaa at position 75 is Leu, Ala, Val, Gly, or Ile
  SITE (83)..(83): Xaa at position 83 is Ile, Ala, Val, Leu, or Gly
  SITE (84)..(84): Xaa at position 84 is Ile, Ala, Val, Leu, or Gly
  SITE (86)..(86): Xaa at position 86 is Ile, Ala, Val, Leu, or Gly
  SITE (89)..(89): Xaa at position 89 is Ile, Ala, Val, Leu, or Gly
  SITE (95)..(95): Xaa at position 95 is Ile, Ala, Val, Leu, or Gly
  SITE (98)..(98): Xaa at position 98 is Met, Ile, Leu, Val, Ala, or Gly
  SITE (101)..(101): Xaa at position 101 is Val, Ala, Gly, Leu, or Ile
  SITE (102)..(102): Xaa at position 102 is Tyr, Phe, Met, His, Ile, Leu, Val Ala, or Gly
  SITE (103)..(103): Xaa at position 103 is Ile, Ala, Val, Leu, or Gly
  SITE (104)..(104): Xaa at position 104 is Val, Ala, Gly, Leu, or Ile
  SITE (112)..(112): Xaa at position 112 is Leu, Ala, Val, Gly, or Ile
  SITE (115)..(115): Xaa at position 115 is Leu, Ala, Val, Gly, or Ile
  SITE (116)..(116): Xaa at position 116 is Leu, Ala, Val, Gly, or Ile
  SITE (121)..(121): Xaa at position 121 is Leu, Ala, Val, Gly, or Ile
  SITE (125)..(125): Xaa at position 125 is His, Phe, Tyr, Lys, Arg, Gly, Ser Thr, Ala, Val, Leu, Ile, Asn, Met, or Gln
  SITE (126)..(126): Xaa at position 126 is Ile, Ala, Val, Leu, or Gly
  SITE (127)..(127): Xaa at position 127 is Cys, Ala, Val, Gly, Ser, or Thr
  SITE (129)..(129): Xaa at position 129 is Phe, Tyr, Met, His, Ile, Leu, Val Ala, or Gly
  SITE (130)..(130): Xaa at position 130 is Leu, Ala, Val, Gly, or Ile
  SITE (133)..(133): Xaa at position 133 is Ile, Ala, Val, Leu, or Gly
  SITE (134)..(134): Xaa at position 134 is Leu, Ala, Val, Gly, or Ile
  SITE (137)..(137): Xaa at position 137 is Leu, Ala, Val, Gly, or Ile
  SITE (140)..(140): Xaa at position 140 is Ile, Ala, Val, Leu, or Gly
  SITE (141)..(141): Xaa at position 141 is His, Phe, Tyr, Lys, Arg, Gly, Ser Thr, Ala, Val, Leu, Ile, Asn, Met, or Gln
  SITE (143)..(143): Xaa at position 143 is Ala, Gly, or Pro
  SITE (145)..(145): Xaa at position 145 is Val, Ala, Gly, Leu, or Ile
  SITE (146)..(146): Xaa at position 146 is Leu, Ala, Val, Gly, or Ile
  SITE (147)..(147): Xaa at position 147 is His, Phe, Tyr, Lys, Arg, Gly, Ser Thr, Ala, Val, Leu, Ile, Asn, Met, or Gln
  SITE (150)..(150): Xaa at position 150 is Leu, Ala, Val, Gly, or Ile
  SITE (155)..(155): Xaa at position 155 is Leu, Ala, Val, Gly, or Ile
  SITE (156)..(156): Xaa at position 156 is Leu, Ala, Val, Gly, or Ile
  SITE (157)..(157): Xaa at position 157 is Leu, Ala, Val, Gly, or Ile
  SITE (163)..(163): Xaa at position 163 is Leu, Ala, Val, Gly, or Ile
  SITE (165)..(165): Xaa at position 165 is Ile, Ala, Val, Leu, or Gly
  SITE (168)..(168): Xaa at position 168 is Phe, Tyr, Met, His, Ile, Leu, Val Ala, or Gly
  SITE (170)..(170): Xaa at position 170 is Leu, Ala, Val, Gly, or Ile
  SITE (171)..(171): Xaa at position 171 is Ala, Gly, or Pro
  SITE (184)..(184): Xaa at position 184 is Leu, Ala, Val, Gly, or Ile
  SITE (189)..(189): Xaa at position 189 is Ala, Gly, or Pro
  SITE (192)..(192): Xaa at position 192 is Trp, Tyr, Phe, Met, His, Ile, Leu Val, Ala, or Gly
  SITE (193)..(193): Xaa at position 193 is Tyr, Phe, Met, His, Ile, Leu, Val Ala, or Gly
  SITE (195)..(195): Xaa at position 195 is Ala, Gly, or Pro
  SITE (198)..(198): Xaa at position 198 is Ile, Ala, Val, Leu, or Gly
  SITE (199)..(199): Xaa at position 199 is Met, Ile, Leu, Val, Ala, or Gly
  SITE (200)..(200): Xaa at position 200 is Leu, Ala, Val, Gly, or Ile
  SITE (205)..(205): Xaa at position 205 is Tyr, Phe, Met, His, Ile, Leu, Val Ala, or Gly
  SITE (209)..(209): Xaa at position 209 is Ile, Ala, Val, Leu, or Gly
  SITE (211)..(211): Xaa at position 211 is Ile, Ala, Val, Leu, or Gly
  SITE (212)..(212): Xaa at position 212 is Trp, Tyr, Phe, Met, His, Ile, Leu Val, Ala, or Gly
  SITE (214)..(214): Xaa at position 214 is Val, Ala, Gly, Leu, or Ile
  SITE (216)..(216): Xaa at position 216 is Cys, Ala, Val, Gly, Ser, or Thr
  SITE (217)..(217): Xaa at position 217 is Ile, Ala, Val, Leu, or Gly
  SITE (218)..(218): Xaa at position 218 is Leu, Ala, Val, Gly, or Ile
  SITE (219)..(219): Xaa at position 219 is Ala, Gly, or Pro
  SITE (221)..(221): Xaa at position 221 is Met, Ile, Leu, Val, Ala, or Gly
  SITE (222)..(222): Xaa at position 222 is Leu, Ala, Val, Gly, or Ile
  SITE (227)..(227): Xaa at position 227 is Ile, Ala, Val, Leu, or Gly
  SITE (228)..(228): Xaa at position 228 is Phe, Tyr, Met, His, Ile, Leu, Val Ala, or Gly
  SITE (234)..(234): Xaa at position 234 is Leu, Ala, Val, Gly, or Ile
  SITE (237)..(237): Xaa at position 237 is Leu, Ala, Val, Gly, or Ile
  SITE (240)..(240): Xaa at position 240 is Ile, Ala, Val, Leu, or Gly
  SITE (241)..(241): Xaa at position 241 is Leu, Ala, Val, Gly, or Ile
  SITE (244)..(244): Xaa at position 244 is Leu, Ala, Val, Gly, or Ile
  SITE (252)..(252): Xaa at position 252 is Leu, Ala, Val, Gly, or Ile
  SITE (255)..(255): Xaa at position 255 is Ile, Ala, Val, Leu, or Gly
  SITE (260)..(260): Xaa at position 260 is Ala, Gly, or Pro
  SITE (264)..(264): Xaa at position 264 is Leu, Ala, Val, Gly, or Ile
  SITE (267)..(267): Xaa at position 267 is Leu, Ala, Val, Gly, or Ile
  SITE (279)..(279): Xaa at position 279 is Phe, Tyr, Met, His, Ile, Leu, Val Ala, or Gly
  SITE (286)..(286): Xaa at position 286 is Ala, Gly, or Pro
  SITE (287)..(287): Xaa at position 287 is Leu, Ala, Val, Gly, or Ile
  SITE (289)..(289): Xaa at position 289 is Leu, Ala, Val, Gly, or Ile
  SITE (290)..(290): Xaa at position 290 is Leu, Ala, Val, Gly, or Ile
  SITE (293)..(293): Xaa at position 293 is Met, Ile, Leu, Val, Ala, or Gly
  SITE (294)..(294): Xaa at position 294 is Leu, Ala, Val, Gly, or Ile
  SITE (307)..(307): Xaa at position 307 is Ala, Gly, or Pro
  SITE (308)..(308): Xaa at position 308 is Leu, Ala, Val, Gly, or Ile
  SITE (313)..(313): Xaa at position 313 is Leu, Ala, Val, Gly, or Ile
  SITE (329)..(329): Xaa at position 329 is Phe, Tyr, Met, His, Ile, Leu, Val Ala, or Gly
  SITE (333)..(333): Xaa at position 333 is Met, Ile, Leu, Val, Ala, or Gly
  SITE (335)..(335): Xaa at position 335 is Leu, Ala, Val, Gly, or Ile
  SITE (338)..(338): Xaa at position 338 is Leu, Ala, Val, Gly, or Ile
  SITE (343)..(343): Xaa at position 343 is Leu, Ala, Val, Gly, or Ile
  SITE (347)..(347): Xaa at position 347 is Ile, Ala, Val, Leu, or Gly
MAAAAAAGXGPEMXRGQVXDXGPRXTNLSYXGEGXXGXVXSXYDNVNKXRXXXKKXSPFEHQTYXQRTXREXKXXLRFRHENXXGXNDXIRAPTXEQXKDXXXXQDLMETDXYKXXKTQHXSNDXXXYXXYQXXRGXKYXXSXNXXXRDXKPSNXXXNTTCDXKXCDXGXXRVADPDHDHTGFXTEYVXTRXXRXPEXXXNSKGXTKSXDXXSXGXXXXEXXSNRPXXPGKHYXDQXNHXXGIXGSPSQEDXNCXINLKXRNYXLSXPHKNKVPWNRLXPNADSKXXDXXDKXXTFNPHKRIEVEQXXAHPYXEQYYDPSDEPIAEAPXKFDXEXDDXPKEKXKELXFEETARFQPGYRS

SEQ ID NO: 433 - protein, 593 aa, Homo sapiens
  SITE (133)..(133): Xaa at position 133 is Cys, Ala, Val, Gly, Ser, or Thr
  SITE (157)..(157): Xaa at position 157 is Cys, Ala, Val, Gly, Ser, or Thr
  SITE (215)..(215): Xaa at position 215 is Cys, Ala, Val, Gly, Ser, or Thr
  SITE (239)..(239): Xaa at position 239 is Cys, Ala, Val, Gly, Ser, or Thr
  SITE (290)..(290): Xaa at position 290 is Cys, Ala, Val, Gly, Ser, or Thr
  SITE (314)..(314): Xaa at position 314 is Cys, Ala, Val, Gly, Ser, or Thr
  SITE (372)..(372): Xaa at position 372 is Cys, Ala, Val, Gly, Ser, or Thr
  SITE (396)..(396): Xaa at position 396 is Cys, Ala, Val, Gly, Ser, or Thr
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFEXPDFSTCCVMVDGSWGCCPMPQASXCEDRVHCCPHGAFCDLVHTRCITPTGTHPLAKKLPAQRTNRAVALSSSVMCPDARSRXPDGSTCCELPSGKYGCCPMPNATXCSDHLHCCPQDTVCDLIQSKCLSKENATTDLLTKLPAHTVGDVKCDMEVSXPDGYTCCRLQSGAWGCCPFTQAVXCEDHIHCCPAGFTCDTQKGTCEQGPHQVPWMEKAPAHLSLPDPQALKRDVPCDNVSSXPSSDTCCQLTSGEWGCCPIPEAVXCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 434 - protein, 300 aa, Homo sapiens
  SITE (59)..(59): Xaa at position 59 is Phe, Tyr, Met, His, Ile, Leu, Val Ala, or Gly
  SITE (63)..(63): Xaa at position 63 is Val, Ala, Gly, Leu, or Ile
  SITE (67)..(67): Xaa at position 67 is Cys, Ala, Val, Gly, Ser, or Thr
  SITE (70)..(70): Xaa at position 70 is Tyr, Phe, Met, His, Ile, Leu, Val Ala, or Gly
  SITE (77)..(77): Xaa at position 77 is Met, Ile, Leu, Val, Ala, or Gly
  SITE (85)..(85): Xaa at position 85 is Val, Ala, Gly, Leu, or Ile
  SITE (89)..(89): Xaa at position 89 is Phe, Tyr, Met, His, Ile, Leu, Val Ala, or Gly
  SITE (92)..(92): Xaa at position 92 is Ala, Gly, or Pro
  SITE (93)..(93): Xaa at position 93 is Phe, Tyr, Met, His, Ile, Leu, Val Ala, or Gly
  SITE (101)..(101): Xaa at position 101 is Ile, Ala, Val, Leu, or Gly
  SITE (106)..(106): Xaa at position 106 is Tyr, Phe, Met, His, Ile, Leu, Val Ala, or Gly
  SITE (109)..(109): Xaa at position 109 is Leu, Ala, Val, Gly, or Ile
  SITE (110)..(110): Xaa at position 110 is Met, Ile, Leu, Val, Ala, or Gly
  SITE (119)..(119): Xaa at position 119 is Cys, Ala, Val, Gly, Ser, or Thr
  SITE (122)..(122): Xaa at position 122 is Ile, Ala, Val, Leu, or Gly
  SITE (123)..(123): Xaa at position 123 is Leu, Ala, Val, Gly, or Ile
  SITE (124)..(124): Xaa at position 124 is Leu, Ala, Val, Gly, or Ile
  SITE (132)..(132): Xaa at position 132 is Ala, Gly, or Pro
  SITE (135)..(135): Xaa at position 135 is Phe, Tyr, Met, His, Ile, Leu, Val Ala, or Gly
  SITE (145)..(145): Xaa at position 145 is Leu, Ala, Val, Gly, or Ile
  SITE (149)..(149): Xaa at position 149 is Leu, Ala, Val, Gly, or Ile
  SITE (150)..(150): Xaa at position 150 is Leu, Ala, Val, Gly, or Ile
  SITE (153)..(153): Xaa at position 153 is Leu, Ala, Val, Gly, or Ile
  SITE (154)..(154): Xaa at position 154 is Ala, Gly, or Pro
  SITE (159)..(159): Xaa at position 159 is Trp, Tyr, Phe, Met, His, Ile, Leu Val, Ala, or Gly
  SITE (160)..(160): Xaa at position 160 is Cys, Ala, Val, Gly, Ser, or Thr
  SITE (187)..(187): Xaa at position 187 is Val, Ala, Gly, Leu, or Ile
  SITE (188)..(188): Xaa at position 188 is Phe, Tyr, Met, His, Ile, Leu, Val Ala, or Gly
  SITE (192)..(192): Xaa at position 192 is Val, Ala, Gly, Leu, or Ile
  SITE (197)..(197): Xaa at position 197 is Ala, Gly, or Pro
  SITE (199)..(199): Xaa at position 199 is Ala, Gly, or Pro
  SITE (200)..(200): Xaa at position 200 is Ala, Gly, or Pro
  SITE (204)..(204): Xaa at position 204 is Val, Ala, Gly, Leu, or Ile
  SITE (206)..(206): Xaa at position 206 is Val, Ala, Gly, Leu, or Ile
  SITE (207)..(207): Xaa at position 207 is Met, Ile, Leu, Val, Ala, or Gly
  SITE (208)..(208): Xaa at position 208 is Leu, Ala, Val, Gly, or Ile
  SITE (215)..(215): Xaa at position 215 is Ile, Ala, Val, Leu, or Gly
  SITE (216)..(216): Xaa at position 216 is Phe, Tyr, Met, His, Ile, Leu, Val Ala, or Gly
  SITE (222)..(222): Xaa at position 222 is Phe, Tyr, Met, His, Ile, Leu, Val Ala, or Gly
  SITE (225)..(225): Xaa at position 225 is Val, Ala, Gly, Leu, or Ile
  SITE (227)..(227): Xaa at position 227 is Val, Ala, Gly, Leu, or Ile
  SITE (230)..(230): Xaa at position 230 is Leu, Ala, Val, Gly, or Ile
  SITE (235)..(235): Xaa at position 235 is Val, Ala, Gly, Leu, or Ile
  SITE (238)..(238): Xaa at position 238 is Leu, Ala, Val, Gly, or Ile
  SITE (240)..(240): Xaa at position 240 is Ala, Gly, or Pro
  SITE (242)..(242): Xaa at position 242 is Val, Ala, Gly, Leu, or Ile
  SITE (253)..(253): Xaa at position 253 is Leu, Ala, Val, Gly, or Ile
  SITE (259)..(259): Xaa at position 259 is Ile, Ala, Val, Leu, or Gly
  SITE (262)..(262): Xaa at position 262 is Leu, Ala, Val, Gly, or Ile
  SITE (266)..(266): Xaa at position 266 is Ile, Ala, Val, Leu, or Gly
MANCEFSPVSGDKPCCRLSRRAQLCLGVSILVLILVVVLAVVVPRWRQQWSGPGTTKRXPETXLARXVKXTEIHPEXRHVDCQSXWDAXKGXXISKHPCNXTEEDXQPXXKLGTQTVPXNKXXXWSRIKDLXHQXTQVQRDMFTXEDTXXGYXXDDLTXXGEFNTSKINYQSCPDWRKDCSNNPVSXXWKTXSRRFXEXXCDVXHXXXNGSRSKXXDKNSTXGSXEXHNXQPEKXQTXEXWXIHGGREDSRDXCQDPTXKEXESIXSKRNIQFSCKNIYRPDKFLQCVKNPEDSSCTSEI

SEQ ID NO: 435 - protein, 595 aa, Homo sapiens
  SITE (44)..(44): Xaa at position 44 is Cys, Ala, Val, Gly, Ser, or Thr
  SITE (45)..(45): Xaa at position 45 is Cys, Ala, Val, Gly, Ser, or Thr
  SITE (48)..(48): Xaa at position 48 is Cys, Ala, Val, Gly, Ser, or Thr
  SITE (58)..(58): Xaa at position 58 is Cys, Ala, Val, Gly, Ser, or Thr
  SITE (65)..(65): Xaa at position 65 is Cys, Ala, Val, Gly, Ser, or Thr
  SITE (69)..(69): Xaa at position 69 is Cys, Ala, Val, Gly, Ser, or Thr
  SITE (74)..(74): Xaa at position 74 is Tyr, Phe, Met, His, Ile, Leu, Val Ala, or Gly
  SITE (81)..(81): Xaa at position 81 is Cys, Ala, Val, Gly, Ser, or Thr
  SITE (83)..(83): Xaa at position 83 is Ala, Gly, or Pro
  SITE (84)..(84): Xaa at position 84 is Cys, Ala, Val, Gly, Ser, or Thr
  SITE (85)..(85): Xaa at position 85 is Val, Ala, Gly, Leu, or Ile
  SITE (87)..(87): Xaa at position 87 is Cys, Ala, Val, Gly, Ser, or Thr
  SITE (92)..(92): Xaa at position 92 is Leu, Ala, Val, Gly, or Ile
  SITE (93)..(93): Xaa at position 93 is Val, Ala, Gly, Leu, or Ile
  SITE (98)..(98): Xaa at position 98 is Cys, Ala, Val, Gly, Ser, or Thr
  SITE (105)..(105): Xaa at position 105 is Val, Ala, Gly, Leu, or Ile
  SITE (106)..(106): Xaa at position 106 is Cys, Ala, Val, Gly, Ser, or Thr
  SITE (108)..(108): Xaa at position 108 is Cys, Ala, Val, Gly, Ser, or Thr
  SITE (113)..(113): Xaa at position 113 is Phe, Tyr, Met, His, Ile, Leu, Val Ala, or Gly
  SITE (114)..(114): Xaa at position 114 is Cys, Ala, Val, Gly, Ser, or Thr
  SITE (122)..(122): Xaa at position 122 is Cys, Ala, Val, Gly, Ser, or Thr
  SITE (123)..(123): Xaa at position 123 is Ala, Gly, or Pro
  SITE (125)..(125): Xaa at position 125 is Cys, Ala, Val, Gly, Ser, or Thr
  SITE (131)..(131): Xaa at position 131 is Cys, Ala, Val, Gly, Ser, or Thr
  SITE (136)..(136): Xaa at position 136 is Ile, Ala, Val, Leu, or Gly
  SITE (137)..(137): Xaa at position 137 is Val, Ala, Gly, Leu, or Ile
  SITE (233)..(233): Xaa at position 233 is Cys, Ala, Val, Gly, Ser, or Thr
  SITE (240)..(240): Xaa at position 240 is Cys, Ala, Val, Gly, Ser, or Thr
  SITE (244)..(244): Xaa at position 244 is Cys, Ala, Val, Gly, Ser, or Thr
  SITE (249)..(249): Xaa at position 249 is Tyr, Phe, Met, His, Ile, Leu, Val Ala, or Gly
  SITE (250)..(250): Xaa at position 250 is Leu, Ala, Val, Gly, or Ile
  SITE (256)..(256): Xaa at position 256 is Cys, Ala, Val, Gly, Ser, or Thr
  SITE (259)..(259): Xaa at position 259 is Cys, Ala, Val, Gly, Ser, or Thr
  SITE (260)..(260): Xaa at position 260 is Val, Ala, Gly, Leu, or Ile
  SITE (262)..(262): Xaa at position 262 is Cys, Ala, Val, Gly, Ser, or Thr
  SITE (267)..(267): Xaa at position 267 is Leu, Ala, Val, Gly, or Ile
  SITE (268)..(268): Xaa at position 268 is Val, Ala, Gly, Leu, or Ile
  SITE (273)..(273): Xaa at position 273 is Cys, Ala, Val, Gly, Ser, or Thr
  SITE (275)..(275): Xaa at position 275 is Trp, Tyr, Phe, Met, His, Ile, Leu Val, Ala, or Gly
  SITE (281)..(281): Xaa at position 281 is Cys, Ala, Val, Gly, Ser, or Thr
  SITE (283)..(283): Xaa at position 283 is Cys, Ala, Val, Gly, Ser, or Thr
  SITE (289)..(289): Xaa at position 289 is Cys, Ala, Val, Gly, Ser, or Thr
  SITE (297)..(297): Xaa at position 297 is Cys, Ala, Val, Gly, Ser, or Thr
  SITE (298)..(298): Xaa at position 298 is Ala, Gly, or Pro
  SITE (300)..(300): Xaa at position 300 is Cys, Ala, Val, Gly, Ser, or Thr
  SITE (306)..(306): Xaa at position 306 is Cys, Ala, Val, Gly, Ser, or Thr
  SITE (311)..(311): Xaa at position 311 is Val, Ala, Gly, Leu, or Ile
MRVLLAALGLLFLGALRAFPQDRPFEDTCHGNPSHYYDKAVRRXXYRXPMGLFPTQQXPQRPTDXRKQXEPDYXLDEADRXTXXXTXSRDDXXEKTPXAWNSSRXXEXRPGMXXSTSAVNSXXRXFFHSVXPAGMXXKFPGTAQKNTVCEPASPGVSPACASPENCKEPSSGTIPQAKPTPVSPATSSASTMPVRGGTRLAQEAASKLTRAPDSPSSVGRPSSDPGLSPTQPXPEGSGDXRKQXEPDYXXDEAGRXTAXXSXSRDDXXEKTPXAXNSSRTXEXRPGMIXATSATNSXXRXVPYPIXAAETXTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 436 - protein, 226 aa, Homo sapiens
  SITE (44)..(44): Xaa at position 44 is Trp, Tyr, Phe, Met, His, Ile, Leu Val, Ala, or Gly
  SITE (51)..(51): Xaa at position 51 is Phe, Tyr, Met, His, Ile, Leu, Val Ala, or Gly
  SITE (60)..(60): Xaa at position 60 is Cys, Ala, Val, Gly, Ser, or Thr
  SITE (64)..(64): Xaa at position 64 is Cys, Ala, Val, Gly, Ser, or Thr
  SITE (73)..(73): Xaa at position 73 is His, Phe, Tyr, Lys, Arg, Gly, Ser Thr, Ala, Val, Leu, Ile, Asn, Met, or Gln
  SITE (169)..(169): Xaa at position 169 is Cys, Ala, Val, Gly, Ser, or Thr
  SITE (171)..(171): Xaa at position 171 is Ala, Gly, or Pro
  SITE (180)..(180): Xaa at position 180 is Cys, Ala, Val, Gly, Ser, or Thr
MDWGTLQTILGGVNKHSTSIGKIWLTVLFIFRIMILVVAAKEVXGDEQADXVCNTLQPGXKNVXYDHYFPISXIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKXNXWPCPNTVDXFVSRPTEKTVFTVFMIAVSGICILLNVTELCYLLIRYCSGKSKKPV

SEQ ID NO: 437 - protein, 753 aa, Homo sapiens
  SITE (319)..(319): Xaa at position 319 is Cys, Ala, Val, Gly, Ser, or Thr
  SITE (393)..(393): Xaa at position 393 is Ala, Gly, or Pro
  SITE (411)..(411): Xaa at position 411 is Val, Ala, Gly, Leu, or Ile
  SITE (511)..(511): Xaa at position 511 is Ala, Gly, or Pro
  SITE (525)..(525): Xaa at position 525 is Leu, Ala, Val, Gly, or Ile
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDXDGYTDSIYTISISSASQQGLSPWYAEKCSSTLATSYSSGDYTDQRITSADLHNDCTETHTGTSASAPLAAGIFXLALEANPNLTWRDMQHLXVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEXTIEYSRRGDLHVTXTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 438 - protein, 76 aa, Macaca mulatta
  SITE (49)..(49): Xaa at position 49 is Cys, Ala, Val, Gly, Ser, or Thr
  SITE (53)..(53): Xaa at position 53 is Cys, Ala, Val, Gly, Ser, or Thr
EVCSEQAETGPCRAMISRWYFDVTEGKCAPFFYGGCGGNRNNFDTEEYXMAVXGSVMSQSLRKTTREPLTRDPVKL

SEQ ID NO: 439 - protein, 983 aa, Homo sapiens
  SITE (33)..(33): Xaa at position 33 is Leu, Ala, Val, Gly, or Ile
  SITE (68)..(68): Xaa at position 68 is Tyr, Phe, Met, His, Ile, Leu, Val Ala, or Gly
  SITE (70)..(70): Xaa at position 70 is Val, Ala, Gly, Leu, or Ile
  SITE (82)..(82): Xaa at position 82 is Leu, Ala, Val, Gly, or Ile
  SITE (87)..(87): Xaa at position 87 is Val, Ala, Gly, Leu, or Ile
  SITE (92)..(92): Xaa at position 92 is Ala, Gly, or Pro
  SITE (95)..(95): Xaa at position 95 is Ile, Ala, Val, Leu, or Gly
  SITE (96)..(96): Xaa at position 96 is Tyr, Phe, Met, His, Ile, Leu, Val Ala, or Gly
  SITE (97)..(97): Xaa at position 97 is Val, Ala, Gly, Leu, or Ile
  SITE (99)..(99): Xaa at position 99 is Leu, Ala, Val, Gly, or Ile
  SITE (101)..(101): Xaa at position 101 is Phe, Tyr, Met, His, Ile, Leu, Val Ala, or Gly
  SITE (103)..(103): Xaa at position 103 is Leu, Ala, Val, Gly, or Ile
  SITE (112)..(112): Xaa at position 112 is Val, Ala, Gly, Leu, or Ile
  SITE (120)..(120): Xaa at position 120 is Phe, Tyr, Met, His, Ile, Leu, Val Ala, or Gly
  SITE (122)..(122): Xaa at position 122 is Leu, Ala, Val, Gly, or Ile
  SITE (146)..(146): Xaa at position 146 is Ile, Ala, Val, Leu, or Gly
  SITE (155)..(155): Xaa at position 155 is Met, Ile, Leu, Val, Ala, or Gly
  SITE (171)..(171): Xaa at position 171 is Val, Ala, Gly, Leu, or Ile
  SITE (179)..(179): Xaa at position 179 is Phe, Tyr, Met, His, Ile, Leu, Val Ala, or Gly
  SITE (180)..(180): Xaa at position 180 is Tyr, Phe, Met, His, Ile, Leu, Val Ala, or Gly
  SITE (181)..(181): Xaa at position 181 is Leu, Ala, Val, Gly, or Ile
  SITE (182)..(182): Xaa at position 182 is Ala, Gly, or Pro
  SITE (183)..(183): Xaa at position 183 is Phe, Tyr, Met, His, Ile, Leu, Val Ala, or Gly
  SITE (188)..(188): Xaa at position 188 is Ala, Gly, or Pro
  SITE (190)..(190): Xaa at position 190 is Val, Ala, Gly, Leu, or Ile
  SITE (191)..(191): Xaa at position 191 is Ala, Gly, or Pro
  SITE (192)..(192): Xaa at position 192 is Leu, Ala, Val, Gly, or Ile
  SITE (195)..(195): Xaa at position 195 is Val, Ala, Gly, Leu, or Ile
  SITE (197)..(197): Xaa at position 197 is Val, Ala, Gly, Leu, or Ile
  SITE (436)..(436): Xaa at position 436 is Ala, Gly, or Pro
MDCQLSILLLLSCSVLDSFGELIPQPSNEVNLXDSKTIQGELGWISYPSHGWEEISGVDEHYTPIRTXQXCNVMDHSQNNWXRTNWXPRNSXQKXXXEXKXTXRDCNSIPLXLGTCKETXNXYYMESDDDHGVKFREHQFTKIDTXAADESFTQXDLGDRILKLNTEIREXGPVNKKGXXXXXQDVGXCXXXVSXRXYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAXPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 440 - protein, 1055 aa, Homo sapiens
  SITE (43)..(43): Xaa at position 43 is Trp, Tyr, Phe, Met, His, Ile, Leu Val, Ala, or Gly
  SITE (61)..(61): Xaa at position 61 is Val, Ala, Gly, Leu, or Ile
  SITE (72)..(72): Xaa at position 72 is Trp, Tyr, Phe, Met, His, Ile, Leu Val, Ala, or Gly
  SITE (73)..(73): Xaa at position 73 is Leu, Ala, Val, Gly, or Ile
  SITE (78)..(78): Xaa at position 78 is Ile, Ala, Val, Leu, or Gly
  SITE (83)..(83): Xaa at position 83 is Ala, Gly, or Pro
  SITE (86)..(86): Xaa at position 86 is Ile, Ala, Val, Leu, or Gly
  SITE (88)..(88): Xaa at position 88 is Val, Ala, Gly, Leu, or Ile
  SITE (90)..(90): Xaa at position 90 is Met, Ile, Leu, Val, Ala, or Gly
  SITE (92)..(92): Xaa at position 92 is Phe, Tyr, Met, His, Ile, Leu, Val Ala, or Gly
  SITE (94)..(94): Xaa at position 94 is Val, Ala, Gly, Leu, or Ile
  SITE (103)..(103): Xaa at position 103 is Val, Ala, Gly, Leu, or Ile
  SITE (111)..(111): Xaa at position 111 is Phe, Tyr, Met, His, Ile, Leu, Val Ala, or Gly
  SITE (113)..(113): Xaa at position 113 is Leu, Ala, Val, Gly, or Ile
  SITE (141)..(141): Xaa at position 141 is Ile, Ala, Val, Leu, or Gly
  SITE (150)..(150): Xaa at position 150 is Val, Ala, Gly, Leu, or Ile
  SITE (159)..(159): Xaa at position 159 is Ile, Ala, Val, Leu, or Gly
  SITE (166)..(166): Xaa at position 166 is Phe, Tyr, Met, His, Ile, Leu, Val Ala, or Gly
  SITE (169)..(169): Xaa at position 169 is Val, Ala, Gly, Leu, or Ile
  SITE (174)..(174): Xaa at position 174 is Phe, Tyr, Met, His, Ile, Leu, Val Ala, or Gly
  SITE (175)..(175): Xaa at position 175 is Tyr, Phe, Met, His, Ile, Leu, Val Ala, or Gly
  SITE (176)..(176): Xaa at position 176 is Leu, Ala, Val, Gly, or Ile
  SITE (177)..(177): Xaa at position 177 is Ala, Gly, or Pro
  SITE (178)..(178): Xaa at position 178 is Phe, Tyr, Met, His, Ile, Leu, Val Ala, or Gly
  SITE (187)..(187): Xaa at position 187 is Leu, Ala, Val, Gly, or Ile
  SITE (190)..(190): Xaa at position 190 is Val, Ala, Gly, Leu, or Ile
  SITE (192)..(192): Xaa at position 192 is Val, Ala, Gly, Leu, or Ile
  SITE (435)..(435): Xaa at position 435 is Ala, Gly, or Pro
MALRRLGAALLLLPLLAAVEETLMDSTTATAELGWMVHPPSGXEEVSGYDENMNTIRTYQXCNVFESSQNNXXRTKFXRRRGXHRXHXEXKXSXRDCSSIPSXPGSCKETXNXYYYEADFDSATKTFPNWMENPWVKVDTXAADESFSQXDLGGRVMKXNTEVRSXGPXSRSGXXXXXQDYGGCMSXIAXRXFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAXPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 441 - protein, 1685 aa, Homo sapiens
  SITE (1464)..(1464): Xaa at position 1464 is Ile, Ala, Val, Leu, or Gly
  SITE (1490)..(1490): Xaa at position 1490 is Leu, Ala, Val, Gly, or Ile
  SITE (1491)..(1491): Xaa at position 1491 is Tyr, Phe, Met, His, Ile, Leu Val, Ala, or Gly
  SITE (1503)..(1503): Xaa at position 1503 is Leu, Ala, Val, Gly, or Ile
  SITE (1537)..(1537): Xaa at position 1537 is Tyr, Phe, Met, His, Ile, Leu Val, Ala, or Gly
  SITE (1538)..(1538): Xaa at position 1538 is Trp, Tyr, Phe, Met, His, Ile Leu, Val, Ala, or Gly
  SITE (1539)..(1539): Xaa at position 1539 is Leu, Ala, Val, Gly, or Ile
  SITE (1561)..(1561): Xaa at position 1561 is Ile, Ala, Val, Leu, or Gly
  SITE (1564)..(1564): Xaa at position 1564 is Cys, Ala, Val, Gly, Ser, or Thr
  SITE (1565)..(1565): Xaa at position 1565 is Ala, Gly, or Pro
  SITE (1566)..(1566): Xaa at position 1566 is Val, Ala, Gly, Leu, or Ile
  SITE (1567)..(1567): Xaa at position 1567 is Cys, Ala, Val, Gly, Ser, or Thr
  SITE (1569)..(1569): Xaa at position 1569 is Ala, Gly, or Pro
  SITE (1599)..(1599): Xaa at position 1599 is Phe, Tyr, Met, His, Ile, Leu Val, Ala, or Gly
  SITE (1602)..(1602): Xaa at position 1602 is His, Phe, Tyr, Lys, Arg, Gly Ser, Thr, Ala, Val, Leu, Ile, Asn, Met, or Gln
  SITE (1620)..(1620): Xaa at position 1620 is Cys, Ala, Val, Gly, Ser, or Thr
  SITE (1629)..(1629): Xaa at position 1629 is Phe, Tyr, Met, His, Ile, Leu Val, Ala, or Gly
  SITE (1630)..(1630): Xaa at position 1630 is Ile, Ala, Val, Leu, or Gly
  SITE (1632)..(1632): Xaa at position 1632 is Cys, Ala, Val, Gly, Ser, or Thr
  SITE (1638)..(1638): Xaa at position 1638 is Cys, Ala, Val, Gly, Ser, or Thr
  SITE (1678)..(1678): Xaa at position 1678 is Cys, Ala, Val, Gly, Ser, or Thr
  SITE (1680)..(1680): Xaa at position 1680 is Val, Ala, Gly, Leu, or Ile
  SITE (1681)..(1681): Xaa at position 1681 is Cys, Ala, Val, Gly, Ser, or Thr
  SITE (1682)..(1682): Xaa at position 1682 is Met, Ile, Leu, Val, Ala, or Gly
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLXTRHSQTTDAPQCPQGTLQVYEGFSLXXVQGNKRAHGQDXGTAGSCLRRFSTMPFMFCNINNVCNFASRNDYSXXXSTPEPMPMSMQPLKGQSIQPFXSRXXXXEXPAVVIAVHSQTIQIPHCPQGWDSLWIGYSXMMXTSAGAEGSGQALASPGSXLEEFRSAPXXEXHGRGTXNYYANSYSFWLATVDVSDMFSKPQSETLKAGDLRTRISRXQXXXKRT

SEQ ID NO: 442 - protein, 219 aa, Homo sapiens
  SITE (48)..(48): Xaa at position 48 is Val, Ala, Gly, Leu, or Ile
  SITE (51)..(51): Xaa at position 51 is Met, Ile, Leu, Val, Ala, or Gly
  SITE (55)..(55): Xaa at position 55 is Ala, Gly, or Pro
  SITE (105)..(105): Xaa at position 105 is Ile, Ala, Val, Leu, or Gly
  SITE (123)..(123): Xaa at position 123 is Cys, Ala, Val, Gly, Ser, or Thr
  SITE (131)..(131): Xaa at position 131 is Leu, Ala, Val, Gly, or Ile
  SITE (141)..(141): Xaa at position 141 is Met, Ile, Leu, Val, Ala, or Gly
  SITE (159)..(159): Xaa at position 159 is Met, Ile, Leu, Val, Ala, or Gly
  SITE (163)..(163): Xaa at position 163 is Ile, Ala, Val, Leu, or Gly
  SITE (196)..(196): Xaa at position 196 is Cys, Ala, Val, Gly, Ser, or Thr
  SITE (199)..(199): Xaa at position 199 is Leu, Ala, Val, Gly, or Ile
  SITE (209)..(209): Xaa at position 209 is Ile, Ala, Val, Leu, or Gly
MCPARSLLLVATLVLLDHLSLARNLPVATPDPGMFPCLHHSQNLLRAXSNXLQKXRQTLEFYPCTSEEIDHEDITKDKTSTVEACLPLELTKNESCLNSRETSFXTNGSCLASRKTSFMMALXLSSIYEDXKMYQVEFKTXNAKLLMDPKRQIFLDQNXLAVXDELMQALNFNSETVPQKSSLEEPDFYKTKIKLXILXHAFRIRAVTXDRVMSYLNAS

SEQ ID NO: 443 - protein, 328 aa, Homo sapiens
  SITE (30)..(30): Xaa at position 30 is Val, Ala, Gly, Leu, or Ile
  SITE (32)..(32): Xaa at position 32 is Val, Ala, Gly, Leu, or Ile
  SITE (33)..(33): Xaa at position 33 is Val, Ala, Gly, Leu, or Ile
  SITE (46)..(46): Xaa at position 46 is Val, Ala, Gly, Leu, or Ile
  SITE (58)..(58): Xaa at position 58 is Ile, Ala, Val, Leu, or Gly
  SITE (60)..(60): Xaa at position 60 is Trp, Tyr, Phe, Met, His, Ile, Leu Val, Ala, or Gly
  SITE (79)..(79): Xaa at position 79 is Val, Ala, Gly, Leu, or Ile
  SITE (85)..(85): Xaa at position 85 is Ala, Gly, or Pro
  SITE (90)..(90): Xaa at position 90 is Cys, Ala, Val, Gly, Ser, or Thr
  SITE (102)..(102): Xaa at position 102 is Leu, Ala, Val, Gly, or Ile
  SITE (104)..(104): Xaa at position 104 is Leu, Ala, Val, Gly, or Ile
  SITE (116)..(116): Xaa at position 116 is Ile, Ala, Val, Leu, or Gly
  SITE (133)..(133): Xaa at position 133 is Ala, Gly, or Pro
  SITE (140)..(140): Xaa at position 140 is Phe, Tyr, Met, His, Ile, Leu, Val Ala, or Gly
  SITE (142)..(142): Xaa at position 142 is Cys, Ala, Val, Gly, Ser, or Thr
  SITE (144)..(144): Xaa at position 144 is Trp, Tyr, Phe, Met, His, Ile, Leu Val, Ala, or Gly
  SITE (191)..(191): Xaa at position 191 is Val, Ala, Gly, Leu, or Ile
  SITE (193)..(193): Xaa at position 193 is Cys, Ala, Val, Gly, Ser, or Thr
  SITE (208)..(208): Xaa at position 208 is Ile, Ala, Val, Leu, or Gly
  SITE (210)..(210): Xaa at position 210 is Val, Ala, Gly, Leu, or Ile
  SITE (212)..(212): Xaa at position 212 is Val, Ala, Gly, Leu, or Ile
  SITE (214)..(214): Xaa at position 214 is Ala, Gly, or Pro
  SITE (220)..(220): Xaa at position 220 is Tyr, Phe, Met, His, Ile, Leu, Val Ala, or Gly
  SITE (223)..(223): Xaa at position 223 is Tyr, Phe, Met, His, Ile, Leu, Val Ala, or Gly
  SITE (229)..(229): Xaa at position 229 is Ile, Ala, Val, Leu, or Gly
  SITE (233)..(233): Xaa at position 233 is Ile, Ala, Val, Leu, or Gly
  SITE (252)..(252): Xaa at position 252 is Val, Ala, Gly, Leu, or Ile
  SITE (254)..(254): Xaa at position 254 is Val, Ala, Gly, Leu, or Ile
  SITE (271)..(271): Xaa at position 271 is Leu, Ala, Val, Gly, or Ile
  SITE (273)..(273): Xaa at position 273 is Phe, Tyr, Met, His, Ile, Leu, Val Ala, or Gly
  SITE (274)..(274): Xaa at position 274 is Cys, Ala, Val, Gly, Ser, or Thr
  SITE (275)..(275): Xaa at position 275 is Val, Ala, Gly, Leu, or Ile
  SITE (277)..(277): Xaa at position 277 is Val, Ala, Gly, Leu, or Ile
  SITE (304)..(304): Xaa at position 304 is Ala, Gly, or Pro
  SITE (306)..(306): Xaa at position 306 is Ile, Ala, Val, Leu, or Gly
  SITE (308)..(308): Xaa at position 308 is Val, Ala, Gly, Leu, or Ile
  SITE (310)..(310): Xaa at position 310 is Ala, Gly, or Pro
MCHQQLVISWFSLVFLASPLVAIWELKKDXYXXELDWYPDAPGEMXVLTCDTPEEDGXTXTLDQSSEVLGSGKTLTIQXKEFGDXGQYTXHKGGEVLSHSLXLXHKKEDGIWSTDXLKDQKEPKNKTFLRCEXKNYSGRXTXWXLTTISTDLTFSVKSSRGSSDPQGVTCGAATLSAERVRGDNKEYEYSXEXQEDSACPAAEESLPXEXMXDXVHKLKXENXTSSFFXRDIXKPDPPKNLQLKPLKNSRQXEXSWEYPDTWSTPHSYFSXTXXXQXQGKSKREKKDRVFTDKTSATVICRKNXSXSXRXQDRYYSSSWSEWASVPCS

SEQ ID NO: 444 - protein, 882 aa, Homo sapiens
  SITE (57)..(57): Xaa at position 57 is Cys, Ala, Val, Gly, Ser, or Thr
  SITE (66)..(66): Xaa at position 66 is Cys, Ala, Val, Gly, Ser, or Thr
  SITE (73)..(73): Xaa at position 73 is Leu, Ala, Val, Gly, or Ile
  SITE (74)..(74): Xaa at position 74 is His, Phe, Tyr, Lys, Arg, Gly, Ser Thr, Ala, Val, Leu, Ile, Asn, Met, or Gln
  SITE (76)..(76): Xaa at position 76 is Leu, Ala, Val, Gly, or Ile
  SITE (129)..(129): Xaa at position 129 is Cys, Ala, Val, Gly, Ser, or Thr
  SITE (140)..(140): Xaa at position 140 is Cys, Ala, Val, Gly, Ser, or Thr
  SITE (148)..(148): Xaa at position 148 is Cys, Ala, Val, Gly, Ser, or Thr
MEPAPARSPRPQQDPARPQEPTMPPPETPSEGRQPSPSPSPTERAPASEEEFQFLRXQQCQAEAKXPKLLPCXXTXCSGCLEASGMQCPICQAPWPLGADTPALDNVFFESLQRRLSVYRQIVDAQAVXTRCKESADFWXFECEQLLXAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 445 - protein, 1187 aa, Homo sapiens
  SITE (28)..(28): Xaa at position 28 is Leu, Ala, Val, Gly, or Ile
  SITE (30)..(30): Xaa at position 30 is Val, Ala, Gly, Leu, or Ile
  SITE (53)..(53): Xaa at position 53 is Ala, Gly, or Pro
  SITE (56)..(56): Xaa at position 56 is Val, Ala, Gly, Leu, or Ile
  SITE (60)..(60): Xaa at position 60 is Ile, Ala, Val, Leu, or Gly
  SITE (61)..(61): Xaa at position 61 is Ala, Gly, or Pro
  SITE (64)..(64): Xaa at position 64 is Val, Ala, Gly, Leu, or Ile
  SITE (73)..(73): Xaa at position 73 is Leu, Ala, Val, Gly, or Ile
  SITE (76)..(76): Xaa at position 76 is Leu, Ala, Val, Gly, or Ile
  SITE (81)..(81): Xaa at position 81 is Ala, Gly, or Pro
  SITE (91)..(91): Xaa at position 91 is Leu, Ala, Val, Gly, or Ile
  SITE (101)..(101): Xaa at position 101 is Leu, Ala, Val, Gly, or Ile
  SITE (103)..(103): Xaa at position 103 is Phe, Tyr, Met, His, Ile, Leu, Val Ala, or Gly
  SITE (109)..(109): Xaa at position 109 is Phe, Tyr, Met, His, Ile, Leu, Val Ala, or Gly
  SITE (151)..(151): Xaa at position 151 is Tyr, Phe, Met, His, Ile, Leu, Val Ala, or Gly
  SITE (152)..(152): Xaa at position 152 is Leu, Ala, Val, Gly, or Ile
  SITE (153)..(153): Xaa at position 153 is Phe, Tyr, Met, His, Ile, Leu, Val Ala, or Gly
  SITE (160)..(160): Xaa at position 160 is Phe, Tyr, Met, His, Ile, Leu, Val Ala, or Gly
  SITE (165)..(165): Xaa at position 165 is Ala, Gly, or Pro
  SITE (184)..(184): Xaa at position 184 is Leu, Ala, Val, Gly, or Ile
  SITE (186)..(186): Xaa at position 186 is Met, Ile, Leu, Val, Ala, or Gly
  SITE (187)..(187): Xaa at position 187 is Ala, Gly, or Pro
  SITE (191)..(191): Xaa at position 191 is Leu, Ala, Val, Gly, or Ile
  SITE (193)..(193): Xaa at position 193 is His, Phe, Tyr, Lys, Arg, Gly, Ser Thr, Ala, Val, Leu, Ile, Asn, Met, or Gln
  SITE (214)..(214): Xaa at position 214 is Cys, Ala, Val, Gly, Ser, or Thr
  SITE (215)..(215): Xaa at position 215 is Ile, Ala, Val, Leu, or Gly
  SITE (219)..(219): Xaa at position 219 is Phe, Tyr, Met, His, Ile, Leu, Val Ala, or Gly
  SITE (259)..(259): Xaa at position 259 is Tyr, Phe, Met, His, Ile, Leu, Val Ala, or Gly
  SITE (260)..(260): Xaa at position 260 is Leu, Ala, Val, Gly, or Ile
  SITE (263)..(263): Xaa at position 263 is Leu, Ala, Val, Gly, or Ile
  SITE (267)..(267): Xaa at position 267 is Ala, Gly, or Pro
  SITE (277)..(277): Xaa at position 277 is Val, Ala, Gly, Leu, or Ile
  SITE (280)..(280): Xaa at position 280 is Leu, Ala, Val, Gly, or Ile
  SITE (283)..(283): Xaa at position 283 is Leu, Ala, Val, Gly, or Ile
  SITE (316)..(316): Xaa at position 316 is Val, Ala, Gly, Leu, or Ile
  SITE (318)..(318): Xaa at position 318 is Val, Ala, Gly, Leu, or Ile
  SITE (324)..(324): Xaa at position 324 is Ile, Ala, Val, Leu, or Gly
  SITE (378)..(378): Xaa at position 378 is Cys, Ala, Val, Gly, Ser, or Thr
  SITE (380)..(380): Xaa at position 380 is Phe, Tyr, Met, His, Ile, Leu, Val Ala, or Gly
  SITE (393)..(393): Xaa at position 393 is Val, Ala, Gly, Leu, or Ile
  SITE (395)..(395): Xaa at position 395 is Ile, Ala, Val, Leu, or Gly
  SITE (402)..(402): Xaa at position 402 is Cys, Ala, Val, Gly, Ser, or Thr
  SITE (403)..(403): Xaa at position 403 is Leu, Ala, Val, Gly, or Ile
  SITE (405)..(405): Xaa at position 405 is Leu, Ala, Val, Gly, or Ile
  SITE (407)..(407): Xaa at position 407 is Leu, Ala, Val, Gly, or Ile
  SITE (413)..(413): Xaa at position 413 is Ala, Gly, or Pro
  SITE (416)..(416): Xaa at position 416 is Phe, Tyr, Met, His, Ile, Leu, Val Ala, or Gly
  SITE (417)..(417): Xaa at position 417 is Val, Ala, Gly, Leu, or Ile
  SITE (419)..(419): Xaa at position 419 is Leu, Ala, Val, Gly, or Ile
  SITE (420)..(420): Xaa at position 420 is Val, Ala, Gly, Leu, or Ile
  SITE (423)..(423): Xaa at position 423 is Tyr, Phe, Met, His, Ile, Leu, Val Ala, or Gly
  SITE (426)..(426): Xaa at position 426 is Leu, Ala, Val, Gly, or Ile
  SITE (438)..(438): Xaa at position 438 is Val, Ala, Gly, Leu, or Ile
  SITE (452)..(452): Xaa at position 452 is His, Phe, Tyr, Lys, Arg, Gly, Ser Thr, Ala, Val, Leu, Ile, Asn, Met, or Gln
  SITE (471)..(471): Xaa at position 471 is Tyr, Phe, Met, His, Ile, Leu, Val Ala, or Gly
  SITE (472)..(472): Xaa at position 472 is Leu, Ala, Val, Gly, or Ile
  SITE (483)..(483): Xaa at position 483 is Leu, Ala, Val, Gly, or Ile
  SITE (485)..(485): Xaa at position 485 is Leu, Ala, Val, Gly, or Ile
  SITE (487)..(487): Xaa at position 487 is Val, Ala, Gly, Leu, or Ile
  SITE (507)..(507): Xaa at position 507 is Ile, Ala, Val, Leu, or Gly
  SITE (526)..(526): Xaa at position 526 is Val, Ala, Gly, Leu, or Ile
  SITE (529)..(529): Xaa at position 529 is Leu, Ala, Val, Gly, or Ile
  SITE (563)..(563): Xaa at position 563 is Ile, Ala, Val, Leu, or Gly
  SITE (639)..(639): Xaa at position 639 is Val, Ala, Gly, Leu, or Ile
  SITE (641)..(641): Xaa at position 641 is Leu, Ala, Val, Gly, or Ile
  SITE (644)..(644): Xaa at position 644 is Leu, Ala, Val, Gly, or Ile
  SITE (655)..(655): Xaa at position 655 is Phe, Tyr, Met, His, Ile, Leu, Val Ala, or Gly
  SITE (659)..(659): Xaa at position 659 is Ala, Gly, or Pro
  SITE (676)..(676): Xaa at position 676 is Val, Ala, Gly, Leu, or Ile
  SITE (677)..(677): Xaa at position 677 is Cys, Ala, Val, Gly, Ser, or Thr
  SITE (684)..(684): Xaa at position 684 is Ile, Ala, Val, Leu, or Gly
  SITE (685)..(685): Xaa at position 685 is Met, Ile, Leu, Val, Ala, or Gly
  SITE (686)..(686): Xaa at position 686 is Val, Ala, Gly, Leu, or Ile
  SITE (695)..(695): Xaa at position 695 is Leu, Ala, Val, Gly, or Ile
  SITE (699)..(699): Xaa at position 699 is Leu, Ala, Val, Gly, or Ile
  SITE (714)..(714): Xaa at position 714 is Val, Ala, Gly, Leu, or Ile
  SITE (715)..(715): Xaa at position 715 is Ala, Gly, or Pro
  SITE (718)..(718): Xaa at position 718 is Leu, Ala, Val, Gly, or Ile
  SITE (719)..(719): Xaa at position 719 is Ala, Gly, or Pro
  SITE (721)..(721): Xaa at position 721 is Ala, Gly, or Pro
  SITE (722)..(722): Xaa at position 722 is Leu, Ala, Val, Gly, or Ile
  SITE (725)..(725): Xaa at position 725 is Leu, Ala, Val, Gly, or Ile
  SITE (735)..(735): Xaa at position 735 is Val, Ala, Gly, Leu, or Ile
  SITE (740)..(740): Xaa at position 740 is Ile, Ala, Val, Leu, or Gly
  SITE (742)..(742): Xaa at position 742 is Leu, Ala, Val, Gly, or Ile
  SITE (755)..(755): Xaa at position 755 is Ile, Ala, Val, Leu, or Gly
  SITE (757)..(757): Xaa at position 757 is Leu, Ala, Val, Gly, or Ile
  SITE (762)..(762): Xaa at position 762 is Val, Ala, Gly, Leu, or Ile
  SITE (773)..(773): Xaa at position 773 is Val, Ala, Gly, Leu, or Ile
  SITE (776)..(776): Xaa at position 776 is Ile, Ala, Val, Leu, or Gly
  SITE (780)..(780): Xaa at position 780 is Ala, Gly, or Pro
  SITE (798)..(798): Xaa at position 798 is Trp, Tyr, Phe, Met, His, Ile, Leu Val, Ala, or Gly
  SITE (800)..(800): Xaa at position 800 is Phe, Tyr, Met, His, Ile, Leu, Val Ala, or Gly
  SITE (802)..(802): Xaa at position 802 is Ala, Gly, or Pro
  SITE (804)..(804): Xaa at position 804 is Leu, Ala, Val, Gly, or Ile
  SITE (805)..(805): Xaa at position 805 is Leu, Ala, Val, Gly, or Ile
  SITE (807)..(807): Xaa at position 807 is Ile, Ala, Val, Leu, or Gly
  SITE (838)..(838): Xaa at position 838 is Cys, Ala, Val, Gly, Ser, or Thr
  SITE (841)..(841): Xaa at position 841 is Leu, Ala, Val, Gly, or Ile
  SITE (844)..(844): Xaa at position 844 is Leu, Ala, Val, Gly, or Ile
  SITE (848)..(848): Xaa at position 848 is Cys, Ala, Val, Gly, Ser, or Thr
  SITE (859)..(859): Xaa at position 859 is Phe, Tyr, Met, His, Ile, Leu, Val Ala, or Gly
  SITE (862)..(862): Xaa at position 862 is Ile, Ala, Val, Leu, or Gly
  SITE (866)..(866): Xaa at position 866 is Leu, Ala, Val, Gly, or Ile
  SITE (913)..(913): Xaa at position 913 is Leu, Ala, Val, Gly, or Ile
  SITE (927)..(927): Xaa at position 927 is Val, Ala, Gly, Leu, or Ile
  SITE (929)..(929): Xaa at position 929 is Val, Ala, Gly, Leu, or Ile
  SITE (934)..(934): Xaa at position 934 is Ala, Gly, or Pro
  SITE (944)..(944): Xaa at position 944 is Trp, Tyr, Phe, Met, His, Ile, Leu Val, Ala, or Gly
  SITE (948)..(948): Xaa at position 948 is Ile, Ala, Val, Leu, or Gly
  SITE (951)..(951): Xaa at position 951 is Leu, Ala, Val, Gly, or Ile
  SITE (958)..(958): Xaa at position 958 is His, Phe, Tyr, Lys, Arg, Gly, Ser Thr, Ala, Val, Leu, Ile, Asn, Met, or Gln
  SITE (959)..(959): Xaa at position 959 is Ile, Ala, Val, Leu, or Gly
  SITE (960)..(960): Xaa at position 960 is Ile, Ala, Val, Leu, or Gly
  SITE (966)..(966): Xaa at position 966 is Cys, Ala, Val, Gly, Ser, or Thr
  SITE (974)..(974): Xaa at position 974 is Leu, Ala, Val, Gly, or Ile
  SITE (976)..(976): Xaa at position 976 is Leu, Ala, Val, Gly, or Ile
  SITE (977)..(977): Xaa at position 977 is Val, Ala, Gly, Leu, or Ile
  SITE (986)..(986): Xaa at position 986 is Leu, Ala, Val, Gly, or Ile
  SITE (990)..(990): Xaa at position 990 is Leu, Ala, Val, Gly, or Ile
  SITE (1000)..(1000): Xaa at position 1000 is Leu, Ala, Val, Gly, or Ile
  SITE (1001)..(1001): Xaa at position 1001 is Leu, Ala, Val, Gly, or Ile
  SITE (1003)..(1003): Xaa at position 1003 is Phe, Tyr, Met, His, Ile, Leu Val, Ala, or Gly
  SITE (1004)..(1004): Xaa at position 1004 is Ala, Gly, or Pro
  SITE (1007)..(1007): Xaa at position 1007 is Ile, Ala, Val, Leu, or Gly
  SITE (1008)..(1008): Xaa at position 1008 is Cys, Ala, Val, Gly, Ser, or Thr
  SITE (1011)..(1011): Xaa at position 1011 is Met, Ile, Leu, Val, Ala, or Gly
  SITE (1014)..(1014): Xaa at position 1014 is Leu, Ala, Val, Gly, or Ile
  SITE (1020)..(1020): Xaa at position 1020 is Ile, Ala, Val, Leu, or Gly
  SITE (1021)..(1021): Xaa at position 1021 is His, Phe, Tyr, Lys, Arg, Gly Ser, Thr, Ala, Val, Leu, Ile, Asn, Met, or Gln
  SITE (1024)..(1024): Xaa at position 1024 is Leu, Ala, Val, Gly, or Ile
  SITE (1025)..(1025): Xaa at position 1025 is Ala, Gly, or Pro
  SITE (1026)..(1026): Xaa at position 1026 is Ala, Gly, or Pro
  SITE (1029)..(1029): Xaa at position 1029 is Val, Ala, Gly, Leu, or Ile
  SITE (1031)..(1031): Xaa at position 1031 is Leu, Ala, Val, Gly, or Ile
  SITE (1037)..(1037): Xaa at position 1037 is Val, Ala, Gly, Leu, or Ile
  SITE (1039)..(1039): Xaa at position 1039 is Ile, Ala, Val, Leu, or Gly
  SITE (1042)..(1042): Xaa at position 1042 is Phe, Tyr, Met, His, Ile, Leu Val, Ala, or Gly
  SITE (1044)..(1044): Xaa at position 1044 is Leu, Ala, Val, Gly, or Ile
  SITE (1045)..(1045): Xaa at position 1045 is Ala, Gly, or Pro
  SITE (1069)..(1069): Xaa at position 1069 is Ala, Gly, or Pro
  SITE (1072)..(1072): Xaa at position 1072 is Cys, Ala, Val, Gly, Ser, or Thr
  SITE (1078)..(1078): Xaa at position 1078 is Phe, Tyr, Met, His, Ile, Leu Val, Ala, or Gly
  SITE (1084)..(1084): Xaa at position 1084 is Val, Ala, Gly, Leu, or Ile
  SITE (1087)..(1087): Xaa at position 1087 is Phe, Tyr, Met, His, Ile, Leu Val, Ala, or Gly
  SITE (1089)..(1089): Xaa at position 1089 is Val, Ala, Gly, Leu, or Ile
  SITE (1091)..(1091): Xaa at position 1091 is Leu, Ala, Val, Gly, or Ile
  SITE (1092)..(1092): Xaa at position 1092 is Tyr, Phe, Met, His, Ile, Leu Val, Ala, or Gly
  SITE (1094)..(1094): Xaa at position 1094 is Leu, Ala, Val, Gly, or Ile
  SITE (1124)..(1124): Xaa at position 1124 is Leu, Ala, Val, Gly, or Ile
  SITE (1127)..(1127): Xaa at position 1127 is Leu, Ala, Val, Gly, or Ile
  SITE (1128)..(1128): Xaa at position 1128 is Leu, Ala, Val, Gly, or Ile
  SITE (1134)..(1134): Xaa at position 1134 is Leu, Ala, Val, Gly, or Ile
  SITE (1140)..(1140): Xaa at position 1140 is Cys, Ala, Val, Gly, Ser, or Thr
  SITE (1144)..(1144): Xaa at position 1144 is Val, Ala, Gly, Leu, or Ile
  SITE (1148)..(1148): Xaa at position 1148 is Met, Ile, Leu, Val, Ala, or Gly
  SITE (1151)..(1151): Xaa at position 1151 is Cys, Ala, Val, Gly, Ser, or Thr
  SITE (1152)..(1152): Xaa at position 1152 is Trp, Tyr, Phe, Met, His, Ile Leu, Val, Ala, or Gly
  SITE (1165)..(1165): Xaa at position 1165 is Leu, Ala, Val, Gly, or Ile
  SITE (1169)..(1169): Xaa at position 1169 is Leu, Ala, Val, Gly, or Ile
MPLRHWGMARGSKPVGDGAQPMAAMGGXKXLLHWAGPGGGEPWVTFSESSLTXEEXCIHXXHKXGITPPCFNXFAXFDAQXQVWLPPNHIXEIPRDASLMXYXRIRFYXRNWHGMNPREPAVYRCGPPGTEASSDQTAQGMQLLDPASFEXXXEQGKHEXVNDVXSLWELSTEEEIHHFKNESXGXXFLHXCXLALRHGIPLEEVAKKTSFKDXXPRSXRRHIRQHSALTRLRLRNVFRRFLRDFQPGRLSQQMVMVKXXATXERLXPRFGTERVPXCHXRLXAQAEGEPCYIRDSGVAPTDPGPESAAGPPTHEXLXTGTGGXQWWPVEEEVNKEEGSSGSSGRNPQASLFGKKAKAHKAVGQPADRPREPLWAYFXDXRDITHVVLKEHCXSXHRQDNKXXEXSXPSRAAXLSXXSXXDGXFRXTADSSHYLCHEXAPPRLVMSIRDGIXGPLLEPFVQAKLRPEDGLXXIHWSTSHPYRXIXTXAQRSQAPDGMQSLRLRKFPXEQQDGAFVLEGWGRSFPSXREXGAALQGCLLRAGDDCFSLRRCCLPQPGETSNLIXMRGARASPRTLNLSQLSFHRVDQKEITQLSHLGQGTRTNVYEGRLRVEGSGDPEEGKMDDEDPLVPGRDRGQELRXVXKVXDPSHHDIALAXYETXSLMSQVSHTHLAFVHGXXVRGPENXXXTEYVEHGPXDVWXRRERGHVPMAWKMVXXQQXXSXXSYXENKNLVHGNXCGRNXLXARLGLAEGTSPFXKXSDPGXGLGALSREERXERXPWLXPECLPGGANSLSTAMDKXGXGXTXXEXCFDGEAPLQSRSPSEKEHFYQRQHRLPEPSXPQXATXTSQXLTYEPTQRPSXRTXLRDXTRLQPHNLADVLTVNPDSPASDPTVFHKRYLKKIRDLGEGHFGKVSXYCYDPTNDGTGEMXAXKALKXDCGPQHRSGXKQEXDIXRTLYHEXXXKYKGCXEDQGEKSXQXXMEYVPLGSXRDYXPRHSIGLAQXXLXXQQXXEGXAYXHAQHYXXRDXXXRNXLXDNDRLXKXGDXGXXKAVPEGHEYYRVREDGDSPVFWYXPEXLKEYKXYYASDXWSXGXTXXEXLTHCDSSQSPPTKFLELIGIAQGQMTVLRXTEXXERGERXPRPDKXPCEXYHLXKNXXETEASFRPTFENXIPIXKTVHEKYQGQAPSVFSVC

SEQ ID NO: 446 - protein, 261 aa, Homo sapiens
  SITE (124)..(124): Xaa at position 124 is Ala, Gly, or Pro
  SITE (126)..(126): Xaa at position 126 is Val, Ala, Gly, Leu, or Ile
  SITE (138)..(138): Xaa at position 138 is Leu, Ala, Val, Gly, or Ile
  SITE (153)..(153): Xaa at position 153 is Val, Ala, Gly, Leu, or Ile
  SITE (161)..(161): Xaa at position 161 is Leu, Ala, Val, Gly, or Ile
  SITE (163)..(163): Xaa at position 163 is Val, Ala, Gly, Leu, or Ile
  SITE (169)..(169): Xaa at position 169 is Tyr, Phe, Met, His, Ile, Leu, Val Ala, or Gly
  SITE (171)..(171): Xaa at position 171 is Ile, Ala, Val, Leu, or Gly
  SITE (173)..(173): Xaa at position 173 is Ala, Gly, or Pro
  SITE (175)..(175): Xaa at position 175 is Val, Ala, Gly, Leu, or Ile
  SITE (177)..(177): Xaa at position 177 is Phe, Tyr, Met, His, Ile, Leu, Val Ala, or Gly
  SITE (189)..(189): Xaa at position 189 is Phe, Tyr, Met, His, Ile, Leu, Val Ala, or Gly
  SITE (191)..(191): Xaa at position 191 is Ala, Gly, or Pro
  SITE (193)..(193): Xaa at position 193 is Leu, Ala, Val, Gly, or Ile
  SITE (231)..(231): Xaa at position 231 is Leu, Ala, Val, Gly, or Ile
  SITE (235)..(235): Xaa at position 235 is Ala, Gly, or Pro
  SITE (237)..(237): Xaa at position 237 is Val, Ala, Gly, Leu, or Ile
  SITE (239)..(239): Xaa at position 239 is Val, Ala, Gly, Leu, or Ile
  SITE (241)..(241): Xaa at position 241 is Val, Ala, Gly, Leu, or Ile
  SITE (256)..(256): Xaa at position 256 is Phe, Tyr, Met, His, Ile, Leu, Val Ala, or Gly
  SITE (258)..(258): Xaa at position 258 is Leu, Ala, Val, Gly, or Ile
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAXHXISEASSKTTSVXQWAEKGYYTMSNNLXTLENGKQXTXKRQGLXYXYXQXTXCSNREASSQAPXIXSXCLKSPGRFERILLRAANTHSSAKPCGQQSIHLGGVFEXQPGXSXFXNXTDPSQVSHGTGFTSXGXLKL

SEQ ID NO: 447 - protein, 214 aa, Homo sapiens
  SITE (67)..(67): Xaa at position 67 is Val, Ala, Gly, Leu, or Ile
  SITE (76)..(76): Xaa at position 76 is Val, Ala, Gly, Leu, or Ile
  SITE (78)..(78): Xaa at position 78 is Leu, Ala, Val, Gly, or Ile
  SITE (82)..(82): Xaa at position 82 is Phe, Tyr, Met, His, Ile, Leu, Val Ala, or Gly
  SITE (88)..(88): Xaa at position 88 is Val, Ala, Gly, Leu, or Ile
  SITE (89)..(89): Xaa at position 89 is Leu, Ala, Val, Gly, or Ile
  SITE (90)..(90): Xaa at position 90 is Phe, Tyr, Met, His, Ile, Leu, Val Ala, or Gly
  SITE (92)..(92): Xaa at position 92 is Val, Ala, Gly, Leu, or Ile
  SITE (96)..(96): Xaa at position 96 is Phe, Tyr, Met, His, Ile, Leu, Val Ala, or Gly
  SITE (100)..(100): Xaa at position 100 is Cys, Ala, Val, Gly, Ser, or Thr
  SITE (104)..(104): Xaa at position 104 is His, Phe, Tyr, Lys, Arg, Gly, Ser Thr, Ala, Val, Leu, Ile, Asn, Met, or Gln
  SITE (105)..(105): Xaa at position 105 is Leu, Ala, Val, Gly, or Ile
  SITE (108)..(108): Xaa at position 108 is Phe, Tyr, Met, His, Ile, Leu, Val Ala, or Gly
  SITE (112)..(112): Xaa at position 112 is Ala, Gly, or Pro
  SITE (115)..(115): Xaa at position 115 is Leu, Ala, Val, Gly, or Ile
  SITE (117)..(117): Xaa at position 117 is Ala, Gly, or Pro
  SITE (123)..(123): Xaa at position 123 is Val, Ala, Gly, Leu, or Ile
  SITE (124)..(124): Xaa at position 124 is Ala, Gly, or Pro
  SITE (125)..(125): Xaa at position 125 is Cys, Ala, Val, Gly, Ser, or Thr
  SITE (126)..(126): Xaa at position 126 is Leu, Ala, Val, Gly, or Ile
  SITE (128)..(128): Xaa at position 128 is Val, Ala, Gly, Leu, or Ile
  SITE (131)..(131): Xaa at position 131 is Ala, Gly, or Pro
  SITE (137)..(137): Xaa at position 137 is Trp, Tyr, Phe, Met, His, Ile, Leu Val, Ala, or Gly
  SITE (140)..(140): Xaa at position 140 is Ala, Gly, or Pro
  SITE (143)..(143): Xaa at position 143 is Ala, Gly, or Pro
  SITE (150)..(150): Xaa at position 150 is Leu, Ala, Val, Gly, or Ile
  SITE (151)..(151): Xaa at position 151 is Ala, Gly, or Pro
  SITE (157)..(157): Xaa at position 157 is Phe, Tyr, Met, His, Ile, Leu, Val Ala, or Gly
  SITE (178)..(178): Xaa at position 178 is Leu, Ala, Val, Gly, or Ile
  SITE (181)..(181): Xaa at position 181 is Phe, Tyr, Met, His, Ile, Leu, Val Ala, or Gly
  SITE (183)..(183): Xaa at position 183 is Met, Ile, Leu, Val, Ala, or Gly
  SITE (184)..(184): Xaa at position 184 is Val, Ala, Gly, Leu, or Ile
  SITE (185)..(185): Xaa at position 185 is Val, Ala, Gly, Leu, or Ile
  SITE (190)..(190): Xaa at position 190 is Val, Ala, Gly, Leu, or Ile
  SITE (207)..(207): Xaa at position 207 is Ala, Gly, or Pro
  SITE (210)..(210): Xaa at position 210 is Ile, Ala, Val, Leu, or Gly
MGLAGVCALRRSAGYILVGGAGGQSAAAAARRYSEGEWASGGVRSFSRAAAAMAPIKVGDAIPAVEXFEGEPGNKXNXAELXKGKKGXXXGXPGAXTPGXSKTXXPGXVEQXEAXKXKGVQVXXXXSXNDXFVTGEXGRXHKXEGKVRLXXDPTGAXGKETDLLLDDSLVSIFGNRRXKRXSXXXQDGIXKALNVEPDGTGLTCSLXPNXISQL

SEQ ID NO: 448 - protein, 668 aa, Homo sapiens
  SITE (58)..(58): Xaa at position 58 is Val, Ala, Gly, Leu, or Ile
  SITE (60)..(60): Xaa at position 60 is Val, Ala, Gly, Leu, or Ile
  SITE (78)..(78): Xaa at position 78 is Ala, Gly, or Pro
  SITE (79)..(79): Xaa at position 79 is Ala, Gly, or Pro
  SITE (81)..(81): Xaa at position 81 is Ala, Gly, or Pro
  SITE (82)..(82): Xaa at position 82 is Val, Ala, Gly, Leu, or Ile
  SITE (83)..(83): Xaa at position 83 is Cys, Ala, Val, Gly, Ser, or Thr
  SITE (126)..(126): Xaa at position 126 is Ala, Gly, or Pro
  SITE (151)..(151): Xaa at position 151 is Ala, Gly, or Pro
  SITE (153)..(153): Xaa at position 153 is Val, Ala, Gly, Leu, or Ile
  SITE (171)..(171): Xaa at position 171 is Ala, Gly, or Pro
  SITE (174)..(174): Xaa at position 174 is Val, Ala, Gly, Leu, or Ile
  SITE (176)..(176): Xaa at position 176 is Met, Ile, Leu, Val, Ala, or Gly
  SITE (185)..(185): Xaa at position 185 is Val, Ala, Gly, Leu, or Ile
  SITE (186)..(186): Xaa at position 186 is Cys, Ala, Val, Gly, Ser, or Thr
  SITE (195)..(195): Xaa at position 195 is Ala, Gly, or Pro
  SITE (197)..(197): Xaa at position 197 is Val, Ala, Gly, Leu, or Ile
  SITE (198)..(198): Xaa at position 198 is Val, Ala, Gly, Leu, or Ile
  SITE (199)..(199): Xaa at position 199 is Cys, Ala, Val, Gly, Ser, or Thr
  SITE (255)..(255): Xaa at position 255 is Ala, Gly, or Pro
  SITE (257)..(257): Xaa at position 257 is Ala, Gly, or Pro
  SITE (278)..(278): Xaa at position 278 is Val, Ala, Gly, Leu, or Ile
  SITE (280)..(280): Xaa at position 280 is Val, Ala, Gly, Leu, or Ile
  SITE (282)..(282): Xaa at position 282 is Phe, Tyr, Met, His, Ile, Leu, Val Ala, or Gly
  SITE (289)..(289): Xaa at position 289 is Val, Ala, Gly, Leu, or Ile
  SITE (290)..(290): Xaa at position 290 is Cys, Ala, Val, Gly, Ser, or Thr
  SITE (299)..(299): Xaa at position 299 is Ala, Gly, or Pro
  SITE (301)..(301): Xaa at position 301 is Val, Ala, Gly, Leu, or Ile
  SITE (302)..(302): Xaa at position 302 is Leu, Ala, Val, Gly, or Ile
  SITE (303)..(303): Xaa at position 303 is Cys, Ala, Val, Gly, Ser, or Thr
  SITE (308)..(308): Xaa at position 308 is Cys, Ala, Val, Gly, Ser, or Thr
  SITE (326)..(326): Xaa at position 326 is Met, Ile, Leu, Val, Ala, or Gly
  SITE (328)..(328): Xaa at position 328 is Tyr, Phe, Met, His, Ile, Leu, Val Ala, or Gly
  SITE (337)..(337): Xaa at position 337 is Leu, Ala, Val, Gly, or Ile
  SITE (355)..(355): Xaa at position 355 is Ala, Gly, or Pro
  SITE (358)..(358): Xaa at position 358 is Val, Ala, Gly, Leu, or Ile
  SITE (360)..(360): Xaa at position 360 is Cys, Ala, Val, Gly, Ser, or Thr
MWLFFGITGLLTAALSGHPSPAPPDQLNTSSAESELWEPGERLPVRLTNGSSSCSGTXEXRLEASWEPACGALWDSRXXEXXXRALGCGGAEAASQLAPPTPELPPPPAAGNTSVAANATLAGAPXLLCSGAEWRLCEVVEHACRSDGRRXRXTCAENRALRLVDGGGACXGRXEXLEHGEWGSXXDDTWDLEDXHXXXRQLGCGWAVQALPGLHFTPGRGPIHRDQVNCSGAEAYLWDCPGLPGQHYCGHKEDXGXVCSEHQSWRLTGGADRCEGQXEXHXRGVWNTXXDSEWYPSEXKXXXQSLGXGTAVERPKGLPHSLSGRXYXSCNGEELTXSNCSWRFNNSNLCSQSLXARXLXSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 449 - protein, 263 aa, Homo sapiens
  SITE (12)..(12): Xaa at position 12 is Ala, Gly, or Pro
  SITE (15)..(15): Xaa at position 15 is Ala, Gly, or Pro
  SITE (19)..(19): Xaa at position 19 is Ala, Gly, or Pro
  SITE (23)..(23): Xaa at position 23 is Tyr, Phe, Met, His, Ile, Leu, Val Ala, or Gly
  SITE (24)..(24): Xaa at position 24 is Val, Ala, Gly, Leu, or Ile
  SITE (28)..(28): Xaa at position 28 is Leu, Ala, Val, Gly, or Ile
  SITE (32)..(32): Xaa at position 32 is Leu, Ala, Val, Gly, or Ile
  SITE (44)..(44): Xaa at position 44 is Val, Ala, Gly, Leu, or Ile
  SITE (45)..(45): Xaa at position 45 is Ala, Gly, or Pro
  SITE (48)..(48): Xaa at position 48 is Phe, Tyr, Met, His, Ile, Leu, Val Ala, or Gly
  SITE (51)..(51): Xaa at position 51 is Ala, Gly, or Pro
  SITE (67)..(67): Xaa at position 67 is Val, Ala, Gly, Leu, or Ile
  SITE (70)..(70): Xaa at position 70 is Ala, Gly, or Pro
  SITE (71)..(71): Xaa at position 71 is Val, Ala, Gly, Leu, or Ile
  SITE (74)..(74): Xaa at position 74 is Ala, Gly, or Pro
  SITE (86)..(86): Xaa at position 86 is Ala, Gly, or Pro
  SITE (89)..(89): Xaa at position 89 is Tyr, Phe, Met, His, Ile, Leu, Val Ala, or Gly
  SITE (97)..(97): Xaa at position 97 is Ala, Gly, or Pro
  SITE (101)..(101): Xaa at position 101 is Ala, Gly, or Pro
  SITE (112)..(112): Xaa at position 112 is Val, Ala, Gly, Leu, or Ile
  SITE (116)..(116): Xaa at position 116 is Leu, Ala, Val, Gly, or Ile
  SITE (127)..(127): Xaa at position 127 is Val, Ala, Gly, Leu, or Ile
  SITE (130)..(130): Xaa at position 130 is Ala, Gly, or Pro
  SITE (142)..(142): Xaa at position 142 is Val, Ala, Gly, Leu, or Ile
  SITE (145)..(145): Xaa at position 145 is Ile, Ala, Val, Leu, or Gly
  SITE (146)..(146): Xaa at position 146 is Phe, Tyr, Met, His, Ile, Leu, Val Ala, or Gly
  SITE (161)..(161): Xaa at position 161 is Ala, Gly, or Pro
  SITE (164)..(164): Xaa at position 164 is Val, Ala, Gly, Leu, or Ile
  SITE (168)..(168): Xaa at position 168 is Leu, Ala, Val, Gly, or Ile
  SITE (172)..(172): Xaa at position 172 is His, Phe, Tyr, Lys, Arg, Gly, Ser Thr, Ala, Val, Leu, Ile, Asn, Met, or Gln
  SITE (181)..(181): Xaa at position 181 is Ala, Gly, or Pro
  SITE (183)..(183): Xaa at position 183 is Met, Ile, Leu, Val, Ala, or Gly
  SITE (186)..(186): Xaa at position 186 is Ala, Gly, or Pro
  SITE (190)..(190): Xaa at position 190 is Ala, Gly, or Pro
  SITE (192)..(192): Xaa at position 192 is Ala, Gly, or Pro
  SITE (203)..(203): Xaa at position 203 is Val, Ala, Gly, Leu, or Ile
  SITE (204)..(204): Xaa at position 204 is Tyr, Phe, Met, His, Ile, Leu, Val Ala, or Gly
  SITE (209)..(209): Xaa at position 209 is Ile, Ala, Val, Leu, or Gly
MWELRSASFWRXIFXEFFXTLFXXFFGXGSSXRWAPGPLHVLQXXMAXGLXLATLVQSVGHISGAHXNPXXTFXFLVGSQMSLLRXFCXMAAQLLGXVAGXAVLYSVTPPAXRGNXALNTLHPAVSXGQXTTVEIFLTLQFXLCXXATYDERRNGQLGSVXLAXGFSXALGXLFGMYYTGXGXNPXRSFXPXILTGNFTNHWXXWVGPXIGGGLGSLLYDFLLFPRLKSISERLSVLKGAKPDVSNGQPEVTGEPVELNTQAL

SEQ ID NO: 450 - protein, 362 aa, Homo sapiens
  SITE (29)..(29): Xaa at position 29 is Met, Ile, Leu, Val, Ala, or Gly
  SITE (31)..(31): Xaa at position 31 is Tyr, Phe, Met, His, Ile, Leu, Val Ala, or Gly
  SITE (35)..(35): Xaa at position 35 is Ala, Gly, or Pro
  SITE (46)..(46): Xaa at position 46 is Phe, Tyr, Met, His, Ile, Leu, Val Ala, or Gly
  SITE (52)..(52): Xaa at position 52 is Val, Ala, Gly, Leu, or Ile
  SITE (57)..(57): Xaa at position 57 is Phe, Tyr, Met, His, Ile, Leu, Val Ala, or Gly
  SITE (58)..(58): Xaa at position 58 is Val, Ala, Gly, Leu, or Ile
  SITE (60)..(60): Xaa at position 60 is Phe, Tyr, Met, His, Ile, Leu, Val Ala, or Gly
  SITE (73)..(73): Xaa at position 73 is Ala, Gly, or Pro
  SITE (75)..(75): Xaa at position 75 is Trp, Tyr, Phe, Met, His, Ile, Leu Val, Ala, or Gly
  SITE (76)..(76): Xaa at position 76 is Ile, Ala, Val, Leu, or Gly
  SITE (83)..(83): Xaa at position 83 is Tyr, Phe, Met, His, Ile, Leu, Val Ala, or Gly
  SITE (91)..(91): Xaa at position 91 is Phe, Tyr, Met, His, Ile, Leu, Val Ala, or Gly
  SITE (102)..(102): Xaa at position 102 is Leu, Ala, Val, Gly, or Ile
  SITE (105)..(105): Xaa at position 105 is Leu, Ala, Val, Gly, or Ile
  SITE (119)..(119): Xaa at position 119 is Leu, Ala, Val, Gly, or Ile
  SITE (122)..(122): Xaa at position 122 is Met, Ile, Leu, Val, Ala, or Gly
  SITE (125)..(125): Xaa at position 125 is Cys, Ala, Val, Gly, Ser, or Thr
  SITE (127)..(127): Xaa at position 127 is Val, Ala, Gly, Leu, or Ile
  SITE (140)..(140): Xaa at position 140 is Tyr, Phe, Met, His, Ile, Leu, Val Ala, or Gly
  SITE (142)..(142): Xaa at position 142 is Tyr, Phe, Met, His, Ile, Leu, Val Ala, or Gly
  SITE (147)..(147): Xaa at position 147 is Tyr, Phe, Met, His, Ile, Leu, Val Ala, or Gly
  SITE (148)..(148): Xaa at position 148 is Ile, Ala, Val, Leu, or Gly
  SITE (150)..(150): Xaa at position 150 is Leu, Ala, Val, Gly, or Ile
  SITE (154)..(154): Xaa at position 154 is Leu, Ala, Val, Gly, or Ile
  SITE (157)..(157): Xaa at position 157 is Trp, Tyr, Phe, Met, His, Ile, Leu Val, Ala, or Gly
  SITE (163)..(163): Xaa at position 163 is Ala, Gly, or Pro
  SITE (164)..(164): Xaa at position 164 is Ala, Gly, or Pro
  SITE (176)..(176): Xaa at position 176 is Val, Ala, Gly, Leu, or Ile
  SITE (177)..(177): Xaa at position 177 is Ala, Gly, or Pro
  SITE (184)..(184): Xaa at position 184 is Leu, Ala, Val, Gly, or Ile
  SITE (188)..(188): Xaa at position 188 is Cys, Ala, Val, Gly, Ser, or Thr
  SITE (189)..(189): Xaa at position 189 is Val, Ala, Gly, Leu, or Ile
  SITE (192)..(192): Xaa at position 192 is Leu, Ala, Val, Gly, or Ile
  SITE (195)..(195): Xaa at position 195 is Tyr, Phe, Met, His, Ile, Leu, Val Ala, or Gly
  SITE (196)..(196): Xaa at position 196 is Leu, Ala, Val, Gly, or Ile
  SITE (203)..(203): Xaa at position 203 is Leu, Ala, Val, Gly, or Ile
  SITE (213)..(213): Xaa at position 213 is Val, Ala, Gly, Leu, or Ile
  SITE (223)..(223): Xaa at position 223 is Ala, Gly, or Pro
  SITE (225)..(225): Xaa at position 225 is Leu, Ala, Val, Gly, or Ile
  SITE (227)..(227): Xaa at position 227 is Cys, Ala, Val, Gly, Ser, or Thr
  SITE (229)..(229): Xaa at position 229 is Ala, Gly, or Pro
  SITE (232)..(232): Xaa at position 232 is Phe, Tyr, Met, His, Ile, Leu, Val Ala, or Gly
  SITE (233)..(233): Xaa at position 233 is Tyr, Phe, Met, His, Ile, Leu, Val Ala, or Gly
  SITE (239)..(239): Xaa at position 239 is Leu, Ala, Val, Gly, or Ile
  SITE (241)..(241): Xaa at position 241 is Trp, Tyr, Phe, Met, His, Ile, Leu Val, Ala, or Gly
  SITE (269)..(269): Xaa at position 269 is Ala, Gly, or Pro
  SITE (270)..(270): Xaa at position 270 is Ala, Gly, or Pro
  SITE (271)..(271): Xaa at position 271 is Val, Ala, Gly, Leu, or Ile
  SITE (272)..(272): Xaa at position 272 is Val, Ala, Gly, Leu, or Ile
  SITE (273)..(273): Xaa at position 273 is Val, Ala, Gly, Leu, or Ile
  SITE (281)..(281): Xaa at position 281 is Tyr, Phe, Met, His, Ile, Leu, Val Ala, or Gly
  SITE (283)..(283): Xaa at position 283 is Cys, Ala, Val, Gly, Ser, or Thr
  SITE (285)..(285): Xaa at position 285 is Val, Ala, Gly, Leu, or Ile
  SITE (287)..(287): Xaa at position 287 is His, Phe, Tyr, Lys, Arg, Gly, Ser Thr, Ala, Val, Leu, Ile, Asn, Met, or Gln
MLVMAPRTVLLLLSAALALTETWAGSHSXRXFDTXMSRPGRGEPRXISVGYXDDTQXXRXDSDAASPREEPRXPXXEQEGPEXWDRNTQIXKTNTQTDRESXRNXRGYYNQSEAGSHTXQSXYGXDXGPDGRLLRGHNQXAXDGKDXXAXNEDXRSXTAADTXXQITQRKWEAARXXEQDRAYXEGTXXEWXRRXXENGKDTXERADPPKTHXTHHPISDHEXTXRXWXLGXXPAEITXTXQRDGEDQTQDTELVETRPAGDRTFQKWXXXXXPSGEEQRXTXHXQXEGLPKPLTLRWEPSSQSTVPIVGIVAGLAVLAVVVIGAVVAAVMCRRKSSGGKGGSYSQAACSDSAQGSDVSLTA

SEQ ID NO: 451 - protein, 894 aa, Homo sapiens
  SITE (54)..(54): Xaa at position 54 is Leu, Ala, Val, Gly, or Ile
  SITE (56)..(56): Xaa at position 56 is Cys, Ala, Val, Gly, Ser, or Thr
  SITE (58)..(58): Xaa at position 58 is Leu, Ala, Val, Gly, or Ile
  SITE (98)..(98): Xaa at position 98 is Val, Ala, Gly, Leu, or Ile
  SITE (102)..(102): Xaa at position 102 is Leu, Ala, Val, Gly, or Ile
  SITE (117)..(117): Xaa at position 117 is Cys, Ala, Val, Gly, Ser, or Thr
  SITE (119)..(119): Xaa at position 119 is Val, Ala, Gly, Leu, or Ile
  SITE (133)..(133): Xaa at position 133 is Val, Ala, Gly, Leu, or Ile
  SITE (160)..(160): Xaa at position 160 is Cys, Ala, Val, Gly, Ser, or Thr
  SITE (173)..(173): Xaa at position 173 is Trp, Tyr, Phe, Met, His, Ile, Leu Val, Ala, or Gly
  SITE (203)..(203): Xaa at position 203 is Phe, Tyr, Met, His, Ile, Leu, Val Ala, or Gly
  SITE (205)..(205): Xaa at position 205 is Cys, Ala, Val, Gly, Ser, or Thr
  SITE (207)..(207): Xaa at position 207 is Ala, Gly, or Pro
  SITE (219)..(219): Xaa at position 219 is Ala, Gly, or Pro
  SITE (221)..(221): Xaa at position 221 is Ile, Ala, Val, Leu, or Gly
MAWRCPRMGRVPLAWCLALCGWACMAPRGTQAEESPFVGNPGNITGARGLTGTXRXQXQVQGEPPEVHWLRDGQILELADSTQTQVPLGEDEQDDWIXVSQXRITSLQLSDTGQYQXLXFLGHQTFVSQPGYXGLEGLPYFLEEPEDRTVAANTPFNLSXQAQGPPEPVDLLXLQDAVPLATAPGHGPQRSLHVPGLNKTSSXSXEXHNAKGVTTSRTXTXTVLPQQPRNLHLVSRQPTELEVAWTPGLSGIYPLTHCTLQAVLSNDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 452 - protein, 359 aa, Homo sapiens
  SITE (27)..(27): Xaa at position 27 is Ile, Ala, Val, Leu, or Gly
  SITE (101)..(101): Xaa at position 101 is Cys, Ala, Val, Gly, Ser, or Thr
MILNSSTEDGIKRIQDDCPKAGRHNYXFVMIPTLYSIIFVVGIFGNSLVVIVIYFYMKLKTVASVFLLNLALADLCFLLTLPLWAVYTAMEYRWPFGNYLXKIASASVSFNLYASVFLLTCLSIDRYLAIVHPMKSRLRRTMLVAKVTCIIIWLLAGLASLPAIIHRNVFFIENTNITVCAFHYESQNSTLPIGLGLTKNILGFLFPFLIILTSYTLIWKALKKAYEIQKNKPRNDDIFKIIMAIVLFFFFSWIPHQIFTFLDVLIQLGIIRDCRIADIVDTAMPITICIAYFNNCLNPLFYGFLGKKFKRYFLQLLKYIPPKAKSHSNLSTKMSTLSYRPSDNVSSSTKKPAPCFEVE

SEQ ID NO: 453 - protein, 208 aa, Homo sapiens
  SITE (66)..(66): Xaa at position 66 is Leu, Ala, Val, Gly, or Ile
  SITE (68)..(68): Xaa at position 68 is Cys, Ala, Val, Gly, Ser, or Thr
  SITE (74)..(74): Xaa at position 74 is Leu, Ala, Val, Gly, or Ile
  SITE (76)..(76): Xaa at position 76 is Ile, Ala, Val, Leu, or Gly
  SITE (94)..(94): Xaa at position 94 is Ile, Ala, Val, Leu, or Gly
  SITE (95)..(95): Xaa at position 95 is Leu, Ala, Val, Gly, or Ile
  SITE (105)..(105): Xaa at position 105 is Val, Ala, Gly, Leu, or Ile
  SITE (107)..(107): Xaa at position 107 is Ile, Ala, Val, Leu, or Gly
  SITE (116)..(116): Xaa at position 116 is Leu, Ala, Val, Gly, or Ile
  SITE (118)..(118): Xaa at position 118 is Met, Ile, Leu, Val, Ala, or Gly
  SITE (134)..(134): Xaa at position 134 is Cys, Ala, Val, Gly, Ser, or Thr
  SITE (136)..(136): Xaa at position 136 is Phe, Tyr, Met, His, Ile, Leu, Val Ala, or Gly
  SITE (148)..(148): Xaa at position 148 is Tyr, Phe, Met, His, Ile, Leu, Val Ala, or Gly
  SITE (164)..(164): Xaa at position 164 is Val, Ala, Gly, Leu, or Ile
  SITE (165)..(165): Xaa at position 165 is Ala, Gly, or Pro
  SITE (166)..(166): Xaa at position 166 is Leu, Ala, Val, Gly, or Ile
  SITE (184)..(184): Xaa at position 184 is Phe, Tyr, Met, His, Ile, Leu, Val Ala, or Gly
  SITE (187)..(187): Xaa at position 187 is Phe, Tyr, Met, His, Ile, Leu, Val Ala, or Gly
  SITE (197)..(197): Xaa at position 197 is Val, Ala, Gly, Leu, or Ile
  SITE (200)..(200): Xaa at position 200 is Leu, Ala, Val, Gly, or Ile
MAPLGEVGNYFGVQDAVPFGNVPVLPVDSPVLLSDHLGQSEAGGLPRGPAVTDLDHLKGILRRRQXYXRTGFHXEXFPNGTIQGTRKDHSRFGXXEFISIAVGLXSXRGVDSGLYXGXNEKGELYGSEKLTQEXVXREQFEENWYNTXSSNLYKHVDTGRRYYXXXNKDGTPREGTRTKRHQKXTHXLPRPVDPDKXPEXYKDILSQS

SEQ ID NO: 454 - protein, 369 aa, Homo sapiens
  SITE (62)..(62): Xaa at position 62 is Cys, Ala, Val, Gly, Ser, or Thr
  SITE (64)..(64): Xaa at position 64 is Val, Ala, Gly, Leu, or Ile
  SITE (70)..(70): Xaa at position 70 is Met, Ile, Leu, Val, Ala, or Gly
  SITE (72)..(72): Xaa at position 72 is Cys, Ala, Val, Gly, Ser, or Thr
  SITE (74)..(74): Xaa at position 74 is Trp, Tyr, Phe, Met, His, Ile, Leu Val, Ala, or Gly
  SITE (85)..(85): Xaa at position 85 is Leu, Ala, Val, Gly, or Ile
  SITE (87)..(87): Xaa at position 87 is Leu, Ala, Val, Gly, or Ile
  SITE (102)..(102): Xaa at position 102 is Cys, Ala, Val, Gly, Ser, or Thr
  SITE (106)..(106): Xaa at position 106 is Leu, Ala, Val, Gly, or Ile
  SITE (115)..(115): Xaa at position 115 is Cys, Ala, Val, Gly, Ser, or Thr
  SITE (117)..(117): Xaa at position 117 is Leu, Ala, Val, Gly, or Ile
  SITE (124)..(124): Xaa at position 124 is Leu, Ala, Val, Gly, or Ile
  SITE (128)..(128): Xaa at position 128 is Phe, Tyr, Met, His, Ile, Leu, Val Ala, or Gly
  SITE (129)..(129): Xaa at position 129 is Val, Ala, Gly, Leu, or Ile
  SITE (130)..(130): Xaa at position 130 is Val, Ala, Gly, Leu, or Ile
  SITE (132)..(132): Xaa at position 132 is Leu, Ala, Val, Gly, or Ile
  SITE (146)..(146): Xaa at position 146 is Leu, Ala, Val, Gly, or Ile
  SITE (148)..(148): Xaa at position 148 is Leu, Ala, Val, Gly, or Ile
  SITE (152)..(152): Xaa at position 152 is Val, Ala, Gly, Leu, or Ile
  SITE (162)..(162): Xaa at position 162 is Leu, Ala, Val, Gly, or Ile
  SITE (165)..(165): Xaa at position 165 is Leu, Ala, Val, Gly, or Ile
  SITE (170)..(170): Xaa at position 170 is Leu, Ala, Val, Gly, or Ile
  SITE (172)..(172): Xaa at position 172 is Leu, Ala, Val, Gly, or Ile
  SITE (174)..(174): Xaa at position 174 is Trp, Tyr, Phe, Met, His, Ile, Leu Val, Ala, or Gly
  SITE (183)..(183): Xaa at position 183 is Leu, Ala, Val, Gly, or Ile
  SITE (185)..(185): Xaa at position 185 is His, Phe, Tyr, Lys, Arg, Gly, Ser Thr, Ala, Val, Leu, Ile, Asn, Met, or Gln
  SITE (187)..(187): Xaa at position 187 is Val, Ala, Gly, Leu, or Ile
  SITE (221)..(221): Xaa at position 221 is Phe, Tyr, Met, His, Ile, Leu, Val Ala, or Gly
  SITE (223)..(223): Xaa at position 223 is Val, Ala, Gly, Leu, or Ile
  SITE (227)..(227): Xaa at position 227 is Phe, Tyr, Met, His, Ile, Leu, Val Ala, or Gly
  SITE (234)..(234): Xaa at position 234 is Ala, Gly, or Pro
MLKPSLPFTSLLFLQLPLLGVGLNTTILTPNGNEDTTADFFLTTMPTDSLSVSTLPLPEVQXFXFNVEYXNXTXNSSSEPQPTNXTXHYWYKNSDNDKVQKXSHYXFSEEITSGXQXQKKEIHXYQTXXXQXQDPREPRRQATQMXKXQNLXIPWAPENLTXHKXSESQXEXNXNNRFLNHCXEXLXQYRTDWDHSWTEQSVDYRHKFSLPSVDGQKRYTXRXRSRXNPLCGSXQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 455 - protein, 310 aa, Homo sapiens
  SITE (50)..(50): Xaa at position 50 is Ala, Gly, or Pro
  SITE (62)..(62): Xaa at position 62 is Leu, Ala, Val, Gly, or Ile
  SITE (67)..(67): Xaa at position 67 is Val, Ala, Gly, Leu, or Ile
  SITE (69)..(69): Xaa at position 69 is Leu, Ala, Val, Gly, or Ile
  SITE (84)..(84): Xaa at position 84 is Trp, Tyr, Phe, Met, His, Ile, Leu Val, Ala, or Gly
  SITE (103)..(103): Xaa at position 103 is Ala, Gly, or Pro
  SITE (111)..(111): Xaa at position 111 is Tyr, Phe, Met, His, Ile, Leu, Val Ala, or Gly
  SITE (113)..(113): Xaa at position 113 is Cys, Ala, Val, Gly, Ser, or Thr
  SITE (126)..(126): Xaa at position 126 is Leu, Ala, Val, Gly, or Ile
  SITE (129)..(129): Xaa at position 129 is Leu, Ala, Val, Gly, or Ile
  SITE (133)..(133): Xaa at position 133 is Leu, Ala, Val, Gly, or Ile
  SITE (134)..(134): Xaa at position 134 is Val, Ala, Gly, Leu, or Ile
  SITE (135)..(135): Xaa at position 135 is Leu, Ala, Val, Gly, or Ile
  SITE (140)..(140): Xaa at position 140 is Leu, Ala, Val, Gly, or Ile
  SITE (142)..(142): Xaa at position 142 is Phe, Tyr, Met, His, Ile, Leu, Val Ala, or Gly
  SITE (148)..(148): Xaa at position 148 is Ile, Ala, Val, Leu, or Gly
  SITE (150)..(150): Xaa at position 150 is Leu, Ala, Val, Gly, or Ile
  SITE (152)..(152): Xaa at position 152 is Cys, Ala, Val, Gly, Ser, or Thr
  SITE (160)..(160): Xaa at position 160 is Leu, Ala, Val, Gly, or Ile
  SITE (163)..(163): Xaa at position 163 is Val, Ala, Gly, Leu, or Ile
  SITE (165)..(165): Xaa at position 165 is Phe, Tyr, Met, His, Ile, Leu, Val Ala, or Gly
  SITE (166)..(166): Xaa at position 166 is Phe, Tyr, Met, His, Ile, Leu, Val Ala, or Gly
  SITE (181)..(181): Xaa at position 181 is Phe, Tyr, Met, His, Ile, Leu, Val Ala, or Gly
  SITE (186)..(186): Xaa at position 186 is Ala, Gly, or Pro
  SITE (194)..(194): Xaa at position 194 is Tyr, Phe, Met, His, Ile, Leu, Val Ala, or Gly
  SITE (196)..(196): Xaa at position 196 is Cys, Ala, Val, Gly, Ser, or Thr
  SITE (212)..(212): Xaa at position 212 is Ile, Ala, Val, Leu, or Gly
  SITE (214)..(214): Xaa at position 214 is Val, Ala, Gly, Leu, or Ile
MGILSFLPVLATESDWADCKSPQPWGHMLLWTAVLFLAPVAGTPAAPPKXVLKLEPQWINVXQEDSXTXTCRGTHSPESDSIQXFHNGNLIPTHTQPSYRFKXNNNDSGEXTXQTGQTSLSDPVHXTVXSEWXXXQTPHXEXQEGETXVXRXHSWKDKPXVKXTXXQNGKSKKFSRSDPNXSIPQXNHSHSGDXHXTGNIGYTLYSSKPVTXTXQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 456 - protein, 323 aa, Homo sapiens
  SITE (50)..(50): Xaa at position 50 is Ala, Gly, or Pro
  SITE (62)..(62): Xaa at position 62 is Leu, Ala, Val, Gly, or Ile
  SITE (67)..(67): Xaa at position 67 is Val, Ala, Gly, Leu, or Ile
  SITE (69)..(69): Xaa at position 69 is Leu, Ala, Val, Gly, or Ile
  SITE (84)..(84): Xaa at position 84 is Trp, Tyr, Phe, Met, His, Ile, Leu Val, Ala, or Gly
  SITE (103)..(103): Xaa at position 103 is Ala, Gly, or Pro
  SITE (111)..(111): Xaa at position 111 is Tyr, Phe, Met, His, Ile, Leu, Val Ala, or Gly
  SITE (113)..(113): Xaa at position 113 is Cys, Ala, Val, Gly, Ser, or Thr
  SITE (126)..(126): Xaa at position 126 is Leu, Ala, Val, Gly, or Ile
  SITE (129)..(129): Xaa at position 129 is Leu, Ala, Val, Gly, or Ile
  SITE (133)..(133): Xaa at position 133 is Leu, Ala, Val, Gly, or Ile
  SITE (134)..(134): Xaa at position 134 is Val, Ala, Gly, Leu, or Ile
  SITE (135)..(135): Xaa at position 135 is Leu, Ala, Val, Gly, or Ile
  SITE (140)..(140): Xaa at position 140 is Leu, Ala, Val, Gly, or Ile
  SITE (142)..(142): Xaa at position 142 is Phe, Tyr, Met, His, Ile, Leu, Val Ala, or Gly
  SITE (148)..(148): Xaa at position 148 is Ile, Ala, Val, Leu, or Gly
  SITE (150)..(150): Xaa at position 150 is Leu, Ala, Val, Gly, or Ile
  SITE (152)..(152): Xaa at position 152 is Cys, Ala, Val, Gly, Ser, or Thr
  SITE (160)..(160): Xaa at position 160 is Leu, Ala, Val, Gly, or Ile
  SITE (163)..(163): Xaa at position 163 is Val, Ala, Gly, Leu, or Ile
  SITE (165)..(165): Xaa at position 165 is Phe, Tyr, Met, His, Ile, Leu, Val Ala, or Gly
  SITE (166)..(166): Xaa at position 166 is Phe, Tyr, Met, His, Ile, Leu, Val Ala, or Gly
  SITE (181)..(181): Xaa at position 181 is Phe, Tyr, Met, His, Ile, Leu, Val Ala, or Gly
  SITE (186)..(186): Xaa at position 186 is Ala, Gly, or Pro
  SITE (194)..(194): Xaa at position 194 is Tyr, Phe, Met, His, Ile, Leu, Val Ala, or Gly
  SITE (196)..(196): Xaa at position 196 is Cys, Ala, Val, Gly, Ser, or Thr
  SITE (212)..(212): Xaa at position 212 is Ile, Ala, Val, Leu, or Gly
  SITE (214)..(214): Xaa at position 214 is Val, Ala, Gly, Leu, or Ile
MGILSFLPVLATESDWADCKSPQPWGHMLLWTAVLFLAPVAGTPAAPPKXVLKLEPQWINVXQEDSXTXTCRGTHSPESDSIQXFHNGNLIPTHTQPSYRFKXNNNDSGEXTXQTGQTSLSDPVHXTVXSEWXXXQTPHXEXQEGETXVXRXHSWKDKPXVKXTXXQNGKSKKFSRSDPNXSIPQXNHSHSGDXHXTGNIGYTLYSSKPVTXTXQAPSSSPMGIIVAVVTGIAVAAIVAAVVALIYCRKKRISANSTDPVKAAQFEPPGRQMIAIRKRQPEETNNDYETADGGYMTLNPRAPTDDDKNIYLTLPPNDHVNSNN

SEQ ID NO: 457 - protein, 349 aa, Homo sapiens
  SITE (36)..(36): Xaa at position 36 is Leu, Ala, Val, Gly, or Ile
  SITE (45)..(45): Xaa at position 45 is Ala, Gly, or Pro
  SITE (51)..(51): Xaa at position 51 is Val, Ala, Gly, Leu, or Ile
  SITE (52)..(52): Xaa at position 52 is Leu, Ala, Val, Gly, or Ile
  SITE (53)..(53): Xaa at position 53 is Leu, Ala, Val, Gly, or Ile
  SITE (55)..(55): Xaa at position 55 is Val, Ala, Gly, Leu, or Ile
  SITE (65)..(65): Xaa at position 65 is Tyr, Phe, Met, His, Ile, Leu, Val Ala, or Gly
  SITE (67)..(67): Xaa at position 67 is Trp, Tyr, Phe, Met, His, Ile, Leu Val, Ala, or Gly
  SITE (79)..(79): Xaa at position 79 is Ile, Ala, Val, Leu, or Gly
  SITE (80)..(80): Xaa at position 80 is Ile, Ala, Val, Leu, or Gly
  SITE (105)..(105): Xaa at position 105 is Ala, Gly, or Pro
  SITE (107)..(107): Xaa at position 107 is Leu, Ala, Val, Gly, or Ile
  SITE (109)..(109): Xaa at position 109 is Met, Ile, Leu, Val, Ala, or Gly
  SITE (112)..(112): Xaa at position 112 is Val, Ala, Gly, Leu, or Ile
  SITE (120)..(120): Xaa at position 120 is Tyr, Phe, Met, His, Ile, Leu, Val Ala, or Gly
  SITE (122)..(122): Xaa at position 122 is Leu, Ala, Val, Gly, or Ile
  SITE (124)..(124): Xaa at position 124 is Val, Ala, Gly, Leu, or Ile
  SITE (138)..(138): Xaa at position 138 is Phe, Tyr, Met, His, Ile, Leu, Val Ala, or Gly
MGPISAPSCRWRIPWQGLLLTASLFTFWNPPTTAQXTIEAVPSNXAEGKEXXXLXHNLPQDPRGXNXYKGETVDANRRXXGYVISNQQITPGPAYSNRETIYPNXSXLXRNXTRNDTGSXTXQXIKLNLMSEEVTGQXSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 458 - protein, 505 aa, Homo sapiens
  SITE (139)..(139): Xaa at position 139 is Ala, Gly, or Pro
  SITE (140)..(140): Xaa at position 140 is Leu, Ala, Val, Gly, or Ile
  SITE (153)..(153): Xaa at position 153 is Ala, Gly, or Pro
  SITE (187)..(187): Xaa at position 187 is Ile, Ala, Val, Leu, or Gly
  SITE (189)..(189): Xaa at position 189 is Leu, Ala, Val, Gly, or Ile
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKXXLKYTGEVTWIPPXIFKSSCKIDVTYFPFDYQNCTMKFGSWSYDKAKXDXVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 459 - protein, 393 aa, Homo sapiens
  SITE (22)..(22): Xaa at position 22 is Val, Ala, Gly, Leu, or Ile
  SITE (24)..(24): Xaa at position 24 is Phe, Tyr, Met, His, Ile, Leu, Val Ala, or Gly
  SITE (29)..(29): Xaa at position 29 is Ala, Gly, or Pro
  SITE (33)..(33): Xaa at position 33 is Ala, Gly, or Pro
  SITE (40)..(40): Xaa at position 40 is Met, Ile, Leu, Val, Ala, or Gly
  SITE (42)..(42): Xaa at position 42 is Phe, Tyr, Met, His, Ile, Leu, Val Ala, or Gly
  SITE (61)..(61): Xaa at position 61 is Val, Ala, Gly, Leu, or Ile
  SITE (62)..(62): Xaa at position 62 is Ile, Ala, Val, Leu, or Gly
  SITE (67)..(67): Xaa at position 67 is Ile, Ala, Val, Leu, or Gly
  SITE (68)..(68): Xaa at position 68 is Val, Ala, Gly, Leu, or Ile
  SITE (69)..(69): Xaa at position 69 is Phe, Tyr, Met, His, Ile, Leu, Val Ala, or Gly
  SITE (71)..(71): Xaa at position 71 is Leu, Ala, Val, Gly, or Ile
  SITE (96)..(96): Xaa at position 96 is Ile, Ala, Val, Leu, or Gly
  SITE (98)..(98): Xaa at position 98 is Phe, Tyr, Met, His, Ile, Leu, Val Ala, or Gly
  SITE (103)..(103): Xaa at position 103 is Cys, Ala, Val, Gly, Ser, or Thr
  SITE (107)..(107): Xaa at position 107 is Val, Ala, Gly, Leu, or Ile
  SITE (110)..(110): Xaa at position 110 is Ala, Gly, or Pro
  SITE (131)..(131): Xaa at position 131 is Val, Ala, Gly, Leu, or Ile
  SITE (134)..(134): Xaa at position 134 is Ala, Gly, or Pro
  SITE (136)..(136): Xaa at position 136 is Leu, Ala, Val, Gly, or Ile
  SITE (144)..(144): Xaa at position 144 is His, Phe, Tyr, Lys, Arg, Gly, Ser Thr, Ala, Val, Leu, Ile, Asn, Met, or Gln
  SITE (146)..(146): Xaa at position 146 is Leu, Ala, Val, Gly, or Ile
  SITE (147)..(147): Xaa at position 147 is Val, Ala, Gly, Leu, or Ile
  SITE (176)..(176): Xaa at position 176 is Cys, Ala, Val, Gly, Ser, or Thr
  SITE (184)..(184): Xaa at position 184 is Ile, Ala, Val, Leu, or Gly
  SITE (185)..(185): Xaa at position 185 is Val, Ala, Gly, Leu, or Ile
  SITE (200)..(200): Xaa at position 200 is Tyr, Phe, Met, His, Ile, Leu, Val Ala, or Gly
  SITE (217)..(217): Xaa at position 217 is Val, Ala, Gly, Leu, or Ile
  SITE (224)..(224): Xaa at position 224 is Leu, Ala, Val, Gly, or Ile
  SITE (228)..(228): Xaa at position 228 is Val, Ala, Gly, Leu, or Ile
  SITE (229)..(229): Xaa at position 229 is Val, Ala, Gly, Leu, or Ile
  SITE (230)..(230): Xaa at position 230 is Ala, Gly, or Pro
  SITE (236)..(236): Xaa at position 236 is Ile, Ala, Val, Leu, or Gly
  SITE (238)..(238): Xaa at position 238 is Met, Ile, Leu, Val, Ala, or Gly
  SITE (240)..(240): Xaa at position 240 is Ile, Ala, Val, Leu, or Gly
  SITE (252)..(252): Xaa at position 252 is Ile, Ala, Val, Leu, or Gly
  SITE (267)..(267): Xaa at position 267 is Ile, Ala, Val, Leu, or Gly
  SITE (268)..(268): Xaa at position 268 is Ala, Gly, or Pro
  SITE (269)..(269): Xaa at position 269 is Leu, Ala, Val, Gly, or Ile
  SITE (274)..(274): Xaa at position 274 is Ile, Ala, Val, Leu, or Gly
  SITE (277)..(277): Xaa at position 277 is Ala, Gly, or Pro
  SITE (278)..(278): Xaa at position 278 is Ile, Ala, Val, Leu, or Gly
  SITE (281)..(281): Xaa at position 281 is Leu, Ala, Val, Gly, or Ile
  SITE (296)..(296): Xaa at position 296 is Tyr, Phe, Met, His, Ile, Leu, Val Ala, or Gly
  SITE (317)..(317): Xaa at position 317 is Leu, Ala, Val, Gly, or Ile
  SITE (322)..(322): Xaa at position 322 is Ile, Ala, Val, Leu, or Gly
  SITE (331)..(331): Xaa at position 331 is Tyr, Phe, Met, His, Ile, Leu, Val Ala, or Gly
  SITE (332)..(332): Xaa at position 332 is Leu, Ala, Val, Gly, or Ile
  SITE (333)..(333): Xaa at position 333 is Leu, Ala, Val, Gly, or Ile
  SITE (335)..(335): Xaa at position 335 is Ile, Ala, Val, Leu, or Gly
  SITE (346)..(346): Xaa at position 346 is Leu, Ala, Val, Gly, or Ile
  SITE (347)..(347): Xaa at position 347 is Phe, Tyr, Met, His, Ile, Leu, Val Ala, or Gly
  SITE (348)..(348): Xaa at position 348 is Leu, Ala, Val, Gly, or Ile
  SITE (350)..(350): Xaa at position 350 is Val, Ala, Gly, Leu, or Ile
  SITE (351)..(351): Xaa at position 351 is Ile, Ala, Val, Leu, or Gly
  SITE (368)..(368): Xaa at position 368 is Phe, Tyr, Met, His, Ile, Leu, Val Ala, or Gly
MTTYSDKGAKPERGRFLHFHSXTXWVGNXKQAXSFYCSKXGXEPLAYRGLETGSREVVSHXXKQGKXXXVXSSALNPWNKEMGDHLVKHGDGVKDXAXEVEDXDYIXQKXRERGAKIMREPWVEQDKFGKXKFXVXQTYGDTTXTXXEKMNYIGQFLPGYEAPAFMDPLLPKLPKXSLEMIDHXXGNQPDQEMVSASEWXLKNLQFHRFWSVDDTQXHTEYSSXRSIXXXNYEESXKXPXNEPAPGKKKSQXQEYVDYNGGAGVQHXXXKTEDXITXXRHXRERGLEFLSVPSTYXKQLREKLKTAKIKVKENIDAXEELKXLVDYDEKGXXXQXFTKPVQDRPTXXXEXXQRHNHQGFGAGNFNSLXKAFEEEQNLRGNLTNMETNGVVPGM

SEQ ID NO: 460 - protein, 288 aa, Homo sapiens
  SITE (46)..(46): Xaa at position 46 is Ala, Gly, or Pro
  SITE (48)..(48): Xaa at position 48 is Leu, Ala, Val, Gly, or Ile
  SITE (50)..(50): Xaa at position 50 is Cys, Ala, Val, Gly, Ser, or Thr
  SITE (64)..(64): Xaa at position 64 is Ile, Ala, Val, Leu, or Gly
  SITE (66)..(66): Xaa at position 66 is Trp, Tyr, Phe, Met, His, Ile, Leu Val, Ala, or Gly
  SITE (73)..(73): Xaa at position 73 is Val, Ala, Gly, Leu, or Ile
  SITE (74)..(74): Xaa at position 74 is Leu, Ala, Val, Gly, or Ile
  SITE (99)..(99): Xaa at position 99 is Leu, Ala, Val, Gly, or Ile
  SITE (101)..(101): Xaa at position 101 is Ile, Ala, Val, Leu, or Gly
  SITE (103)..(103): Xaa at position 103 is Ile, Ala, Val, Leu, or Gly
  SITE (114)..(114): Xaa at position 114 is Tyr, Phe, Met, His, Ile, Leu, Val Ala, or Gly
  SITE (116)..(116): Xaa at position 116 is Cys, Ala, Val, Gly, Ser, or Thr
  SITE (118)..(118): Xaa at position 118 is Val, Ala, Gly, Leu, or Ile
  SITE (160)..(160): Xaa at position 160 is Ile, Ala, Val, Leu, or Gly
  SITE (162)..(162): Xaa at position 162 is Cys, Ala, Val, Gly, Ser, or Thr
  SITE (175)..(175): Xaa at position 175 is Trp, Tyr, Phe, Met, His, Ile, Leu Val, Ala, or Gly
  SITE (200)..(200): Xaa at position 200 is Val, Ala, Gly, Leu, or Ile
  SITE (204)..(204): Xaa at position 204 is Leu, Ala, Val, Gly, or Ile
  SITE (214)..(214): Xaa at position 214 is Phe, Tyr, Met, His, Ile, Leu, Val Ala, or Gly
  SITE (216)..(216): Xaa at position 216 is Cys, Ala, Val, Gly, Ser, or Thr
  SITE (218)..(218): Xaa at position 218 is Ile, Ala, Val, Leu, or Gly
MGHTRRQGTSPSKCPYLNFFQLLVLAGLSHFCSGVIHVTKEVKEVXTXSXGHNVSVEELAQTRXYXQKEKKMXXTMMSGDMNIWPEYKNRTIFDITNNXSXVXLALRPSDEGTXEXVXLKYEKDAFKREHLAEVTLSVKADFPTPSISDFEIPTSNIRRXIXSTSGGFPEPHLSXLENGEELNAINTTVSQDPETELYAXSSKXDFNMTTNHSXMXLXKYGHLRVNQTFNWNTTKQEHFPDNLLPSWAITLISVNGIFVICCLTYCFAPRCRERRRNERLRRESVRPV

SEQ ID NO: 461 - protein, 354 aa, Variola virus
  isolate Human/India/Ind3/1967 (VARV) (Smallpox virus)
  SITE (36)..(36): Xaa at position 36 is Phe, Tyr, Met, His, Ile, Leu, Val Ala, or Gly
  SITE (66)..(66): Xaa at position 66 is Ala, Gly, or Pro
  SITE (83)..(83): Xaa at position 83 is Leu, Ala, Val, Gly, or Ile
  SITE (210)..(210): Xaa at position 210 is Ile, Ala, Val, Leu, or Gly
  SITE (238)..(238): Xaa at position 238 is Val, Ala, Gly, Leu, or Ile
MMKMTMKMMVHIYFVSLLLLLFHSYAIDIENEITDXFNKMKDTLPAKDSKWLNPTCIFGGTMNNMXAIGEPFSAKCPPIEDSXLSRRYINKDNVVNWEKIGKTRRPLNRRVKNGDLWIANYTSNDSHRMYLCTVITKNGDCIQGIVRSHVRKPSSCIPEIYELGTHDKYGIDLYCGIIYAKHYNNITWYKDNKEINIDDIKYSQTGKELXIHNPALEDSGRYDCYVHYDDVRIKNDIXVSRCKILTVIPSQDHRFKLILDSKINVIIGEPANITCTAVSTSLLFDDVLIEWENPSGWLIGFDFDVYSVLTSRGGITEATLYFKNVTEEYIGNTYKCRGHNYYFEKTLTTTVVLE

SEQ ID NO: 462 - protein, 522 aa, Homo sapiens
  SITE (33)..(33): Xaa at position 33 is Ile, Ala, Val, Leu, or Gly
  SITE (34)..(34): Xaa at position 34 is Leu, Ala, Val, Gly, or Ile
  SITE (35)..(35): Xaa at position 35 is Leu, Ala, Val, Gly, or Ile
  SITE (36)..(36): Xaa at position 36 is Leu, Ala, Val, Gly, or Ile
  SITE (37)..(37): Xaa at position 37 is Leu, Ala, Val, Gly, or Ile
  SITE (38)..(38): Xaa at position 38 is Met, Ile, Leu, Val, Ala, or Gly
  SITE (41)..(41): Xaa at position 41 is Met, Ile, Leu, Val, Ala, or Gly
  SITE (46)..(46): Xaa at position 46 is Leu, Ala, Val, Gly, or Ile
  SITE (62)..(62): Xaa at position 62 is Met, Ile, Leu, Val, Ala, or Gly
  SITE (69)..(69): Xaa at position 69 is Phe, Tyr, Met, His, Ile, Leu, Val Ala, or Gly
  SITE (72)..(72): Xaa at position 72 is Phe, Tyr, Met, His, Ile, Leu, Val Ala, or Gly
  SITE (73)..(73): Xaa at position 73 is Tyr, Phe, Met, His, Ile, Leu, Val Ala, or Gly
  SITE (75)..(75): Xaa at position 75 is Ala, Gly, or Pro
  SITE (84)..(84): Xaa at position 84 is Ala, Gly, or Pro
  SITE (85)..(85): Xaa at position 85 is Ala, Gly, or Pro
  SITE (86)..(86): Xaa at position 86 is Leu, Ala, Val, Gly, or Ile
  SITE (87)..(87): Xaa at position 87 is Leu, Ala, Val, Gly, or Ile
  SITE (91)..(91): Xaa at position 91 is Leu, Ala, Val, Gly, or Ile
  SITE (97)..(97): Xaa at position 97 is Phe, Tyr, Met, His, Ile, Leu, Val Ala, or Gly
  SITE (104)..(104): Xaa at position 104 is Ala, Gly, or Pro
  SITE (113)..(113): Xaa at position 113 is Ile, Ala, Val, Leu, or Gly
  SITE (117)..(117): Xaa at position 117 is Ile, Ala, Val, Leu, or Gly
  SITE (123)..(123): Xaa at position 123 is Leu, Ala, Val, Gly, or Ile
  SITE (124)..(124): Xaa at position 124 is Leu, Ala, Val, Gly, or Ile
  SITE (128)..(128): Xaa at position 128 is Leu, Ala, Val, Gly, or Ile
  SITE (137)..(137): Xaa at position 137 is Ile, Ala, Val, Leu, or Gly
  SITE (138)..(138): Xaa at position 138 is Val, Ala, Gly, Leu, or Ile
  SITE (141)..(141): Xaa at position 141 is Trp, Tyr, Phe, Met, His, Ile, Leu Val, Ala, or Gly
  SITE (143)..(143): Xaa at position 143 is Leu, Ala, Val, Gly, or Ile
  SITE (154)..(154): Xaa at position 154 is His, Phe, Tyr, Lys, Arg, Gly, Ser Thr, Ala, Val, Leu, Ile, Asn, Met, or Gln
  SITE (159)..(159): Xaa at position 159 is Trp, Tyr, Phe, Met, His, Ile, Leu Val, Ala, or Gly
  SITE (166)..(166): Xaa at position 166 is His, Phe, Tyr, Lys, Arg, Gly, Ser Thr, Ala, Val, Leu, Ile, Asn, Met, or Gln
  SITE (180)..(180): Xaa at position 180 is Val, Ala, Gly, Leu, or Ile
  SITE (190)..(190): Xaa at position 190 is Tyr, Phe, Met, His, Ile, Leu, Val Ala, or Gly
  SITE (203)..(203): Xaa at position 203 is Ala, Gly, or Pro
  SITE (209)..(209): Xaa at position 209 is Tyr, Phe, Met, His, Ile, Leu, Val Ala, or Gly
  SITE (213)..(213): Xaa at position 213 is Ala, Gly, or Pro
  SITE (216)..(216): Xaa at position 216 is Phe, Tyr, Met, His, Ile, Leu, Val Ala, or Gly
  SITE (217)..(217): Xaa at position 217 is Ile, Ala, Val, Leu, or Gly
  SITE (226)..(226): Xaa at position 226 is Phe, Tyr, Met, His, Ile, Leu, Val Ala, or Gly
  SITE (227)..(227): Xaa at position 227 is Phe, Tyr, Met, His, Ile, Leu, Val Ala, or Gly
  SITE (228)..(228): Xaa at position 228 is Leu, Ala, Val, Gly, or Ile
  SITE (229)..(229): Xaa at position 229 is Tyr, Phe, Met, His, Ile, Leu, Val Ala, or Gly
  SITE (230)..(230): Xaa at position 230 is Trp, Tyr, Phe, Met, His, Ile, Leu Val, Ala, or Gly
  SITE (231)..(231): Xaa at position 231 is Ala, Gly, or Pro
  SITE (232)..(232): Xaa at position 232 is Val, Ala, Gly, Leu, or Ile
  SITE (234)..(234): Xaa at position 234 is Ala, Gly, or Pro
  SITE (240)..(240): Xaa at position 240 is Tyr, Phe, Met, His, Ile, Leu, Val Ala, or Gly
  SITE (241)..(241): Xaa at position 241 is Ala, Gly, or Pro
  SITE (254)..(254): Xaa at position 254 is Tyr, Phe, Met, His, Ile, Leu, Val Ala, or Gly
  SITE (257)..(257): Xaa at position 257 is Ala, Gly, or Pro
  SITE (258)..(258): Xaa at position 258 is Val, Ala, Gly, Leu, or Ile
  SITE (261)..(261): Xaa at position 261 is Ile, Ala, Val, Leu, or Gly
  SITE (265)..(265): Xaa at position 265 is Ile, Ala, Val, Leu, or Gly
  SITE (268)..(268): Xaa at position 268 is Ile, Ala, Val, Leu, or Gly
  SITE (272)..(272): Xaa at position 272 is Leu, Ala, Val, Gly, or Ile
  SITE (283)..(283): Xaa at position 283 is Val, Ala, Gly, Leu, or Ile
  SITE (284)..(284): Xaa at position 284 is Phe, Tyr, Met, His, Ile, Leu, Val Ala, or Gly
  SITE (285)..(285): Xaa at position 285 is Phe, Tyr, Met, His, Ile, Leu, Val Ala, or Gly
  SITE (291)..(291): Xaa at position 291 is Ala, Gly, or Pro
  SITE (294)..(294): Xaa at position 294 is Ile, Ala, Val, Leu, or Gly
  SITE (308)..(308): Xaa at position 308 is Cys, Ala, Val, Gly, Ser, or Thr
  SITE (314)..(314): Xaa at position 314 is Phe, Tyr, Met, His, Ile, Leu, Val Ala, or Gly
  SITE (318)..(318): Xaa at position 318 is Met, Ile, Leu, Val, Ala, or Gly
  SITE (322)..(322): Xaa at position 322 is Ala, Gly, or Pro
  SITE (323)..(323): Xaa at position 323 is Leu, Ala, Val, Gly, or Ile
  SITE (324)..(324): Xaa at position 324 is Ala, Gly, or Pro
  SITE (325)..(325): Xaa at position 325 is Trp, Tyr, Phe, Met, His, Ile, Leu Val, Ala, or Gly
  SITE (342)..(342): Xaa at position 342 is Ile, Ala, Val, Leu, or Gly
  SITE (346)..(346): Xaa at position 346 is Phe, Tyr, Met, His, Ile, Leu, Val Ala, or Gly
  SITE (350)..(350): Xaa at position 350 is Leu, Ala, Val, Gly, or Ile
  SITE (368)..(368): Xaa at position 368 is Leu, Ala, Val, Gly, or Ile
  SITE (384)..(384): Xaa at position 384 is Tyr, Phe, Met, His, Ile, Leu, Val Ala, or Gly
  SITE (391)..(391): Xaa at position 391 is Met, Ile, Leu, Val, Ala, or Gly
  SITE (392)..(392): Xaa at position 392 is Ala, Gly, or Pro
  SITE (393)..(393): Xaa at position 393 is Ala, Gly, or Pro
  SITE (400)..(400): Xaa at position 400 is Ala, Gly, or Pro
  SITE (401)..(401): Xaa at position 401 is His, Phe, Tyr, Lys, Arg, Gly, Ser Thr, Ala, Val, Leu, Ile, Asn, Met, or Gln
  SITE (427)..(427): Xaa at position 427 is Val, Ala, Gly, Leu, or Ile
  SITE (441)..(441): Xaa at position 441 is Ile, Ala, Val, Leu, or Gly
  SITE (442)..(442): Xaa at position 442 is Phe, Tyr, Met, His, Ile, Leu, Val Ala, or Gly
  SITE (464)..(464): Xaa at position 464 is Ala, Gly, or Pro
  SITE (468)..(468): Xaa at position 468 is Ile, Ala, Val, Leu, or Gly
  SITE (486)..(486): Xaa at position 486 is Leu, Ala, Val, Gly, or Ile
MAAVVAATRWWQLLLVLSAAGMGASGAPQPPNXXXXXXDDXGWGDXGVYGEPSRETPNLDRXAAEGLLXPNXXSXNPLCSPSRXXXXTGRXPIRNGXYTTNAHXRNAYTPQEXVGGXPDSEQXXPELXKKAGYVSKXXGKXHXGHRPQFHPLKXGFDEXFGSPNCXFGPYDNKARPNIPXYRDWEMVGRXYEEFPINLKTGEXNLTQIXLQEXLDXXKRQARHHPXXXXXXXDXTHAPVXXSKPFLGTSQRGRXGDXXREXDDSXGKXLELXQDLHVADNTFXXXTSDNGXALXSAPEQGGSNGPFLXGKQTTXEGGXREPXXXXWPGHVTAGQVSHQLGSXMDLXTTSXALAGLTPPSDRAIDGLNXLPTLLQGRLMDRPIFXYRGDTLXXXTLGQHKXXFWTWTNSWENFRQGIDFCPGQNVSGXTTHNLEDHTKLPLXXHLGRDPGERFPLSFASAEYQEXLSRXTSVVQQHQEALVPAQPQXNVCNWAVMNWAPPGCEKLGKCLTPPESIPKKCLWSH

SEQ ID NO: 463 - protein, 210 aa, Homo sapiens
  SITE (118)..(118): Xaa at position 118 is Val, Ala, Gly, Leu, or Ile
  SITE (120)..(120): Xaa at position 120 is Val, Ala, Gly, Leu, or Ile
  SITE (179)..(179): Xaa at position 179 is Ala, Gly, or Pro
  SITE (193)..(193): Xaa at position 193 is Ile, Ala, Val, Leu, or Gly
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREXEXLGEVPAAGGSPLRQYFFETRCKADNAEEGGPGAGGGGCRGVDRRHWVSECKAKQSYVRXLTADAQGRVGWRWXRIDTACVCTLLSRTGRA

SEQ ID NO: 464 - protein, 906 aa, Homo sapiens
  SITE (128)..(128): Xaa at position 128 is Ala, Gly, or Pro
  SITE (141)..(141): Xaa at position 141 is Leu, Ala, Val, Gly, or Ile
  SITE (150)..(150): Xaa at position 150 is Leu, Ala, Val, Gly, or Ile
  SITE (157)..(157): Xaa at position 157 is Val, Ala, Gly, Leu, or Ile
  SITE (161)..(161): Xaa at position 161 is Ile, Ala, Val, Leu, or Gly
  SITE (164)..(164): Xaa at position 164 is Leu, Ala, Val, Gly, or Ile
  SITE (173)..(173): Xaa at position 173 is Leu, Ala, Val, Gly, or Ile
  SITE (187)..(187): Xaa at position 187 is Leu, Ala, Val, Gly, or Ile
  SITE (191)..(191): Xaa at position 191 is Ala, Gly, or Pro
  SITE (198)..(198): Xaa at position 198 is Leu, Ala, Val, Gly, or Ile
  SITE (207)..(207): Xaa at position 207 is Met, Ile, Leu, Val, Ala, or Gly
  SITE (208)..(208): Xaa at position 208 is Ala, Gly, or Pro
  SITE (221)..(221): Xaa at position 221 is Leu, Ala, Val, Gly, or Ile
  SITE (229)..(229): Xaa at position 229 is Leu, Ala, Val, Gly, or Ile
  SITE (243)..(243): Xaa at position 243 is Leu, Ala, Val, Gly, or Ile
  SITE (244)..(244): Xaa at position 244 is Ile, Ala, Val, Leu, or Gly
  SITE (248)..(248): Xaa at position 248 is Leu, Ala, Val, Gly, or Ile
  SITE (252)..(252): Xaa at position 252 is Val, Ala, Gly, Leu, or Ile
  SITE (255)..(255): Xaa at position 255 is Ile, Ala, Val, Leu, or Gly
  SITE (258)..(258): Xaa at position 258 is Ala, Gly, or Pro
  SITE (259)..(259): Xaa at position 259 is Ala, Gly, or Pro
  SITE (285)..(285): Xaa at position 285 is Phe, Tyr, Met, His, Ile, Leu, Val Ala, or Gly
  SITE (305)..(305): Xaa at position 305 is Leu, Ala, Val, Gly, or Ile
  SITE (312)..(312): Xaa at position 312 is Ile, Ala, Val, Leu, or Gly
  SITE (316)..(316): Xaa at position 316 is Ala, Gly, or Pro
  SITE (319)..(319): Xaa at position 319 is Met, Ile, Leu, Val, Ala, or Gly
  SITE (333)..(333): Xaa at position 333 is Ile, Ala, Val, Leu, or Gly
  SITE (339)..(339): Xaa at position 339 is Ala, Gly, or Pro
  SITE (340)..(340): Xaa at position 340 is Val, Ala, Gly, Leu, or Ile
  SITE (344)..(344): Xaa at position 344 is Leu, Ala, Val, Gly, or Ile
  SITE (347)..(347): Xaa at position 347 is Leu, Ala, Val, Gly, or Ile
  SITE (348)..(348): Xaa at position 348 is Leu, Ala, Val, Gly, or Ile
  SITE (371)..(371): Xaa at position 371 is Met, Ile, Leu, Val, Ala, or Gly
  SITE (378)..(378): Xaa at position 378 is Leu, Ala, Val, Gly, or Ile
  SITE (382)..(382): Xaa at position 382 is Leu, Ala, Val, Gly, or Ile
  SITE (385)..(385): Xaa at position 385 is Ala, Gly, or Pro
  SITE (386)..(386): Xaa at position 386 is Val, Ala, Gly, Leu, or Ile
  SITE (389)..(389): Xaa at position 389 is His, Phe, Tyr, Lys, Arg, Gly, Ser Thr, Ala, Val, Leu, Ile, Asn, Met, or Gln
  SITE (390)..(390): Xaa at position 390 is Val, Ala, Gly, Leu, or Ile
  SITE (395)..(395): Xaa at position 395 is Leu, Ala, Val, Gly, or Ile
  SITE (401)..(401): Xaa at position 401 is Leu, Ala, Val, Gly, or Ile
  SITE (404)..(404): Xaa at position 404 is Leu, Ala, Val, Gly, or Ile
  SITE (407)..(407): Xaa at position 407 is Ala, Gly, or Pro
  SITE (408)..(408): Xaa at position 408 is Ala, Gly, or Pro
  SITE (416)..(416): Xaa at position 416 is Val, Ala, Gly, Leu, or Ile
  SITE (423)..(423): Xaa at position 423 is Phe, Tyr, Met, His, Ile, Leu, Val Ala, or Gly
  SITE (427)..(427): Xaa at position 427 is Ala, Gly, or Pro
  SITE (430)..(430): Xaa at position 430 is Leu, Ala, Val, Gly, or Ile
  SITE (433)..(433): Xaa at position 433 is Val, Ala, Gly, Leu, or Ile
  SITE (434)..(434): Xaa at position 434 is Ala, Gly, or Pro
  SITE (437)..(437): Xaa at position 437 is Ala, Gly, or Pro
  SITE (438)..(438): Xaa at position 438 is Cys, Ala, Val, Gly, Ser, or Thr
  SITE (450)..(450): Xaa at position 450 is Val, Ala, Gly, Leu, or Ile
  SITE (452)..(452): Xaa at position 452 is Met, Ile, Leu, Val, Ala, or Gly
  SITE (457)..(457): Xaa at position 457 is Leu, Ala, Val, Gly, or Ile
  SITE (459)..(459): Xaa at position 459 is Ala, Gly, or Pro
  SITE (460)..(460): Xaa at position 460 is Leu, Ala, Val, Gly, or Ile
  SITE (464)..(464): Xaa at position 464 is Val, Ala, Gly, Leu, or Ile
  SITE (468)..(468): Xaa at position 468 is Ala, Gly, or Pro
  SITE (471)..(471): Xaa at position 471 is Leu, Ala, Val, Gly, or Ile
  SITE (480)..(480): Xaa at position 480 is Ala, Gly, or Pro
  SITE (491)..(491): Xaa at position 491 is Trp, Tyr, Phe, Met, His, Ile, Leu Val, Ala, or Gly
  SITE (497)..(497): Xaa at position 497 is Val, Ala, Gly, Leu, or Ile
  SITE (498)..(498): Xaa at position 498 is Leu, Ala, Val, Gly, or Ile
  SITE (501)..(501): Xaa at position 501 is Ala, Gly, or Pro
  SITE (502)..(502): Xaa at position 502 is Val, Ala, Gly, Leu, or Ile
  SITE (511)..(511): Xaa at position 511 is Phe, Tyr, Met, His, Ile, Leu, Val Ala, or Gly
  SITE (512)..(512): Xaa at position 512 is Leu, Ala, Val, Gly, or Ile
  SITE (514)..(514): Xaa at position 514 is Val, Ala, Gly, Leu, or Ile
  SITE (519)..(519): Xaa at position 519 is Ile, Ala, Val, Leu, or Gly
  SITE (526)..(526): Xaa at position 526 is Cys, Ala, Val, Gly, Ser, or Thr
  SITE (529)..(529): Xaa at position 529 is Ala, Gly, or Pro
  SITE (530)..(530): Xaa at position 530 is Leu, Ala, Val, Gly, or Ile
  SITE (538)..(538): Xaa at position 538 is Leu, Ala, Val, Gly, or Ile
  SITE (542)..(542): Xaa at position 542 is Ala, Gly, or Pro
  SITE (545)..(545): Xaa at position 545 is Ile, Ala, Val, Leu, or Gly
  SITE (549)..(549): Xaa at position 549 is Ala, Gly, or Pro
  SITE (552)..(552): Xaa at position 552 is Val, Ala, Gly, Leu, or Ile
  SITE (556)..(556): Xaa at position 556 is Val, Ala, Gly, Leu, or Ile
  SITE (572)..(572): Xaa at position 572 is Val, Ala, Gly, Leu, or Ile
  SITE (573)..(573): Xaa at position 573 is Leu, Ala, Val, Gly, or Ile
  SITE (579)..(579): Xaa at position 579 is Leu, Ala, Val, Gly, or Ile
  SITE (583)..(583): Xaa at position 583 is Val, Ala, Gly, Leu, or Ile
  SITE (587)..(587): Xaa at position 587 is Phe, Tyr, Met, His, Ile, Leu, Val Ala, or Gly
  SITE (594)..(594): Xaa at position 594 is Ala, Gly, or Pro
  SITE (611)..(611): Xaa at position 611 is Phe, Tyr, Met, His, Ile, Leu, Val Ala, or Gly
  SITE (614)..(614): Xaa at position 614 is Ala, Gly, or Pro
  SITE (618)..(618): Xaa at position 618 is Val, Ala, Gly, Leu, or Ile
  SITE (622)..(622): Xaa at position 622 is Ile, Ala, Val, Leu, or Gly
  SITE (625)..(625): Xaa at position 625 is Ile, Ala, Val, Leu, or Gly
  SITE (691)..(691): Xaa at position 691 is Phe, Tyr, Met, His, Ile, Leu, Val Ala, or Gly
  SITE (698)..(698): Xaa at position 698 is Leu, Ala, Val, Gly, or Ile
  SITE (712)..(712): Xaa at position 712 is Ile, Ala, Val, Leu, or Gly
  SITE (716)..(716): Xaa at position 716 is Ala, Gly, or Pro
  SITE (719)..(719): Xaa at position 719 is Met, Ile, Leu, Val, Ala, or Gly
  SITE (723)..(723): Xaa at position 723 is Met, Ile, Leu, Val, Ala, or Gly
  SITE (726)..(726): Xaa at position 726 is Met, Ile, Leu, Val, Ala, or Gly
  SITE (742)..(742): Xaa at position 742 is Val, Ala, Gly, Leu, or Ile
  SITE (745)..(745): Xaa at position 745 is Ala, Gly, or Pro
  SITE (746)..(746): Xaa at position 746 is Ala, Gly, or Pro
  SITE (749)..(749): Xaa at position 749 is Ile, Ala, Val, Leu, or Gly
  SITE (752)..(752): Xaa at position 752 is Ala, Gly, or Pro
  SITE (756)..(756): Xaa at position 756 is Met, Ile, Leu, Val, Ala, or Gly
  SITE (759)..(759): Xaa at position 759 is Leu, Ala, Val, Gly, or Ile
  SITE (763)..(763): Xaa at position 763 is Ile, Ala, Val, Leu, or Gly
  SITE (776)..(776): Xaa at position 776 is Leu, Ala, Val, Gly, or Ile
  SITE (780)..(780): Xaa at position 780 is Leu, Ala, Val, Gly, or Ile
  SITE (783)..(783): Xaa at position 783 is Ile, Ala, Val, Leu, or Gly
  SITE (790)..(790): Xaa at position 790 is Leu, Ala, Val, Gly, or Ile
  SITE (793)..(793): Xaa at position 793 is Cys, Ala, Val, Gly, Ser, or Thr
  SITE (815)..(815): Xaa at position 815 is Ala, Gly, or Pro
  SITE (818)..(818): Xaa at position 818 is Leu, Ala, Val, Gly, or Ile
  SITE (819)..(819): Xaa at position 819 is Ile, Ala, Val, Leu, or Gly
  SITE (821)..(821): Xaa at position 821 is Ala, Gly, or Pro
  SITE (822)..(822): Xaa at position 822 is Ala, Gly, or Pro
  SITE (825)..(825): Xaa at position 825 is Leu, Ala, Val, Gly, or Ile
  SITE (826)..(826): Xaa at position 826 is Met, Ile, Leu, Val, Ala, or Gly
  SITE (828)..(828): Xaa at position 828 is Ala, Gly, or Pro
  SITE (829)..(829): Xaa at position 829 is Val, Ala, Gly, Leu, or Ile
  SITE (833)..(833): Xaa at position 833 is Val, Ala, Gly, Leu, or Ile
  SITE (839)..(839): Xaa at position 839 is Ala, Gly, or Pro
  SITE (896)..(896): Xaa at position 896 is Ala, Gly, or Pro
  SITE (902)..(902): Xaa at position 902 is Ala, Gly, or Pro
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAXRALLSAVTRLLIXADMADVYKXLVQLKVXEDGXLKXRNAGNEQDXGIQYKALKPEVDKXNIMXAKRQQEXKDVGHRDQXXAARGILQKNVPIXYTASQACXQHPDVAAYKANRDXXYKQXQQAXTGXSNXXQATASDDASQHQGGGGGELAYALNNXDKQIIVDPLSFSEERFRPSXEERLESXISGXALXADSSCTRDDRRERXVAECNXXRQAXQDXXSEYMGNAGRKERSDALNSAIDKXTKKTRDXRRQXRKXXMDXXSDSFXETNVPXLVXIEXXKNGNEKEXKEYAQVXREHXNKXIEXXNLXXSISNNEEGVKLXRXSASQXEXXCPQXINAXLAXAAKPQSKLXQENMDLFKEQXEKQVRXXTDXXDDITSIDDXXAXSENHXLEDVNKXVIXXQEKDVDGXDRTXGAXRGRXARXIHVXTSEMDNYEPGVYTEKXXEATKLXSNTXMPRXTEQVEAXVEALSSDPAQPMDENEXIDXSRLXYDGXRDXRKAVLMIRTPEELDDSDFETEDFDVRSRTSVQTEDDQLIAGQSARAIMAQLPQEQKAKIAEQVASXQEEKSKXDAEVSKWDDSGNDXIVLXKQXCMIXMEXTDFTRGKGPLKNTSDXISXXKKXAEXGSRXDKXGRTXADHCPDSACKQDXLAYXQRXALYCHQXNIXSKVKAEVQNLGGELVVSGVDSXMSXXQXXKNXXNXXVQTXKASYVXSTKYQKSQGMASLNLPAVSWKMKAPEKKPLVKREKQDETQTKIKRASQKKHVNPVQXLSEFKXMDSI

SEQ ID NO: 465 - protein, 781 aa, Homo sapiens
  SITE (149)..(149): Xaa at position 149 is Ala, Gly, or Pro
  SITE (153)..(153): Xaa at position 153 is Ile, Ala, Val, Leu, or Gly
  SITE (160)..(160): Xaa at position 160 is Leu, Ala, Val, Gly, or Ile
  SITE (168)..(168): Xaa at position 168 is Val, Ala, Gly, Leu, or Ile
  SITE (171)..(171): Xaa at position 171 is Ala, Gly, or Pro
  SITE (172)..(172): Xaa at position 172 is Ala, Gly, or Pro
  SITE (175)..(175): Xaa at position 175 is Val, Ala, Gly, Leu, or Ile
  SITE (188)..(188): Xaa at position 188 is Ile, Ala, Val, Leu, or Gly
  SITE (194)..(194): Xaa at position 194 is Met, Ile, Leu, Val, Ala, or Gly
  SITE (195)..(195): Xaa at position 195 is Val, Ala, Gly, Leu, or Ile
  SITE (197)..(197): Xaa at position 197 is Ala, Gly, or Pro
  SITE (198)..(198): Xaa at position 198 is Ile, Ala, Val, Leu, or Gly
  SITE (199)..(199): Xaa at position 199 is Val, Ala, Gly, Leu, or Ile
  SITE (202)..(202): Xaa at position 202 is Met, Ile, Leu, Val, Ala, or Gly
  SITE (213)..(213): Xaa at position 213 is Cys, Ala, Val, Gly, Ser, or Thr
  SITE (215)..(215): Xaa at position 215 is Ala, Gly, or Pro
  SITE (218)..(218): Xaa at position 218 is Leu, Ala, Val, Gly, or Ile
  SITE (221)..(221): Xaa at position 221 is Leu, Ala, Val, Gly, or Ile
  SITE (228)..(228): Xaa at position 228 is Leu, Ala, Val, Gly, or Ile
  SITE (231)..(231): Xaa at position 231 is Ile, Ala, Val, Leu, or Gly
  SITE (237)..(237): Xaa at position 237 is Ile, Ala, Val, Leu, or Gly
  SITE (239)..(239): Xaa at position 239 is Ala, Gly, or Pro
  SITE (240)..(240): Xaa at position 240 is Leu, Ala, Val, Gly, or Ile
  SITE (241)..(241): Xaa at position 241 is Val, Ala, Gly, Leu, or Ile
  SITE (251)..(251): Xaa at position 251 is Val, Ala, Gly, Leu, or Ile
  SITE (252)..(252): Xaa at position 252 is Leu, Ala, Val, Gly, or Ile
  SITE (255)..(255): Xaa at position 255 is Ala, Gly, or Pro
  SITE (256)..(256): Xaa at position 256 is Ile, Ala, Val, Leu, or Gly
  SITE (259)..(259): Xaa at position 259 is Leu, Ala, Val, Gly, or Ile
  SITE (262)..(262): Xaa at position 262 is Leu, Ala, Val, Gly, or Ile
  SITE (263)..(263): Xaa at position 263 is Leu, Ala, Val, Gly, or Ile
  SITE (269)..(269): Xaa at position 269 is Ala, Gly, or Pro
  SITE (273)..(273): Xaa at position 273 is Val, Ala, Gly, Leu, or Ile
  SITE (279)..(279): Xaa at position 279 is Leu, Ala, Val, Gly, or Ile
  SITE (282)..(282): Xaa at position 282 is Met, Ile, Leu, Val, Ala, or Gly
  SITE (285)..(285): Xaa at position 285 is Leu, Ala, Val, Gly, or Ile
  SITE (293)..(293): Xaa at position 293 is Phe, Tyr, Met, His, Ile, Leu, Val Ala, or Gly
  SITE (294)..(294): Xaa at position 294 is Leu, Ala, Val, Gly, or Ile
  SITE (295)..(295): Xaa at position 295 is Ala, Gly, or Pro
  SITE (300)..(300): Xaa at position 300 is Cys, Ala, Val, Gly, Ser, or Thr
  SITE (301)..(301): Xaa at position 301 is Leu, Ala, Val, Gly, or Ile
  SITE (304)..(304): Xaa at position 304 is Leu, Ala, Val, Gly, or Ile
  SITE (305)..(305): Xaa at position 305 is Ala, Gly, or Pro
  SITE (315)..(315): Xaa at position 315 is Ile, Ala, Val, Leu, or Gly
  SITE (317)..(317): Xaa at position 317 is Ala, Gly, or Pro
  SITE (324)..(324): Xaa at position 324 is Leu, Ala, Val, Gly, or Ile
  SITE (325)..(325): Xaa at position 325 is Val, Ala, Gly, Leu, or Ile
  SITE (327)..(327): Xaa at position 327 is Ile, Ala, Val, Leu, or Gly
  SITE (328)..(328): Xaa at position 328 is Met, Ile, Leu, Val, Ala, or Gly
  SITE (336)..(336): Xaa at position 336 is Leu, Ala, Val, Gly, or Ile
  SITE (337)..(337): Xaa at position 337 is Leu, Ala, Val, Gly, or Ile
  SITE (343)..(343): Xaa at position 343 is Val, Ala, Gly, Leu, or Ile
  SITE (344)..(344): Xaa at position 344 is Leu, Ala, Val, Gly, or Ile
  SITE (347)..(347): Xaa at position 347 is Leu, Ala, Val, Gly, or Ile
  SITE (350)..(350): Xaa at position 350 is Cys, Ala, Val, Gly, Ser, or Thr
  SITE (357)..(357): Xaa at position 357 is Ile, Ala, Val, Leu, or Gly
  SITE (358)..(358): Xaa at position 358 is Val, Ala, Gly, Leu, or Ile
  SITE (360)..(360): Xaa at position 360 is Ala, Gly, or Pro
  SITE (363)..(363): Xaa at position 363 is Met, Ile, Leu, Val, Ala, or Gly
  SITE (365)..(365): Xaa at position 365 is Ala, Gly, or Pro
  SITE (366)..(366): Xaa at position 366 is Leu, Ala, Val, Gly, or Ile
  SITE (368)..(368): Xaa at position 368 is Leu, Ala, Val, Gly, or Ile
  SITE (370)..(370): Xaa at position 370 is Leu, Ala, Val, Gly, or Ile
  SITE (377)..(377): Xaa at position 377 is Leu, Ala, Val, Gly, or Ile
  SITE (378)..(378): Xaa at position 378 is Val, Ala, Gly, Leu, or Ile
  SITE (381)..(381): Xaa at position 381 is Cys, Ala, Val, Gly, Ser, or Thr
  SITE (382)..(382): Xaa at position 382 is Leu, Ala, Val, Gly, or Ile
  SITE (385)..(385): Xaa at position 385 is Leu, Ala, Val, Gly, or Ile
  SITE (388)..(388): Xaa at position 388 is Leu, Ala, Val, Gly, or Ile
  SITE (391)..(391): Xaa at position 391 is Ala, Gly, or Pro
  SITE (392)..(392): Xaa at position 392 is Ala, Gly, or Pro
  SITE (398)..(398): Xaa at position 398 is Met, Ile, Leu, Val, Ala, or Gly
  SITE (401)..(401): Xaa at position 401 is Leu, Ala, Val, Gly, or Ile
  SITE (402)..(402): Xaa at position 402 is Leu, Ala, Val, Gly, or Ile
  SITE (405)..(405): Xaa at position 405 is Leu, Ala, Val, Gly, or Ile
  SITE (406)..(406): Xaa at position 406 is Val, Ala, Gly, Leu, or Ile
  SITE (408)..(408): Xaa at position 408 is Leu, Ala, Val, Gly, or Ile
  SITE (409)..(409): Xaa at position 409 is Leu, Ala, Val, Gly, or Ile
  SITE (417)..(417): Xaa at position 417 is Val, Ala, Gly, Leu, or Ile
  SITE (419)..(419): Xaa at position 419 is Cys, Ala, Val, Gly, Ser, or Thr
  SITE (420)..(420): Xaa at position 420 is Ala, Gly, or Pro
  SITE (421)..(421): Xaa at position 421 is Ala, Gly, or Pro
  SITE (423)..(423): Xaa at position 423 is Ile, Ala, Val, Leu, or Gly
  SITE (424)..(424): Xaa at position 424 is Leu, Ala, Val, Gly, or Ile
  SITE (427)..(427): Xaa at position 427 is Leu, Ala, Val, Gly, or Ile
  SITE (438)..(438): Xaa at position 438 is Val, Ala, Gly, Leu, or Ile
  SITE (444)..(444): Xaa at position 444 is Ile, Ala, Val, Leu, or Gly
  SITE (447)..(447): Xaa at position 447 is Leu, Ala, Val, Gly, or Ile
  SITE (448)..(448): Xaa at position 448 is Val, Ala, Gly, Leu, or Ile
  SITE (451)..(451): Xaa at position 451 is Val, Ala, Gly, Leu, or Ile
  SITE (454)..(454): Xaa at position 454 is Ala, Gly, or Pro
  SITE (460)..(460): Xaa at position 460 is Ile, Ala, Val, Leu, or Gly
  SITE (464)..(464): Xaa at position 464 is Ala, Gly, or Pro
  SITE (465)..(465): Xaa at position 465 is Ile, Ala, Val, Leu, or Gly
  SITE (467)..(467): Xaa at position 467 is Ala, Gly, or Pro
  SITE (468)..(468): Xaa at position 468 is Leu, Ala, Val, Gly, or Ile
  SITE (471)..(471): Xaa at position 471 is Leu, Ala, Val, Gly, or Ile
  SITE (481)..(481): Xaa at position 481 is Ala, Gly, or Pro
  SITE (484)..(484): Xaa at position 484 is Ala, Gly, or Pro
  SITE (485)..(485): Xaa at position 485 is Val, Ala, Gly, Leu, or Ile
  SITE (491)..(491): Xaa at position 491 is Leu, Ala, Val, Gly, or Ile
  SITE (494)..(494): Xaa at position 494 is Val, Ala, Gly, Leu, or Ile
  SITE (495)..(495): Xaa at position 495 is Val, Ala, Gly, Leu, or Ile
  SITE (497)..(497): Xaa at position 497 is Leu, Ala, Val, Gly, or Ile
  SITE (498)..(498): Xaa at position 498 is Leu, Ala, Val, Gly, or Ile
  SITE (506)..(506): Xaa at position 506 is Leu, Ala, Val, Gly, or Ile
  SITE (507)..(507): Xaa at position 507 is Ile, Ala, Val, Leu, or Gly
  SITE (509)..(509): Xaa at position 509 is Ala, Gly, or Pro
  SITE (511)..(511): Xaa at position 511 is Val, Ala, Gly, Leu, or Ile
  SITE (513)..(513): Xaa at position 513 is Leu, Ala, Val, Gly, or Ile
  SITE (514)..(514): Xaa at position 514 is Ile, Ala, Val, Leu, or Gly
  SITE (517)..(517): Xaa at position 517 is Leu, Ala, Val, Gly, or Ile
  SITE (518)..(518): Xaa at position 518 is Ala, Gly, or Pro
  SITE (519)..(519): Xaa at position 519 is Leu, Ala, Val, Gly, or Ile
  SITE (522)..(522): Xaa at position 522 is Ala, Gly, or Pro
  SITE (525)..(525): Xaa at position 525 is Ala, Gly, or Pro
  SITE (527)..(527): Xaa at position 527 is Leu, Ala, Val, Gly, or Ile
  SITE (532)..(532): Xaa at position 532 is Ala, Gly, or Pro
  SITE (533)..(533): Xaa at position 533 is Ile, Ala, Val, Leu, or Gly
  SITE (536)..(536): Xaa at position 536 is Leu, Ala, Val, Gly, or Ile
  SITE (539)..(539): Xaa at position 539 is Leu, Ala, Val, Gly, or Ile
  SITE (540)..(540): Xaa at position 540 is Leu, Ala, Val, Gly, or Ile
  SITE (543)..(543): Xaa at position 543 is Ala, Gly, or Pro
  SITE (564)..(564): Xaa at position 564 is Val, Ala, Gly, Leu, or Ile
  SITE (566)..(566): Xaa at position 566 is Met, Ile, Leu, Val, Ala, or Gly
  SITE (569)..(569): Xaa at position 569 is Ile, Ala, Val, Leu, or Gly
  SITE (570)..(570): Xaa at position 570 is Val, Ala, Gly, Leu, or Ile
  SITE (573)..(573): Xaa at position 573 is Cys, Ala, Val, Gly, Ser, or Thr
  SITE (576)..(576): Xaa at position 576 is Ala, Gly, or Pro
  SITE (577)..(577): Xaa at position 577 is Leu, Ala, Val, Gly, or Ile
  SITE (580)..(580): Xaa at position 580 is Leu, Ala, Val, Gly, or Ile
  SITE (581)..(581): Xaa at position 581 is Ala, Gly, or Pro
  SITE (584)..(584): Xaa at position 584 is Val, Ala, Gly, Leu, or Ile
  SITE (590)..(590): Xaa at position 590 is Ile, Ala, Val, Leu, or Gly
  SITE (596)..(596): Xaa at position 596 is Ile, Ala, Val, Leu, or Gly
  SITE (598)..(598): Xaa at position 598 is Leu, Ala, Val, Gly, or Ile
  SITE (599)..(599): Xaa at position 599 is Phe, Tyr, Met, His, Ile, Leu, Val Ala, or Gly
  SITE (600)..(600): Xaa at position 600 is Val, Ala, Gly, Leu, or Ile
  SITE (602)..(602): Xaa at position 602 is Leu, Ala, Val, Gly, or Ile
  SITE (603)..(603): Xaa at position 603 is Leu, Ala, Val, Gly, or Ile
  SITE (610)..(610): Xaa at position 610 is Ile, Ala, Val, Leu, or Gly
  SITE (613)..(613): Xaa at position 613 is Val, Ala, Gly, Leu, or Ile
  SITE (614)..(614): Xaa at position 614 is Ala, Gly, or Pro
  SITE (615)..(615): Xaa at position 615 is Ala, Gly, or Pro
  SITE (617)..(617): Xaa at position 617 is Val, Ala, Gly, Leu, or Ile
  SITE (618)..(618): Xaa at position 618 is Leu, Ala, Val, Gly, or Ile
  SITE (621)..(621): Xaa at position 621 is Leu, Ala, Val, Gly, or Ile
  SITE (622)..(622): Xaa at position 622 is Ala, Gly, or Pro
  SITE (627)..(627): Xaa at position 627 is Ala, Gly, or Pro
  SITE (628)..(628): Xaa at position 628 is Ala, Gly, or Pro
  SITE (630)..(630): Xaa at position 630 is Ala, Gly, or Pro
  SITE (631)..(631): Xaa at position 631 is Ile, Ala, Val, Leu, or Gly
  SITE (633)..(633): Xaa at position 633 is Ala, Gly, or Pro
  SITE (636)..(636): Xaa at position 636 is Ala, Gly, or Pro
  SITE (640)..(640): Xaa at position 640 is Leu, Ala, Val, Gly, or Ile
  SITE (643)..(643): Xaa at position 643 is Leu, Ala, Val, Gly, or Ile
  SITE (644)..(644): Xaa at position 644 is Leu, Ala, Val, Gly, or Ile
  SITE (651)..(651): Xaa at position 651 is Val, Ala, Gly, Leu, or Ile
  SITE (652)..(652): Xaa at position 652 is Ala, Gly, or Pro
  SITE (655)..(655): Xaa at position 655 is Ala, Gly, or Pro
  SITE (656)..(656): Xaa at position 656 is Ala, Gly, or Pro
  SITE (658)..(658): Xaa at position 658 is Val, Ala, Gly, Leu, or Ile
  SITE (659)..(659): Xaa at position 659 is Leu, Ala, Val, Gly, or Ile
  SITE (781)..(781): Xaa at position 781 is Leu, Ala, Val, Gly, or Ile
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELXTRAXPELTKLXNDEDQVVXNKXXVMXHQLSKKEASRHAXMRSPQXXSXXXRTXQNTNDVETARXTXGTXHNXSHHREGXLAXFKSGGXPXXXKMLGSPVDSXXFYXXTTXHNXXLHQEGXKMAXRLAGGXQKXVAXLNKTNVKXXXITTDXXQIXXYGNQESKLIXLXSGGPQAXXNXXRTYTYEKXXWTTSRXXKVXSVXSSNKPAXXEXGGXQXXGXHXTDPSQRXXQNXXWTXRNXSDXXTKQEGXEGXXGTXXQXXGSDDINVXTXXXGXXSNXTCNNYKNKMMXCQVGGXEAXXRTXLRXGDREDXTEPXXCXXRHXTSRHQEAEMXQNXXRLHYGXPVXXKXXHPPSHWPXXKXTXGXXRNXXXCPXNHXPXREQGXXPRXVQXXVRXHQDTQRRTSMGGTQQQFVEGXRXEEXXEGXTGXXHIXXRDXHNRIVXRGLNTXPXXXQXXYSPIENXQRXXXGXXCEXXQDKEXXEXXEXEGXTAPXTEXXHSRNEGXXTYXXAXXFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDX

SEQ ID NO: 466 - protein, 146 aa, Homo sapiens
  SITE (43)..(43): Xaa at position 43 is Leu, Ala, Val, Gly, or Ile
  SITE (46)..(46): Xaa at position 46 is Leu, Ala, Val, Gly, or Ile
  SITE (47)..(47): Xaa at position 47 is Ile, Ala, Val, Leu, or Gly
  SITE (50)..(50): Xaa at position 50 is Leu, Ala, Val, Gly, or Ile
  SITE (62)..(62): Xaa at position 62 is Cys, Ala, Val, Gly, Ser, or Thr
  SITE (67)..(67): Xaa at position 67 is Val, Ala, Gly, Leu, or Ile
  SITE (76)..(76): Xaa at position 76 is Met, Ile, Leu, Val, Ala, or Gly
  SITE (77)..(77): Xaa at position 77 is Tyr, Phe, Met, His, Ile, Leu, Val Ala, or Gly
  SITE (79)..(79): Xaa at position 79 is Ala, Gly, or Pro
  SITE (80)..(80): Xaa at position 80 is Ala, Gly, or Pro
  SITE (81)..(81): Xaa at position 81 is Leu, Ala, Val, Gly, or Ile
  SITE (84)..(84): Xaa at position 84 is Leu, Ala, Val, Gly, or Ile
  SITE (93)..(93): Xaa at position 93 is Ile, Ala, Val, Leu, or Gly
  SITE (100)..(100): Xaa at position 100 is Leu, Ala, Val, Gly, or Ile
  SITE (104)..(104): Xaa at position 104 is Cys, Ala, Val, Gly, Ser, or Thr
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (129)..(129): Xaa at position 129 is Val, Ala, Gly, Leu, or Ile
  SITE (132)..(132): Xaa at position 132 is Leu, Ala, Val, Gly, or Ile
  SITE (136)..(136): Xaa at position 136 is Leu, Ala, Val, Gly, or Ile
MHPLLNPLLLALGLMALLLTTVIALTCLGGFASPGPVPPSTAXREXXEEXVNITQNQKAPLXNGSMXWSINLTAGXXCXXXESXINVSGCSAXEKTQRMXSGFXPHKVSAGQFSSLHVRDTKIEXAQXXKDXLLHXKKLFREGRFN

SEQ ID NO: 467 - protein, 1172 aa, Homo sapiens
  SITE (600)..(600): Xaa at position 600 is Ile, Ala, Val, Leu, or Gly
  SITE (619)..(619): Xaa at position 619 is Cys, Ala, Val, Gly, Ser, or Thr
  SITE (639)..(639): Xaa at position 639 is Ala, Gly, or Pro
  SITE (707)..(707): Xaa at position 707 is Cys, Ala, Val, Gly, Ser, or Thr
  SITE (715)..(715): Xaa at position 715 is Cys, Ala, Val, Gly, Ser, or Thr
  SITE (720)..(720): Xaa at position 720 is Cys, Ala, Val, Gly, Ser, or Thr
  SITE (756)..(756): Xaa at position 756 is Cys, Ala, Val, Gly, Ser, or Thr
  SITE (779)..(779): Xaa at position 779 is Cys, Ala, Val, Gly, Ser, or Thr
  SITE (815)..(815): Xaa at position 815 is Cys, Ala, Val, Gly, Ser, or Thr
  SITE (838)..(838): Xaa at position 838 is Cys, Ala, Val, Gly, Ser, or Thr
  SITE (876)..(876): Xaa at position 876 is Cys, Ala, Val, Gly, Ser, or Thr
  SITE (882)..(882): Xaa at position 882 is Ala, Gly, or Pro
  SITE (912)..(912): Xaa at position 912 is Cys, Ala, Val, Gly, Ser, or Thr
  SITE (932)..(932): Xaa at position 932 is Cys, Ala, Val, Gly, Ser, or Thr
  SITE (948)..(948): Xaa at position 948 is Cys, Ala, Val, Gly, Ser, or Thr
  SITE (959)..(959): Xaa at position 959 is Phe, Tyr, Met, His, Ile, Leu, Val Ala, or Gly
  SITE (965)..(965): Xaa at position 965 is Val, Ala, Gly, Leu, or Ile
  SITE (967)..(967): Xaa at position 967 is Leu, Ala, Val, Gly, or Ile
  SITE (988)..(988): Xaa at position 988 is Leu, Ala, Val, Gly, or Ile
  SITE (998)..(998): Xaa at position 998 is Ile, Ala, Val, Leu, or Gly
  SITE (999)..(999): Xaa at position 999 is Ala, Gly, or Pro
  SITE (1000)..(1000): Xaa at position 1000 is Val, Ala, Gly, Leu, or Ile
  SITE (1005)..(1005): Xaa at position 1005 is Phe, Tyr, Met, His, Ile, Leu Val, Ala, or Gly
  SITE (1010)..(1010): Xaa at position 1010 is Phe, Tyr, Met, His, Ile, Leu Val, Ala, or Gly
  SITE (1016)..(1016): Xaa at position 1016 is Val, Ala, Gly, Leu, or Ile
  SITE (1024)..(1024): Xaa at position 1024 is Tyr, Phe, Met, His, Ile, Leu Val, Ala, or Gly
  SITE (1025)..(1025): Xaa at position 1025 is Ala, Gly, or Pro
  SITE (1027)..(1027): Xaa at position 1027 is Phe, Tyr, Met, His, Ile, Leu Val, Ala, or Gly
  SITE (1028)..(1028): Xaa at position 1028 is Val, Ala, Gly, Leu, or Ile
  SITE (1029)..(1029): Xaa at position 1029 is Phe, Tyr, Met, His, Ile, Leu Val, Ala, or Gly
  SITE (1031)..(1031): Xaa at position 1031 is Tyr, Phe, Met, His, Ile, Leu Val, Ala, or Gly
  SITE (1037)..(1037): Xaa at position 1037 is Phe, Tyr, Met, His, Ile, Leu Val, Ala, or Gly
  SITE (1038)..(1038): Xaa at position 1038 is Tyr, Phe, Met, His, Ile, Leu Val, Ala, or Gly
  SITE (1039)..(1039): Xaa at position 1039 is Val, Ala, Gly, Leu, or Ile
  SITE (1041)..(1041): Xaa at position 1041 is Met, Ile, Leu, Val, Ala, or Gly
  SITE (1057)..(1057): Xaa at position 1057 is Ala, Gly, or Pro
  SITE (1065)..(1065): Xaa at position 1065 is Leu, Ala, Val, Gly, or Ile
  SITE (1067)..(1067): Xaa at position 1067 is Val, Ala, Gly, Leu, or Ile
  SITE (1068)..(1068): Xaa at position 1068 is Val, Ala, Gly, Leu, or Ile
  SITE (1078)..(1078): Xaa at position 1078 is Leu, Ala, Val, Gly, or Ile
  SITE (1081)..(1081): Xaa at position 1081 is Ala, Gly, or Pro
  SITE (1082)..(1082): Xaa at position 1082 is Leu, Ala, Val, Gly, or Ile
  SITE (1083)..(1083): Xaa at position 1083 is Trp, Tyr, Phe, Met, His, Ile Leu, Val, Ala, or Gly
  SITE (1092)..(1092): Xaa at position 1092 is Val, Ala, Gly, Leu, or Ile
  SITE (1114)..(1114): Xaa at position 1114 is Leu, Ala, Val, Gly, or Ile
  SITE (1116)..(1116): Xaa at position 1116 is His, Phe, Tyr, Lys, Arg, Gly Ser, Thr, Ala, Val, Leu, Ile, Asn, Met, or Gln
  SITE (1123)..(1123): Xaa at position 1123 is Ile, Ala, Val, Leu, or Gly
  SITE (1125)..(1125): Xaa at position 1125 is Val, Ala, Gly, Leu, or Ile
  SITE (1145)..(1145): Xaa at position 1145 is Tyr, Phe, Met, His, Ile, Leu Val, Ala, or Gly
  SITE (1150)..(1150): Xaa at position 1150 is Leu, Ala, Val, Gly, or Ile
  SITE (1152)..(1152): Xaa at position 1152 is Leu, Ala, Val, Gly, or Ile
  SITE (1153)..(1153): Xaa at position 1153 is Phe, Tyr, Met, His, Ile, Leu Val, Ala, or Gly
  SITE (1154)..(1154): Xaa at position 1154 is Val, Ala, Gly, Leu, or Ile
  SITE (1155)..(1155): Xaa at position 1155 is Phe, Tyr, Met, His, Ile, Leu Val, Ala, or Gly
  SITE (1160)..(1160): Xaa at position 1160 is Val, Ala, Gly, Leu, or Ile
  SITE (1162)..(1162): Xaa at position 1162 is Phe, Tyr, Met, His, Ile, Leu Val, Ala, or Gly
  SITE (1165)..(1165): Xaa at position 1165 is Leu, Ala, Val, Gly, or Ile
  SITE (1167)..(1167): Xaa at position 1167 is Tyr, Phe, Met, His, Ile, Leu Val, Ala, or Gly
  SITE (1169)..(1169): Xaa at position 1169 is Cys, Ala, Val, Gly, Ser, or Thr
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDXCFSTSKVPRCVNTQPGFHXLPCPPRYRGNQPVGVGLEAXKTEKQVCEPENPCKDKTHNCHKHAECIYLGHFSDPMYKCECQTGYAGDGLICGEDSDLDGWPNLNLVXATNATYHXIKDNXPHLPNSGQEDFDKDGIGDACDDDDDNDGVTDEKDNXQLLFNPRQADYDKDEVGDRCDNXPYVHNPAQIDTDNNGEGDACSVDIDGDDVFNERDNXPYVYNTDQRDTDGDGVGDHCDNXPLVHNPDQTDVDNDLVGDQCDNNEDIDDDGHQNNQDNXPYISNXNQADHDRDGQGDACDPDDDNDGVPDDRDNXRLVFNPDQEDLDGDGRGDIXKDDFDNDNIPDIDDVXPENNAISETDXRNFQMXPXDPKGTTQIDPNWVIRHQGKEXVQTANSDPGXXXGFDEXGSVDXSGTFYXNTDRDDDXXGXXXGXQSSSRXXXVXWKQVTQTYWEDQPTRXYGYSGVSXKXXNSTTGTGEHXRNXXXHTGNTPGQXRTLWHDPRNIGWKDYTAYRWHXTXRPKTGYXRXLVHEGKQVMADSGPIYDQTXAGGRXGXXXXSQEMXYXSDXKXEXRDI

SEQ ID NO: 468 - protein, 400 aa, Homo sapiens
  SITE (103)..(103): Xaa at position 103 is Cys, Ala, Val, Gly, Ser, or Thr
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICXDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 469 - protein, 653 aa, Homo sapiens
  SITE (32)..(32): Xaa at position 32 is Val, Ala, Gly, Leu, or Ile
  SITE (34)..(34): Xaa at position 34 is Val, Ala, Gly, Leu, or Ile
  SITE (47)..(47): Xaa at position 47 is Trp, Tyr, Phe, Met, His, Ile, Leu Val, Ala, or Gly
  SITE (52)..(52): Xaa at position 52 is Phe, Tyr, Met, His, Ile, Leu, Val Ala, or Gly
  SITE (61)..(61): Xaa at position 61 is Ala, Gly, or Pro
  SITE (65)..(65): Xaa at position 65 is Val, Ala, Gly, Leu, or Ile
  SITE (72)..(72): Xaa at position 72 is Leu, Ala, Val, Gly, or Ile
  SITE (74)..(74): Xaa at position 74 is Leu, Ala, Val, Gly, or Ile
  SITE (75)..(75): Xaa at position 75 is Ala, Gly, or Pro
  SITE (76)..(76): Xaa at position 76 is Tyr, Phe, Met, His, Ile, Leu, Val Ala, or Gly
  SITE (77)..(77): Xaa at position 77 is Val, Ala, Gly, Leu, or Ile
  SITE (79)..(79): Xaa at position 79 is Ala, Gly, or Pro
  SITE (88)..(88): Xaa at position 88 is Val, Ala, Gly, Leu, or Ile
  SITE (92)..(92): Xaa at position 92 is Trp, Tyr, Phe, Met, His, Ile, Leu Val, Ala, or Gly
  SITE (93)..(93): Xaa at position 93 is Leu, Ala, Val, Gly, or Ile
  SITE (94)..(94): Xaa at position 94 is Leu, Ala, Val, Gly, or Ile
  SITE (96)..(96): Xaa at position 96 is Leu, Ala, Val, Gly, or Ile
  SITE (97)..(97): Xaa at position 97 is Val, Ala, Gly, Leu, or Ile
  SITE (114)..(114): Xaa at position 114 is Leu, Ala, Val, Gly, or Ile
  SITE (117)..(117): Xaa at position 117 is Tyr, Phe, Met, His, Ile, Leu, Val Ala, or Gly
  SITE (120)..(120): Xaa at position 120 is Leu, Ala, Val, Gly, or Ile
  SITE (121)..(121): Xaa at position 121 is Leu, Ala, Val, Gly, or Ile
  SITE (130)..(130): Xaa at position 130 is Phe, Tyr, Met, His, Ile, Leu, Val Ala, or Gly
  SITE (132)..(132): Xaa at position 132 is Leu, Ala, Val, Gly, or Ile
  SITE (133)..(133): Xaa at position 133 is Met, Ile, Leu, Val, Ala, or Gly
  SITE (136)..(136): Xaa at position 136 is Ala, Gly, or Pro
  SITE (140)..(140): Xaa at position 140 is Phe, Tyr, Met, His, Ile, Leu, Val Ala, or Gly
  SITE (143)..(143): Xaa at position 143 is Phe, Tyr, Met, His, Ile, Leu, Val Ala, or Gly
  SITE (149)..(149): Xaa at position 149 is Val, Ala, Gly, Leu, or Ile
  SITE (152)..(152): Xaa at position 152 is Trp, Tyr, Phe, Met, His, Ile, Leu Val, Ala, or Gly
  SITE (155)..(155): Xaa at position 155 is Leu, Ala, Val, Gly, or Ile
  SITE (156)..(156): Xaa at position 156 is Val, Ala, Gly, Leu, or Ile
  SITE (159)..(159): Xaa at position 159 is Leu, Ala, Val, Gly, or Ile
  SITE (160)..(160): Xaa at position 160 is Ala, Gly, or Pro
  SITE (163)..(163): Xaa at position 163 is Tyr, Phe, Met, His, Ile, Leu, Val Ala, or Gly
  SITE (172)..(172): Xaa at position 172 is Val, Ala, Gly, Leu, or Ile
  SITE (175)..(175): Xaa at position 175 is Trp, Tyr, Phe, Met, His, Ile, Leu Val, Ala, or Gly
  SITE (177)..(177): Xaa at position 177 is Phe, Tyr, Met, His, Ile, Leu, Val Ala, or Gly
  SITE (180)..(180): Xaa at position 180 is Trp, Tyr, Phe, Met, His, Ile, Leu Val, Ala, or Gly
  SITE (198)..(198): Xaa at position 198 is Phe, Tyr, Met, His, Ile, Leu, Val Ala, or Gly
  SITE (201)..(201): Xaa at position 201 is Tyr, Phe, Met, His, Ile, Leu, Val Ala, or Gly
  SITE (202)..(202): Xaa at position 202 is Tyr, Phe, Met, His, Ile, Leu, Val Ala, or Gly
  SITE (204)..(204): Xaa at position 204 is Ala, Gly, or Pro
  SITE (205)..(205): Xaa at position 205 is Cys, Ala, Val, Gly, Ser, or Thr
  SITE (209)..(209): Xaa at position 209 is Leu, Ala, Val, Gly, or Ile
  SITE (216)..(216): Xaa at position 216 is Leu, Ala, Val, Gly, or Ile
  SITE (218)..(218): Xaa at position 218 is Leu, Ala, Val, Gly, or Ile
  SITE (225)..(225): Xaa at position 225 is Phe, Tyr, Met, His, Ile, Leu, Val Ala, or Gly
  SITE (237)..(237): Xaa at position 237 is Leu, Ala, Val, Gly, or Ile
  SITE (238)..(238): Xaa at position 238 is Leu, Ala, Val, Gly, or Ile
  SITE (258)..(258): Xaa at position 258 is Tyr, Phe, Met, His, Ile, Leu, Val Ala, or Gly
  SITE (259)..(259): Xaa at position 259 is Ile, Ala, Val, Leu, or Gly
  SITE (261)..(261): Xaa at position 261 is Leu, Ala, Val, Gly, or Ile
  SITE (272)..(272): Xaa at position 272 is Ile, Ala, Val, Leu, or Gly
  SITE (279)..(279): Xaa at position 279 is Val, Ala, Gly, Leu, or Ile
  SITE (283)..(283): Xaa at position 283 is Ile, Ala, Val, Leu, or Gly
  SITE (300)..(300): Xaa at position 300 is Ala, Gly, or Pro
  SITE (314)..(314): Xaa at position 314 is Ala, Gly, or Pro
  SITE (316)..(316): Xaa at position 316 is Val, Ala, Gly, Leu, or Ile
  SITE (318)..(318): Xaa at position 318 is Tyr, Phe, Met, His, Ile, Leu, Val Ala, or Gly
  SITE (319)..(319): Xaa at position 319 is Ala, Gly, or Pro
  SITE (320)..(320): Xaa at position 320 is Ala, Gly, or Pro
  SITE (321)..(321): Xaa at position 321 is Met, Ile, Leu, Val, Ala, or Gly
  SITE (322)..(322): Xaa at position 322 is Val, Ala, Gly, Leu, or Ile
  SITE (323)..(323): Xaa at position 323 is Val, Ala, Gly, Leu, or Ile
  SITE (325)..(325): Xaa at position 325 is Val, Ala, Gly, Leu, or Ile
  SITE (326)..(326): Xaa at position 326 is Ile, Ala, Val, Leu, or Gly
  SITE (327)..(327): Xaa at position 327 is Ala, Gly, or Pro
  SITE (329)..(329): Xaa at position 329 is His, Phe, Tyr, Lys, Arg, Gly, Ser Thr, Ala, Val, Leu, Ile, Asn, Met, or Gln
  SITE (333)..(333): Xaa at position 333 is Leu, Ala, Val, Gly, or Ile
  SITE (340)..(340): Xaa at position 340 is Ala, Gly, or Pro
  SITE (346)..(346): Xaa at position 346 is Leu, Ala, Val, Gly, or Ile
  SITE (351)..(351): Xaa at position 351 is Ala, Gly, or Pro
  SITE (353)..(353): Xaa at position 353 is Leu, Ala, Val, Gly, or Ile
  SITE (360)..(360): Xaa at position 360 is Phe, Tyr, Met, His, Ile, Leu, Val Ala, or Gly
  SITE (365)..(365): Xaa at position 365 is Leu, Ala, Val, Gly, or Ile
  SITE (367)..(367): Xaa at position 367 is Ala, Gly, or Pro
  SITE (371)..(371): Xaa at position 371 is Val, Ala, Gly, Leu, or Ile
  SITE (381)..(381): Xaa at position 381 is Leu, Ala, Val, Gly, or Ile
  SITE (382)..(382): Xaa at position 382 is Leu, Ala, Val, Gly, or Ile
  SITE (386)..(386): Xaa at position 386 is Val, Ala, Gly, Leu, or Ile
  SITE (387)..(387): Xaa at position 387 is Leu, Ala, Val, Gly, or Ile
  SITE (389)..(389): Xaa at position 389 is Ala, Gly, or Pro
  SITE (393)..(393): Xaa at position 393 is Leu, Ala, Val, Gly, or Ile
  SITE (394)..(394): Xaa at position 394 is Ala, Gly, or Pro
  SITE (396)..(396): Xaa at position 396 is Leu, Ala, Val, Gly, or Ile
  SITE (401)..(401): Xaa at position 401 is Leu, Ala, Val, Gly, or Ile
  SITE (418)..(418): Xaa at position 418 is Val, Ala, Gly, Leu, or Ile
  SITE (421)..(421): Xaa at position 421 is Leu, Ala, Val, Gly, or Ile
  SITE (422)..(422): Xaa at position 422 is Ala, Gly, or Pro
  SITE (436)..(436): Xaa at position 436 is Ala, Gly, or Pro
  SITE (437)..(437): Xaa at position 437 is Ala, Gly, or Pro
  SITE (438)..(438): Xaa at position 438 is Val, Ala, Gly, Leu, or Ile
  SITE (439)..(439): Xaa at position 439 is Leu, Ala, Val, Gly, or Ile
  SITE (440)..(440): Xaa at position 440 is Ile, Ala, Val, Leu, or Gly
  SITE (441)..(441): Xaa at position 441 is Tyr, Phe, Met, His, Ile, Leu, Val Ala, or Gly
  SITE (442)..(442): Xaa at position 442 is Ala, Gly, or Pro
  SITE (448)..(448): Xaa at position 448 is Ala, Gly, or Pro
  SITE (456)..(456): Xaa at position 456 is Val, Ala, Gly, Leu, or Ile
  SITE (460)..(460): Xaa at position 460 is Leu, Ala, Val, Gly, or Ile
  SITE (472)..(472): Xaa at position 472 is Val, Ala, Gly, Leu, or Ile
  SITE (476)..(476): Xaa at position 476 is Leu, Ala, Val, Gly, or Ile
  SITE (481)..(481): Xaa at position 481 is Cys, Ala, Val, Gly, Ser, or Thr
  SITE (501)..(501): Xaa at position 501 is Phe, Tyr, Met, His, Ile, Leu, Val Ala, or Gly
  SITE (504)..(504): Xaa at position 504 is Met, Ile, Leu, Val, Ala, or Gly
  SITE (507)..(507): Xaa at position 507 is Ala, Gly, or Pro
  SITE (530)..(530): Xaa at position 530 is Leu, Ala, Val, Gly, or Ile
  SITE (535)..(535): Xaa at position 535 is Leu, Ala, Val, Gly, or Ile
  SITE (537)..(537): Xaa at position 537 is Leu, Ala, Val, Gly, or Ile
  SITE (538)..(538): Xaa at position 538 is Val, Ala, Gly, Leu, or Ile
  SITE (539)..(539): Xaa at position 539 is His, Phe, Tyr, Lys, Arg, Gly, Ser Thr, Ala, Val, Leu, Ile, Asn, Met, or Gln
  SITE (540)..(540): Xaa at position 540 is Val, Ala, Gly, Leu, or Ile
  SITE (541)..(541): Xaa at position 541 is Cys, Ala, Val, Gly, Ser, or Thr
  SITE (551)..(551): Xaa at position 551 is Val, Ala, Gly, Leu, or Ile
  SITE (564)..(564): Xaa at position 564 is Leu, Ala, Val, Gly, or Ile
  SITE (565)..(565): Xaa at position 565 is Val, Ala, Gly, Leu, or Ile
  SITE (566)..(566): Xaa at position 566 is Leu, Ala, Val, Gly, or Ile
  SITE (573)..(573): Xaa at position 573 is Val, Ala, Gly, Leu, or Ile
  SITE (577)..(577): Xaa at position 577 is Cys, Ala, Val, Gly, Ser, or Thr
  SITE (578)..(578): Xaa at position 578 is Leu, Ala, Val, Gly, or Ile
  SITE (581)..(581): Xaa at position 581 is Tyr, Phe, Met, His, Ile, Leu, Val Ala, or Gly
  SITE (583)..(583): Xaa at position 583 is Ile, Ala, Val, Leu, or Gly
  SITE (604)..(604): Xaa at position 604 is Leu, Ala, Val, Gly, or Ile
  SITE (614)..(614): Xaa at position 614 is Val, Ala, Gly, Leu, or Ile
  SITE (618)..(618): Xaa at position 618 is Tyr, Phe, Met, His, Ile, Leu, Val Ala, or Gly
  SITE (620)..(620): Xaa at position 620 is Val, Ala, Gly, Leu, or Ile
  SITE (622)..(622): Xaa at position 622 is Ala, Gly, or Pro
MRPLRPRAALLALLASLLAAPPVAPAEAPHLXHXDAARALWPLRRFXRSTGXCPPLPHSQXDQYXLSWDQQXNXXXXGXVPHRGIKQXRTHXXXEXXTTRGSTGRGLSYNFTHXDGXLDXXRENQLLPGXEXXGSXSGHXTDXEDKQQXFEXKDXXSSXXRRXIGRYGLAHXSKXNXETXNEPDHHDFDNVSMTMQGXLNXXDXXSEGXRAASPAXRXGGPGDSXHTPPRSPLSWGXXRHCHDGTNFFTGEAGVRLDXXSXHRKGARSSISXLEQEKVXAQQXRQLFPKFADTPIYNDEXDPLVGWSLPQPWRXDXTXXXXXXKXXXQXQNLXLANTTSXFPYALXSNDNXFXSYHPHPXAQRTXTXRFQXNNTRPPHVQXXRKPXXTXMGLXXLXDEEQXWAEVSQAGTVLDSNHTXGVXXSAHRPQGPADAWRXXXXXXXSDDTRXHPNRSVAXTLRXRGVPPGPGLVYXTRYXDNGLXSPDGEWRRLGRPVFPTAEQXRRXRAXEDPVAAAPRPLPAGGRLTLRPAXRLPSXLXXXXXARPEKPPGQXTRLRALPLTQGQXXXVWSDEHXGSKXXWTXEXQFSQDGKAYTPVSRKPSTFNXFVFSPDTGAXSGSXRXRXLDYWARPGPFSDPVPYLEVPVPRGPPSPGNP

SEQ ID NO: 470 - protein, 2871 aa, Homo sapiens
  SITE (67)..(67): Xaa at position 67 is Cys, Ala, Val, Gly, Ser, or Thr
  SITE (80)..(80): Xaa at position 80 is Cys, Ala, Val, Gly, Ser, or Thr
  SITE (100)..(100): Xaa at position 100 is Cys, Ala, Val, Gly, Ser, or Thr
  SITE (134)..(134): Xaa at position 134 is Cys, Ala, Val, Gly, Ser, or Thr
  SITE (145)..(145): Xaa at position 145 is Cys, Ala, Val, Gly, Ser, or Thr
  SITE (853)..(853): Xaa at position 853 is Cys, Ala, Val, Gly, Ser, or Thr
  SITE (875)..(875): Xaa at position 875 is Cys, Ala, Val, Gly, Ser, or Thr
  SITE (882)..(882): Xaa at position 882 is Ala, Gly, or Pro
  SITE (911)..(911): Xaa at position 911 is Ile, Ala, Val, Leu, or Gly
  SITE (1526)..(1526): Xaa at position 1526 is Cys, Ala, Val, Gly, Ser, or Thr
  SITE (1534)..(1534): Xaa at position 1534 is Cys, Ala, Val, Gly, Ser, or Thr
  SITE (1562)..(1562): Xaa at position 1562 is Cys, Ala, Val, Gly, Ser, or Thr
  SITE (1564)..(1564): Xaa at position 1564 is Cys, Ala, Val, Gly, Ser, or Thr
  SITE (1569)..(1569): Xaa at position 1569 is Ala, Gly, or Pro
  SITE (1607)..(1607): Xaa at position 1607 is Ile, Ala, Val, Leu, or Gly
  SITE (1613)..(1613): Xaa at position 1613 is Leu, Ala, Val, Gly, or Ile
  SITE (1616)..(1616): Xaa at position 1616 is Leu, Ala, Val, Gly, or Ile
  SITE (2061)..(2061): Xaa at position 2061 is Cys, Ala, Val, Gly, Ser, or Thr
  SITE (2083)..(2083): Xaa at position 2083 is Cys, Ala, Val, Gly, Ser, or Thr
  SITE (2084)..(2084): Xaa at position 2084 is Cys, Ala, Val, Gly, Ser, or Thr
  SITE (2085)..(2085): Xaa at position 2085 is Cys, Ala, Val, Gly, Ser, or Thr
  SITE (2110)..(2110): Xaa at position 2110 is Ile, Ala, Val, Leu, or Gly
  SITE (2111)..(2111): Xaa at position 2111 is Cys, Ala, Val, Gly, Ser, or Thr
  SITE (2137)..(2137): Xaa at position 2137 is Cys, Ala, Val, Gly, Ser, or Thr
  SITE (2164)..(2164): Xaa at position 2164 is Cys, Ala, Val, Gly, Ser, or Thr
  SITE (2190)..(2190): Xaa at position 2190 is Cys, Ala, Val, Gly, Ser, or Thr
  SITE (2363)..(2363): Xaa at position 2363 is Cys, Ala, Val, Gly, Ser, or Thr
  SITE (2364)..(2364): Xaa at position 2364 is Cys, Ala, Val, Gly, Ser, or Thr
  SITE (2365)..(2365): Xaa at position 2365 is Cys, Ala, Val, Gly, Ser, or Thr
  SITE (2371)..(2371): Xaa at position 2371 is Trp, Tyr, Phe, Met, His, Ile Leu, Val, Ala, or Gly
  SITE (2378)..(2378): Xaa at position 2378 is Cys, Ala, Val, Gly, Ser, or Thr
MRRGRLLEIALGFTVLLASYTSHGADANLEAGNVKETRASRAKRRGGGGHDALKGPNVCGSRYNAYXCPGWKTLPGGNQXIVPICRHSCGDGFCSRPNMXTCPSGQIAPSCGSRSIQHCNIRCMNGGSCSDDHXLCQKGYIGTHXGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSCRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTXWQTVIDGRCEININGATLKSQXCSSLGAXWGSPCTLCQVDPICGKGYSRIKGTQCEDXDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGXVDTRSGNXYLDIRPRGDNGDTACSNEIGVGVSKASXCXSLGKXWGTPCEMCPAVNTSEYKILCPGGEGFRPNPITVILEDXDECQEXPGXCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYXYAKFEGGKCSSPKSRNHSKQEXXXALKGEGWGDPCELCPTEPDEAFRQXXPYGSGIIVGPDDSAVDMDECKEPDVXKHGQCINTDGSYRCECPFGYILAGNEXVDTDECSVGNPCGNGTCKNVIGGFEXTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSEXXXDGGRGXGPHCEIXPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 471 - protein, 1960 aa, Homo sapiens
  SITE (34)..(34): Xaa at position 34 is Val, Ala, Gly, Leu, or Ile
  SITE (44)..(44): Xaa at position 44 is Ala, Gly, or Pro
  SITE (54)..(54): Xaa at position 54 is Ala, Gly, or Pro
  SITE (56)..(56): Xaa at position 56 is Val, Ala, Gly, Leu, or Ile
  SITE (58)..(58): Xaa at position 58 is Leu, Ala, Val, Gly, or Ile
  SITE (86)..(86): Xaa at position 86 is Met, Ile, Leu, Val, Ala, or Gly
  SITE (89)..(89): Xaa at position 89 is Leu, Ala, Val, Gly, or Ile
  SITE (95)..(95): Xaa at position 95 is Ala, Gly, or Pro
  SITE (97)..(97): Xaa at position 97 is Val, Ala, Gly, Leu, or Ile
  SITE (98)..(98): Xaa at position 98 is Leu, Ala, Val, Gly, or Ile
  SITE (101)..(101): Xaa at position 101 is Leu, Ala, Val, Gly, or Ile
  SITE (105)..(105): Xaa at position 105 is Tyr, Phe, Met, His, Ile, Leu, Val Ala, or Gly
  SITE (109)..(109): Xaa at position 109 is Leu, Ala, Val, Gly, or Ile
  SITE (110)..(110): Xaa at position 110 is Ile, Ala, Val, Leu, or Gly
  SITE (111)..(111): Xaa at position 111 is Tyr, Phe, Met, His, Ile, Leu, Val Ala, or Gly
  SITE (113)..(113): Xaa at position 113 is Tyr, Phe, Met, His, Ile, Leu, Val Ala, or Gly
  SITE (117)..(117): Xaa at position 117 is Phe, Tyr, Met, His, Ile, Leu, Val Ala, or Gly
  SITE (118)..(118): Xaa at position 118 is Cys, Ala, Val, Gly, Ser, or Thr
  SITE (119)..(119): Xaa at position 119 is Val, Ala, Gly, Leu, or Ile
  SITE (120)..(120): Xaa at position 120 is Val, Ala, Gly, Leu, or Ile
  SITE (121)..(121): Xaa at position 121 is Ile, Ala, Val, Leu, or Gly
  SITE (129)..(129): Xaa at position 129 is Ile, Ala, Val, Leu, or Gly
  SITE (134)..(134): Xaa at position 134 is Ile, Ala, Val, Leu, or Gly
  SITE (135)..(135): Xaa at position 135 is Val, Ala, Gly, Leu, or Ile
  SITE (138)..(138): Xaa at position 138 is Tyr, Phe, Met, His, Ile, Leu, Val Ala, or Gly
  SITE (146)..(146): Xaa at position 146 is Met, Ile, Leu, Val, Ala, or Gly
  SITE (149)..(149): Xaa at position 149 is His, Phe, Tyr, Lys, Arg, Gly, Ser Thr, Ala, Val, Leu, Ile, Asn, Met, or Gln
  SITE (150)..(150): Xaa at position 150 is Ile, Ala, Val, Leu, or Gly
  SITE (151)..(151): Xaa at position 151 is Tyr, Phe, Met, His, Ile, Leu, Val Ala, or Gly
  SITE (153)..(153): Xaa at position 153 is Ile, Ala, Val, Leu, or Gly
  SITE (157)..(157): Xaa at position 157 is Ala, Gly, or Pro
  SITE (161)..(161): Xaa at position 161 is Met, Ile, Leu, Val, Ala, or Gly
  SITE (170)..(170): Xaa at position 170 is Ile, Ala, Val, Leu, or Gly
  SITE (171)..(171): Xaa at position 171 is Leu, Ala, Val, Gly, or Ile
  SITE (172)..(172): Xaa at position 172 is Cys, Ala, Val, Gly, Ser, or Thr
  SITE (178)..(178): Xaa at position 178 is Ala, Gly, or Pro
  SITE (187)..(187): Xaa at position 187 is Val, Ala, Gly, Leu, or Ile
  SITE (188)..(188): Xaa at position 188 is Ile, Ala, Val, Leu, or Gly
  SITE (190)..(190): Xaa at position 190 is Tyr, Phe, Met, His, Ile, Leu, Val Ala, or Gly
  SITE (191)..(191): Xaa at position 191 is Leu, Ala, Val, Gly, or Ile
  SITE (192)..(192): Xaa at position 192 is Ala, Gly, or Pro
  SITE (194)..(194): Xaa at position 194 is Val, Ala, Gly, Leu, or Ile
  SITE (195)..(195): Xaa at position 195 is Ala, Gly, or Pro
  SITE (214)..(214): Xaa at position 214 is Ala, Gly, or Pro
  SITE (217)..(217): Xaa at position 217 is Ile, Ala, Val, Leu, or Gly
  SITE (218)..(218): Xaa at position 218 is Leu, Ala, Val, Gly, or Ile
  SITE (220)..(220): Xaa at position 220 is Ala, Gly, or Pro
  SITE (221)..(221): Xaa at position 221 is Phe, Tyr, Met, His, Ile, Leu, Val Ala, or Gly
  SITE (224)..(224): Xaa at position 224 is Ala, Gly, or Pro
  SITE (235)..(235): Xaa at position 235 is Phe, Tyr, Met, His, Ile, Leu, Val Ala, or Gly
  SITE (238)..(238): Xaa at position 238 is Phe, Tyr, Met, His, Ile, Leu, Val Ala, or Gly
  SITE (239)..(239): Xaa at position 239 is Ile, Ala, Val, Leu, or Gly
  SITE (241)..(241): Xaa at position 241 is Ile, Ala, Val, Leu, or Gly
  SITE (243)..(243): Xaa at position 243 is Phe, Tyr, Met, His, Ile, Leu, Val Ala, or Gly
  SITE (250)..(250): Xaa at position 250 is Val, Ala, Gly, Leu, or Ile
  SITE (252)..(252): Xaa at position 252 is Ala, Gly, or Pro
  SITE (257)..(257): Xaa at position 257 is Tyr, Phe, Met, His, Ile, Leu, Val Ala, or Gly
  SITE (258)..(258): Xaa at position 258 is Leu, Ala, Val, Gly, or Ile
  SITE (264)..(264): Xaa at position 264 is Ala, Gly, or Pro
  SITE (274)..(274): Xaa at position 274 is Phe, Tyr, Met, His, Ile, Leu, Val Ala, or Gly
  SITE (276)..(276): Xaa at position 276 is Ile, Ala, Val, Leu, or Gly
  SITE (277)..(277): Xaa at position 277 is Phe, Tyr, Met, His, Ile, Leu, Val Ala, or Gly
  SITE (278)..(278): Xaa at position 278 is Tyr, Phe, Met, His, Ile, Leu, Val Ala, or Gly
  SITE (279)..(279): Xaa at position 279 is Tyr, Phe, Met, His, Ile, Leu, Val Ala, or Gly
  SITE (280)..(280): Xaa at position 280 is Leu, Ala, Val, Gly, or Ile
  SITE (288)..(288): Xaa at position 288 is Leu, Ala, Val, Gly, or Ile
  SITE (292)..(292): Xaa at position 292 is Leu, Ala, Val, Gly, or Ile
  SITE (293)..(293): Xaa at position 293 is Leu, Ala, Val, Gly, or Ile
  SITE (302)..(302): Xaa at position 302 is Phe, Tyr, Met, His, Ile, Leu, Val Ala, or Gly
  SITE (303)..(303): Xaa at position 303 is Leu, Ala, Val, Gly, or Ile
  SITE (310)..(310): Xaa at position 310 is Ile, Ala, Val, Leu, or Gly
  SITE (319)..(319): Xaa at position 319 is Phe, Tyr, Met, His, Ile, Leu, Val Ala, or Gly
  SITE (325)..(325): Xaa at position 325 is Ala, Gly, or Pro
  SITE (326)..(326): Xaa at position 326 is Met, Ile, Leu, Val, Ala, or Gly
  SITE (329)..(329): Xaa at position 329 is Met, Ile, Leu, Val, Ala, or Gly
  SITE (339)..(339): Xaa at position 339 is Leu, Ala, Val, Gly, or Ile
  SITE (340)..(340): Xaa at position 340 is Leu, Ala, Val, Gly, or Ile
  SITE (342)..(342): Xaa at position 342 is Val, Ala, Gly, Leu, or Ile
  SITE (343)..(343): Xaa at position 343 is Ile, Ala, Val, Leu, or Gly
  SITE (346)..(346): Xaa at position 346 is Val, Ala, Gly, Leu, or Ile
  SITE (347)..(347): Xaa at position 347 is Leu, Ala, Val, Gly, or Ile
  SITE (349)..(349): Xaa at position 349 is Leu, Ala, Val, Gly, or Ile
  SITE (352)..(352): Xaa at position 352 is Ile, Ala, Val, Leu, or Gly
  SITE (354)..(354): Xaa at position 354 is Phe, Tyr, Met, His, Ile, Leu, Val Ala, or Gly
  SITE (363)..(363): Xaa at position 363 is Ala, Gly, or Pro
  SITE (370)..(370): Xaa at position 370 is Ala, Gly, or Pro
  SITE (371)..(371): Xaa at position 371 is Ala, Gly, or Pro
  SITE (374)..(374): Xaa at position 374 is Val, Ala, Gly, Leu, or Ile
  SITE (377)..(377): Xaa at position 377 is Leu, Ala, Val, Gly, or Ile
  SITE (378)..(378): Xaa at position 378 is Leu, Ala, Val, Gly, or Ile
  SITE (385)..(385): Xaa at position 385 is Phe, Tyr, Met, His, Ile, Leu, Val Ala, or Gly
  SITE (389)..(389): Xaa at position 389 is Ile, Ala, Val, Leu, or Gly
  SITE (390)..(390): Xaa at position 390 is Leu, Ala, Val, Gly, or Ile
  SITE (410)..(410): Xaa at position 410 is Ala, Gly, or Pro
  SITE (412)..(412): Xaa at position 412 is Phe, Tyr, Met, His, Ile, Leu, Val Ala, or Gly
  SITE (413)..(413): Xaa at position 413 is Ala, Gly, or Pro
  SITE (414)..(414): Xaa at position 414 is Ile, Ala, Val, Leu, or Gly
  SITE (416)..(416): Xaa at position 416 is Ala, Gly, or Pro
  SITE (417)..(417): Xaa at position 417 is Leu, Ala, Val, Gly, or Ile
  SITE (418)..(418): Xaa at position 418 is Ala, Gly, or Pro
  SITE (420)..(420): Xaa at position 420 is Ala, Gly, or Pro
  SITE (422)..(422): Xaa at position 422 is Tyr, Phe, Met, His, Ile, Leu, Val Ala, or Gly
  SITE (425)..(425): Xaa at position 425 is Met, Ile, Leu, Val, Ala, or Gly
  SITE (426)..(426): Xaa at position 426 is Phe, Tyr, Met, His, Ile, Leu, Val Ala, or Gly
  SITE (429)..(429): Xaa at position 429 is Leu, Ala, Val, Gly, or Ile
  SITE (430)..(430): Xaa at position 430 is Val, Ala, Gly, Leu, or Ile
  SITE (433)..(433): Xaa at position 433 is Ile, Ala, Val, Leu, or Gly
  SITE (437)..(437): Xaa at position 437 is Leu, Ala, Val, Gly, or Ile
  SITE (448)..(448): Xaa at position 448 is Ile, Ala, Val, Leu, or Gly
  SITE (450)..(450): Xaa at position 450 is Ile, Ala, Val, Leu, or Gly
  SITE (451)..(451): Xaa at position 451 is Leu, Ala, Val, Gly, or Ile
  SITE (456)..(456): Xaa at position 456 is Phe, Tyr, Met, His, Ile, Leu, Val Ala, or Gly
  SITE (464)..(464): Xaa at position 464 is Phe, Tyr, Met, His, Ile, Leu, Val Ala, or Gly
  SITE (467)..(467): Xaa at position 467 is Leu, Ala, Val, Gly, or Ile
  SITE (468)..(468): Xaa at position 468 is Cys, Ala, Val, Gly, Ser, or Thr
  SITE (471)..(471): Xaa at position 471 is Tyr, Phe, Met, His, Ile, Leu, Val Ala, or Gly
  SITE (479)..(479): Xaa at position 479 is Leu, Ala, Val, Gly, or Ile
  SITE (480)..(480): Xaa at position 480 is Phe, Tyr, Met, His, Ile, Leu, Val Ala, or Gly
  SITE (492)..(492): Xaa at position 492 is Tyr, Phe, Met, His, Ile, Leu, Val Ala, or Gly
  SITE (497)..(497): Xaa at position 497 is Ile, Ala, Val, Leu, or Gly
  SITE (504)..(504): Xaa at position 504 is Phe, Tyr, Met, His, Ile, Leu, Val Ala, or Gly
  SITE (508)..(508): Xaa at position 508 is Leu, Ala, Val, Gly, or Ile
  SITE (511)..(511): Xaa at position 511 is Cys, Ala, Val, Gly, Ser, or Thr
  SITE (512)..(512): Xaa at position 512 is Ile, Ala, Val, Leu, or Gly
  SITE (514)..(514): Xaa at position 514 is Leu, Ala, Val, Gly, or Ile
  SITE (515)..(515): Xaa at position 515 is Ile, Ala, Val, Leu, or Gly
  SITE (524)..(524): Xaa at position 524 is Ile, Ala, Val, Leu, or Gly
  SITE (525)..(525): Xaa at position 525 is Leu, Ala, Val, Gly, or Ile
  SITE (527)..(527): Xaa at position 527 is Leu, Ala, Val, Gly, or Ile
  SITE (528)..(528): Xaa at position 528 is Leu, Ala, Val, Gly, or Ile
  SITE (542)..(542): Xaa at position 542 is Phe, Tyr, Met, His, Ile, Leu, Val Ala, or Gly
  SITE (546)..(546): Xaa at position 546 is Val, Ala, Gly, Leu, or Ile
  SITE (556)..(556): Xaa at position 556 is Phe, Tyr, Met, His, Ile, Leu, Val Ala, or Gly
  SITE (568)..(568): Xaa at position 568 is Phe, Tyr, Met, His, Ile, Leu, Val Ala, or Gly
  SITE (569)..(569): Xaa at position 569 is Cys, Ala, Val, Gly, Ser, or Thr
  SITE (570)..(570): Xaa at position 570 is Ile, Ala, Val, Leu, or Gly
  SITE (571)..(571): Xaa at position 571 is Ile, Ala, Val, Leu, or Gly
  SITE (572)..(572): Xaa at position 572 is His, Phe, Tyr, Lys, Arg, Gly, Ser Thr, Ala, Val, Leu, Ile, Asn, Met, or Gln
  SITE (577)..(577): Xaa at position 577 is Val, Ala, Gly, Leu, or Ile
  SITE (579)..(579): Xaa at position 579 is Tyr, Phe, Met, His, Ile, Leu, Val Ala, or Gly
  SITE (581)..(581): Xaa at position 581 is Ala, Gly, or Pro
  SITE (584)..(584): Xaa at position 584 is Trp, Tyr, Phe, Met, His, Ile, Leu Val, Ala, or Gly
  SITE (589)..(589): Xaa at position 589 is Met, Ile, Leu, Val, Ala, or Gly
  SITE (596)..(596): Xaa at position 596 is Ile, Ala, Val, Leu, or Gly
  SITE (597)..(597): Xaa at position 597 is Ala, Gly, or Pro
  SITE (600)..(600): Xaa at position 600 is Leu, Ala, Val, Gly, or Ile
  SITE (607)..(607): Xaa at position 607 is Phe, Tyr, Met, His, Ile, Leu, Val Ala, or Gly
  SITE (608)..(608): Xaa at position 608 is Val, Ala, Gly, Leu, or Ile
  SITE (612)..(612): Xaa at position 612 is Trp, Tyr, Phe, Met, His, Ile, Leu Val, Ala, or Gly
  SITE (646)..(646): Xaa at position 646 is Val, Ala, Gly, Leu, or Ile
  SITE (650)..(650): Xaa at position 650 is Tyr, Phe, Met, His, Ile, Leu, Val Ala, or Gly
  SITE (654)..(654): Xaa at position 654 is Leu, Ala, Val, Gly, or Ile
  SITE (657)..(657): Xaa at position 657 is Leu, Ala, Val, Gly, or Ile
  SITE (658)..(658): Xaa at position 658 is Met, Ile, Leu, Val, Ala, or Gly
  SITE (661)..(661): Xaa at position 661 is Leu, Ala, Val, Gly, or Ile
  SITE (668)..(668): Xaa at position 668 is Phe, Tyr, Met, His, Ile, Leu, Val Ala, or Gly
  SITE (669)..(669): Xaa at position 669 is Val, Ala, Gly, Leu, or Ile
  SITE (671)..(671): Xaa at position 671 is Cys, Ala, Val, Gly, Ser, or Thr
  SITE (672)..(672): Xaa at position 672 is Ile, Ala, Val, Leu, or Gly
  SITE (673)..(673): Xaa at position 673 is Ile, Ala, Val, Leu, or Gly
  SITE (688)..(688): Xaa at position 688 is Val, Ala, Gly, Leu, or Ile
  SITE (689)..(689): Xaa at position 689 is Leu, Ala, Val, Gly, or Ile
  SITE (692)..(692): Xaa at position 692 is Leu, Ala, Val, Gly, or Ile
  SITE (697)..(697): Xaa at position 697 is Val, Ala, Gly, Leu, or Ile
  SITE (701)..(701): Xaa at position 701 is Ile, Ala, Val, Leu, or Gly
  SITE (703)..(703): Xaa at position 703 is Ile, Ala, Val, Leu, or Gly
  SITE (708)..(708): Xaa at position 708 is Phe, Tyr, Met, His, Ile, Leu, Val Ala, or Gly
  SITE (714)..(714): Xaa at position 714 is Phe, Tyr, Met, His, Ile, Leu, Val Ala, or Gly
  SITE (717)..(717): Xaa at position 717 is Phe, Tyr, Met, His, Ile, Leu, Val Ala, or Gly
  SITE (721)..(721): Xaa at position 721 is Tyr, Phe, Met, His, Ile, Leu, Val Ala, or Gly
  SITE (729)..(729): Xaa at position 729 is Ile, Ala, Val, Leu, or Gly
  SITE (739)..(739): Xaa at position 739 is Ala, Gly, or Pro
  SITE (740)..(740): Xaa at position 740 is Cys, Ala, Val, Gly, Ser, or Thr
  SITE (743)..(743): Xaa at position 743 is Met, Ile, Leu, Val, Ala, or Gly
  SITE (744)..(744): Xaa at position 744 is Ile, Ala, Val, Leu, or Gly
  SITE (761)..(761): Xaa at position 761 is Val, Ala, Gly, Leu, or Ile
  SITE (762)..(762): Xaa at position 762 is Phe, Tyr, Met, His, Ile, Leu, Val Ala, or Gly
  SITE (763)..(763): Xaa at position 763 is Phe, Tyr, Met, His, Ile, Leu, Val Ala, or Gly
  SITE (767)..(767): Xaa at position 767 is Val, Ala, Gly, Leu, or Ile
  SITE (771)..(771): Xaa at position 771 is Leu, Ala, Val, Gly, or Ile
  SITE (783)..(783): Xaa at position 783 is Ile, Ala, Val, Leu, or Gly
  SITE (786)..(786): Xaa at position 786 is Phe, Tyr, Met, His, Ile, Leu, Val Ala, or Gly
  SITE (809)..(809): Xaa at position 809 is Met, Ile, Leu, Val, Ala, or Gly
  SITE (871)..(871): Xaa at position 871 is Met, Ile, Leu, Val, Ala, or Gly
MAQQAADKYLYVDKNFINNPLAQADWAAKKLVWXPSDKSGFEPXSLKEEVGEEXIXEXVENGKKVKVNKDDIQKMNPPKFSKVEDXAEXTCLNEXSXXHNXKERXYSGXXXTXSGLXXXXXNPYKNLPXYSEEXXEMXKGKKRHEXPPXXXAXTDTXYRSXMQDREDQSXXXTGESGXGKTENTKKXXQXXXYXXSSHKSKKDQGELERQLLQXNPXXEXXGNXKTVKNDNSSRXGKXXRXNXDVNGYIXGXNIETXXLEKSRXIRQAKEERTXHXXXXXLSGAGEHXKTDXXLEPYNKYRXXSNGHVTXPGQQDKDMXQETMEXXRIXGIPEEEQMGXXRXXSGXXQXGNXVXKKERNTDQXSMPDNTXXQKXSHXXGINVTDXTRGXXTPRIKVGRDYVQKAQTKEQXDXXXEXXXKXTXERXXRWXXLRXNKAXDKTKRQGASFXGXXDIAGXEIFDLNSXEQXXINXTNEKLQQXXNHTMFILEQEEXQREGXEWNFIDXGLDXQPXXDXXEKPAGPPGXXAXXDEECWFPKATDKSXVEKXMQEQGTHPKXQKPKQLKDKADXXXXXYAGKXDXKXDEXLMKNXDPLNDNXXTLXHQSSDKXXSELXKDVDRIIGLDQVAGMSETALPGAFKTRKGMFRTXGQLXKEQXAKXXATXRNTNPNXXRXXXPNHEKKAGKLDPHLXXDQXRCNGXLEGXRXCRQGXPNRVVXQEXRQRXEILTPNSXPKGFMDGKQXXVLXXKALELDSNLYRIGQSKXXXRAGXLAHXEEERDLKITDVXIGXQACCRGYLARKAFAKRQQQLTAXKVLQRNCAAYLKLRNWQWWRLFTKVKPLLQVSRQEEEMMAKEEELVKVREKQLAAENRLTEXETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 472 - protein, 894 aa, Homo sapiens
  SITE (44)..(44): Xaa at position 44 is Phe, Tyr, Met, His, Ile, Leu, Val Ala, or Gly
  SITE (48)..(48): Xaa at position 48 is Cys, Ala, Val, Gly, Ser, or Thr
  SITE (70)..(70): Xaa at position 70 is Leu, Ala, Val, Gly, or Ile
  SITE (75)..(75): Xaa at position 75 is Leu, Ala, Val, Gly, or Ile
  SITE (76)..(76): Xaa at position 76 is Leu, Ala, Val, Gly, or Ile
  SITE (100)..(100): Xaa at position 100 is Val, Ala, Gly, Leu, or Ile
  SITE (114)..(114): Xaa at position 114 is Leu, Ala, Val, Gly, or Ile
  SITE (119)..(119): Xaa at position 119 is Ala, Gly, or Pro
  SITE (122)..(122): Xaa at position 122 is Ile, Ala, Val, Leu, or Gly
  SITE (123)..(123): Xaa at position 123 is Val, Ala, Gly, Leu, or Ile
  SITE (134)..(134): Xaa at position 134 is Ile, Ala, Val, Leu, or Gly
  SITE (138)..(138): Xaa at position 138 is Ile, Ala, Val, Leu, or Gly
  SITE (142)..(142): Xaa at position 142 is Ala, Gly, or Pro
  SITE (143)..(143): Xaa at position 143 is Ile, Ala, Val, Leu, or Gly
  SITE (146)..(146): Xaa at position 146 is Ile, Ala, Val, Leu, or Gly
  SITE (157)..(157): Xaa at position 157 is Leu, Ala, Val, Gly, or Ile
  SITE (161)..(161): Xaa at position 161 is Cys, Ala, Val, Gly, Ser, or Thr
  SITE (173)..(173): Xaa at position 173 is Ile, Ala, Val, Leu, or Gly
  SITE (180)..(180): Xaa at position 180 is Trp, Tyr, Phe, Met, His, Ile, Leu Val, Ala, or Gly
  SITE (184)..(184): Xaa at position 184 is Leu, Ala, Val, Gly, or Ile
  SITE (186)..(186): Xaa at position 186 is Leu, Ala, Val, Gly, or Ile
  SITE (187)..(187): Xaa at position 187 is Cys, Ala, Val, Gly, Ser, or Thr
  SITE (188)..(188): Xaa at position 188 is Ala, Gly, or Pro
  SITE (189)..(189): Xaa at position 189 is Leu, Ala, Val, Gly, or Ile
  SITE (190)..(190): Xaa at position 190 is Ile, Ala, Val, Leu, or Gly
  SITE (203)..(203): Xaa at position 203 is Leu, Ala, Val, Gly, or Ile
  SITE (209)..(209): Xaa at position 209 is Ile, Ala, Val, Leu, or Gly
  SITE (212)..(212): Xaa at position 212 is Ile, Ala, Val, Leu, or Gly
  SITE (215)..(215): Xaa at position 215 is Ala, Gly, or Pro
  SITE (216)..(216): Xaa at position 216 is Met, Ile, Leu, Val, Ala, or Gly
  SITE (219)..(219): Xaa at position 219 is Ala, Gly, or Pro
  SITE (231)..(231): Xaa at position 231 is Ala, Gly, or Pro
  SITE (235)..(235): Xaa at position 235 is Val, Ala, Gly, Leu, or Ile
  SITE (244)..(244): Xaa at position 244 is Ala, Gly, or Pro
  SITE (245)..(245): Xaa at position 245 is Ile, Ala, Val, Leu, or Gly
  SITE (246)..(246): Xaa at position 246 is Met, Ile, Leu, Val, Ala, or Gly
  SITE (248)..(248): Xaa at position 248 is Tyr, Phe, Met, His, Ile, Leu, Val Ala, or Gly
  SITE (249)..(249): Xaa at position 249 is Val, Ala, Gly, Leu, or Ile
  SITE (252)..(252): Xaa at position 252 is Phe, Tyr, Met, His, Ile, Leu, Val Ala, or Gly
  SITE (253)..(253): Xaa at position 253 is Tyr, Phe, Met, His, Ile, Leu, Val Ala, or Gly
  SITE (262)..(262): Xaa at position 262 is Ala, Gly, or Pro
  SITE (289)..(289): Xaa at position 289 is Leu, Ala, Val, Gly, or Ile
  SITE (290)..(290): Xaa at position 290 is Ala, Gly, or Pro
  SITE (297)..(297): Xaa at position 297 is Ile, Ala, Val, Leu, or Gly
  SITE (304)..(304): Xaa at position 304 is Leu, Ala, Val, Gly, or Ile
  SITE (315)..(315): Xaa at position 315 is Ala, Gly, or Pro
  SITE (316)..(316): Xaa at position 316 is Met, Ile, Leu, Val, Ala, or Gly
  SITE (348)..(348): Xaa at position 348 is Leu, Ala, Val, Gly, or Ile
  SITE (378)..(378): Xaa at position 378 is Leu, Ala, Val, Gly, or Ile
  SITE (381)..(381): Xaa at position 381 is Ala, Gly, or Pro
  SITE (389)..(389): Xaa at position 389 is Leu, Ala, Val, Gly, or Ile
  SITE (403)..(403): Xaa at position 403 is Ala, Gly, or Pro
  SITE (406)..(406): Xaa at position 406 is Phe, Tyr, Met, His, Ile, Leu, Val Ala, or Gly
  SITE (410)..(410): Xaa at position 410 is Ala, Gly, or Pro
  SITE (413)..(413): Xaa at position 413 is His, Phe, Tyr, Lys, Arg, Gly, Ser Thr, Ala, Val, Leu, Ile, Asn, Met, or Gln
  SITE (417)..(417): Xaa at position 417 is Ala, Gly, or Pro
  SITE (424)..(424): Xaa at position 424 is Leu, Ala, Val, Gly, or Ile
  SITE (437)..(437): Xaa at position 437 is Val, Ala, Gly, Leu, or Ile
  SITE (444)..(444): Xaa at position 444 is His, Phe, Tyr, Lys, Arg, Gly, Ser Thr, Ala, Val, Leu, Ile, Asn, Met, or Gln
  SITE (461)..(461): Xaa at position 461 is Ile, Ala, Val, Leu, or Gly
  SITE (465)..(465): Xaa at position 465 is Ala, Gly, or Pro
  SITE (468)..(468): Xaa at position 468 is Leu, Ala, Val, Gly, or Ile
  SITE (479)..(479): Xaa at position 479 is Val, Ala, Gly, Leu, or Ile
  SITE (486)..(486): Xaa at position 486 is Ile, Ala, Val, Leu, or Gly
  SITE (493)..(493): Xaa at position 493 is Leu, Ala, Val, Gly, or Ile
  SITE (504)..(504): Xaa at position 504 is Leu, Ala, Val, Gly, or Ile
  SITE (507)..(507): Xaa at position 507 is Met, Ile, Leu, Val, Ala, or Gly
  SITE (518)..(518): Xaa at position 518 is His, Phe, Tyr, Lys, Arg, Gly, Ser Thr, Ala, Val, Leu, Ile, Asn, Met, or Gln
  SITE (521)..(521): Xaa at position 521 is Phe, Tyr, Met, His, Ile, Leu, Val Ala, or Gly
  SITE (525)..(525): Xaa at position 525 is Ala, Gly, or Pro
  SITE (532)..(532): Xaa at position 532 is Met, Ile, Leu, Val, Ala, or Gly
  SITE (535)..(535): Xaa at position 535 is Ala, Gly, or Pro
  SITE (551)..(551): Xaa at position 551 is Ile, Ala, Val, Leu, or Gly
  SITE (565)..(565): Xaa at position 565 is Leu, Ala, Val, Gly, or Ile
  SITE (575)..(575): Xaa at position 575 is Ile, Ala, Val, Leu, or Gly
  SITE (582)..(582): Xaa at position 582 is Val, Ala, Gly, Leu, or Ile
  SITE (593)..(593): Xaa at position 593 is Ile, Ala, Val, Leu, or Gly
  SITE (607)..(607): Xaa at position 607 is Leu, Ala, Val, Gly, or Ile
  SITE (614)..(614): Xaa at position 614 is Val, Ala, Gly, Leu, or Ile
  SITE (625)..(625): Xaa at position 625 is Leu, Ala, Val, Gly, or Ile
  SITE (646)..(646): Xaa at position 646 is Ala, Gly, or Pro
  SITE (649)..(649): Xaa at position 649 is Ile, Ala, Val, Leu, or Gly
  SITE (667)..(667): Xaa at position 667 is Ile, Ala, Val, Leu, or Gly
  SITE (678)..(678): Xaa at position 678 is Leu, Ala, Val, Gly, or Ile
  SITE (683)..(683): Xaa at position 683 is His, Phe, Tyr, Lys, Arg, Gly, Ser Thr, Ala, Val, Leu, Ile, Asn, Met, or Gln
  SITE (695)..(695): Xaa at position 695 is Leu, Ala, Val, Gly, or Ile
  SITE (707)..(707): Xaa at position 707 is Val, Ala, Gly, Leu, or Ile
  SITE (717)..(717): Xaa at position 717 is Met, Ile, Leu, Val, Ala, or Gly
  SITE (720)..(720): Xaa at position 720 is Ile, Ala, Val, Leu, or Gly
  SITE (727)..(727): Xaa at position 727 is Leu, Ala, Val, Gly, or Ile
  SITE (731)..(731): Xaa at position 731 is Ile, Ala, Val, Leu, or Gly
  SITE (798)..(798): Xaa at position 798 is Met, Ile, Leu, Val, Ala, or Gly
  SITE (839)..(839): Xaa at position 839 is Ala, Gly, or Pro
  SITE (844)..(844): Xaa at position 844 is Tyr, Phe, Met, His, Ile, Leu, Val Ala, or Gly
  SITE (845)..(845): Xaa at position 845 is Ile, Ala, Val, Leu, or Gly
  SITE (850)..(850): Xaa at position 850 is Leu, Ala, Val, Gly, or Ile
  SITE (859)..(859): Xaa at position 859 is Ala, Gly, or Pro
  SITE (863)..(863): Xaa at position 863 is Ile, Ala, Val, Leu, or Gly
  SITE (878)..(878): Xaa at position 878 is Ala, Gly, or Pro
MNQIEPGVQYNYVYDEDEYMIQEEEWDRDLLLDPAWEKQQRKTXTAWXNSHLRKAGTQIENIEEDFRNGXKLMLXXEVISGERLPKPDRGKMRFHKIANXNKALDYIASKGVKXVSIGXEEXXDGNVKMTLGMXWTIXLRFXXQDXSVEETSAKEGXLLWXQRKTAPYRNVNXQNFHTSXKDGXGXXXXXHRHRPDLIDYSKXNKDDPXGNXNLXXEIXEKHLDIPKMLDXEDIXNTPKPDERXXXTXXSCXXHAFAGAEQXETAANRICKVLAVNQENERLMEEYERXXSELLEWXRRTIPWXENRTPEKTMQXXQKKLEDFRDYRRKHKPPKVQEKCQLEINFNTXQTKLRISNRPAFMPSEGKMVSDIAGAWQRXEQXEKGYEEWXLNEIRRLERLEHLXEKXRQKXSTXETWXYGKEQIXLQKDYESASLTEXRALLRKXEAFESDLAAHQDRVEQXAAIXQEXNELDYHDAVNXNDRCQKXCDQWDRXGTLTQKRREAXERXEKLLETIDQLXLEXAKRXAPFNNWXEGXMEDLQDMFIVHSIEEXQSLITAHEQFKATXPEADGERQSXMAIQNEXEKVIQSYNIRXSSSNPYSTVTMDEXRTKWDKXKQLVPIRDQSXQEELARQHANERLRRQFAAQXNAXGPWIQNKMEEIARSSIQXTGALEDQMNQXKQYEXNIINYKNNIDKXEGDHQLIQEALXFDNKHTNYTXEHXRVGWELXLTTXARTINEVETQILTRDAKGITQEQMNEFRASFNHFDRRKNGLMDHEDFRACLISMGYDLGEAEFARIXTLVDPNGQGTVTFQSFIDFMTRETADTDTAEQVIASFRILXSDKPXXLAEEXRRELPPDQXQYCXKRMPAYSGPGSVPGXLDYAAFSSALYGESDL

SEQ ID NO: 473 - protein, 211 aa, Homo sapiens
  SITE (40)..(40): Xaa at position 40 is Ile, Ala, Val, Leu, or Gly
  SITE (42)..(42): Xaa at position 42 is Ile, Ala, Val, Leu, or Gly
  SITE (44)..(44): Xaa at position 44 is Ala, Gly, or Pro
  SITE (46)..(46): Xaa at position 46 is Val, Ala, Gly, Leu, or Ile
  SITE (60)..(60): Xaa at position 60 is Leu, Ala, Val, Gly, or Ile
  SITE (64)..(64): Xaa at position 64 is Ile, Ala, Val, Leu, or Gly
  SITE (79)..(79): Xaa at position 79 is Val, Ala, Gly, Leu, or Ile
  SITE (82)..(82): Xaa at position 82 is Ile, Ala, Val, Leu, or Gly
  SITE (104)..(104): Xaa at position 104 is Leu, Ala, Val, Gly, or Ile
  SITE (113)..(113): Xaa at position 113 is Met, Ile, Leu, Val, Ala, or Gly
MTPWLGLIVLLGSWSLGDWGAEACTCSPSHPQDAFCNSDXVXRXKXVGKKLVKEGPFGTXVYTXKQMKMYRGFTKMPHXQYXHTEASESLCGLKLEVNKYQYLXTGRVYDGKXYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 474 - protein, 1465 aa, Homo sapiens
  SITE (145)..(145): Xaa at position 145 is Val, Ala, Gly, Leu, or Ile
  SITE (147)..(147): Xaa at position 147 is Leu, Ala, Val, Gly, or Ile
  SITE (149)..(149): Xaa at position 149 is Val, Ala, Gly, Leu, or Ile
  SITE (161)..(161): Xaa at position 161 is Ile, Ala, Val, Leu, or Gly
  SITE (165)..(165): Xaa at position 165 is Val, Ala, Gly, Leu, or Ile
  SITE (183)..(183): Xaa at position 183 is Ala, Gly, or Pro
  SITE (185)..(185): Xaa at position 185 is Ile, Ala, Val, Leu, or Gly
  SITE (187)..(187): Xaa at position 187 is Tyr, Phe, Met, His, Ile, Leu, Val Ala, or Gly
  SITE (197)..(197): Xaa at position 197 is Leu, Ala, Val, Gly, or Ile
  SITE (201)..(201): Xaa at position 201 is Val, Ala, Gly, Leu, or Ile
  SITE (206)..(206): Xaa at position 206 is Phe, Tyr, Met, His, Ile, Leu, Val Ala, or Gly
  SITE (271)..(271): Xaa at position 271 is Cys, Ala, Val, Gly, Ser, or Thr
  SITE (279)..(279): Xaa at position 279 is Ile, Ala, Val, Leu, or Gly
  SITE (285)..(285): Xaa at position 285 is Val, Ala, Gly, Leu, or Ile
  SITE (297)..(297): Xaa at position 297 is Ala, Gly, or Pro
  SITE (299)..(299): Xaa at position 299 is Val, Ala, Gly, Leu, or Ile
  SITE (311)..(311): Xaa at position 311 is Leu, Ala, Val, Gly, or Ile
  SITE (315)..(315): Xaa at position 315 is Ile, Ala, Val, Leu, or Gly
  SITE (363)..(363): Xaa at position 363 is Ile, Ala, Val, Leu, or Gly
  SITE (365)..(365): Xaa at position 365 is Ile, Ala, Val, Leu, or Gly
  SITE (377)..(377): Xaa at position 377 is Ile, Ala, Val, Leu, or Gly
  SITE (381)..(381): Xaa at position 381 is Ile, Ala, Val, Leu, or Gly
  SITE (401)..(401): Xaa at position 401 is Val, Ala, Gly, Leu, or Ile
  SITE (413)..(413): Xaa at position 413 is Leu, Ala, Val, Gly, or Ile
  SITE (417)..(417): Xaa at position 417 is Ile, Ala, Val, Leu, or Gly
  SITE (490)..(490): Xaa at position 490 is Cys, Ala, Val, Gly, Ser, or Thr
  SITE (492)..(492): Xaa at position 492 is Leu, Ala, Val, Gly, or Ile
  SITE (494)..(494): Xaa at position 494 is Ile, Ala, Val, Leu, or Gly
  SITE (503)..(503): Xaa at position 503 is Val, Ala, Gly, Leu, or Ile
  SITE (506)..(506): Xaa at position 506 is Ile, Ala, Val, Leu, or Gly
  SITE (510)..(510): Xaa at position 510 is Leu, Ala, Val, Gly, or Ile
  SITE (516)..(516): Xaa at position 516 is Val, Ala, Gly, Leu, or Ile
  SITE (519)..(519): Xaa at position 519 is Val, Ala, Gly, Leu, or Ile
  SITE (520)..(520): Xaa at position 520 is Leu, Ala, Val, Gly, or Ile
  SITE (528)..(528): Xaa at position 528 is Ala, Gly, or Pro
  SITE (530)..(530): Xaa at position 530 is Ile, Ala, Val, Leu, or Gly
  SITE (532)..(532): Xaa at position 532 is Tyr, Phe, Met, His, Ile, Leu, Val Ala, or Gly
  SITE (542)..(542): Xaa at position 542 is Ile, Ala, Val, Leu, or Gly
  SITE (543)..(543): Xaa at position 543 is Ala, Gly, or Pro
  SITE (546)..(546): Xaa at position 546 is Ile, Ala, Val, Leu, or Gly
  SITE (553)..(553): Xaa at position 553 is Ala, Gly, or Pro
  SITE (566)..(566): Xaa at position 566 is Ile, Ala, Val, Leu, or Gly
  SITE (568)..(568): Xaa at position 568 is Leu, Ala, Val, Gly, or Ile
  SITE (570)..(570): Xaa at position 570 is Ile, Ala, Val, Leu, or Gly
  SITE (582)..(582): Xaa at position 582 is Ile, Ala, Val, Leu, or Gly
  SITE (586)..(586): Xaa at position 586 is Leu, Ala, Val, Gly, or Ile
  SITE (595)..(595): Xaa at position 595 is Ala, Gly, or Pro
  SITE (604)..(604): Xaa at position 604 is Ala, Gly, or Pro
  SITE (606)..(606): Xaa at position 606 is Val, Ala, Gly, Leu, or Ile
  SITE (608)..(608): Xaa at position 608 is Phe, Tyr, Met, His, Ile, Leu, Val Ala, or Gly
  SITE (618)..(618): Xaa at position 618 is Ile, Ala, Val, Leu, or Gly
  SITE (619)..(619): Xaa at position 619 is Ile, Ala, Val, Leu, or Gly
  SITE (622)..(622): Xaa at position 622 is Ile, Ala, Val, Leu, or Gly
  SITE (629)..(629): Xaa at position 629 is Ala, Gly, or Pro
  SITE (820)..(820): Xaa at position 820 is Val, Ala, Gly, Leu, or Ile
  SITE (1079)..(1079): Xaa at position 1079 is Cys, Ala, Val, Gly, Ser, or Thr
  SITE (1106)..(1106): Xaa at position 1106 is Val, Ala, Gly, Leu, or Ile
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVXKXRXEGMTCQSCVSSXEGKXRKLQGVVRVKVSLSNQEXVXTXQPYLIQPEDXRDHXNDMGXEAAIKSKVAPLSLGPIDIERLQSTNPKRPLSSANQNFNNSETLGHQGSHVVTLQLRIDGMHCKSXVLNIEENXGQLLGXQSIQVSLENKTXQXKYDPSCTSPVAXQRAXEALPPGNFKVSLPDGAEGSGTDHRSSSSHSPGSPPRNQVQGTCSTTLXAXAGMTCASCVHSXEGMXSQLEGVQQISVSLAEGTATXLYNPSVISPEEXRAAXEDMGFEASVVSESCSTNPLGNHSAGNSMVQTTDGTPTSVQEVAPHTGRLPANHAPDILAKSPQSTRAVAPQKXFXQXKGMTCASCXSNXERNXQKEAGXLSXXVALMAGKXEXKXDPEVIQPLEXXQFXQDLGFEXAVMEDYAGSDGNXEXTXTGMTCASCVHNXESKXTRTNGITYXSVALATSKXLXKXDPEIIGPRDXXKIXEEIGFHXSLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQXPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYXKEELGTETLGYCTDFQAVPGCGIGCKXSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 475 - protein, 1972 aa, Homo sapiens
  SITE (38)..(38): Xaa at position 38 is Val, Ala, Gly, Leu, or Ile
  SITE (48)..(48): Xaa at position 48 is Ala, Gly, or Pro
  SITE (58)..(58): Xaa at position 58 is Val, Ala, Gly, Leu, or Ile
  SITE (60)..(60): Xaa at position 60 is Val, Ala, Gly, Leu, or Ile
  SITE (62)..(62): Xaa at position 62 is Leu, Ala, Val, Gly, or Ile
  SITE (90)..(90): Xaa at position 90 is Met, Ile, Leu, Val, Ala, or Gly
  SITE (93)..(93): Xaa at position 93 is Leu, Ala, Val, Gly, or Ile
  SITE (99)..(99): Xaa at position 99 is Ala, Gly, or Pro
  SITE (101)..(101): Xaa at position 101 is Val, Ala, Gly, Leu, or Ile
  SITE (102)..(102): Xaa at position 102 is Leu, Ala, Val, Gly, or Ile
  SITE (105)..(105): Xaa at position 105 is Leu, Ala, Val, Gly, or Ile
  SITE (109)..(109): Xaa at position 109 is Tyr, Phe, Met, His, Ile, Leu, Val Ala, or Gly
  SITE (113)..(113): Xaa at position 113 is Leu, Ala, Val, Gly, or Ile
  SITE (114)..(114): Xaa at position 114 is Ile, Ala, Val, Leu, or Gly
  SITE (115)..(115): Xaa at position 115 is Tyr, Phe, Met, His, Ile, Leu, Val Ala, or Gly
  SITE (117)..(117): Xaa at position 117 is Tyr, Phe, Met, His, Ile, Leu, Val Ala, or Gly
  SITE (121)..(121): Xaa at position 121 is Phe, Tyr, Met, His, Ile, Leu, Val Ala, or Gly
  SITE (122)..(122): Xaa at position 122 is Cys, Ala, Val, Gly, Ser, or Thr
  SITE (123)..(123): Xaa at position 123 is Val, Ala, Gly, Leu, or Ile
  SITE (124)..(124): Xaa at position 124 is Val, Ala, Gly, Leu, or Ile
  SITE (125)..(125): Xaa at position 125 is Val, Ala, Gly, Leu, or Ile
  SITE (133)..(133): Xaa at position 133 is Ile, Ala, Val, Leu, or Gly
  SITE (138)..(138): Xaa at position 138 is Ile, Ala, Val, Leu, or Gly
  SITE (139)..(139): Xaa at position 139 is Val, Ala, Gly, Leu, or Ile
  SITE (142)..(142): Xaa at position 142 is Tyr, Phe, Met, His, Ile, Leu, Val Ala, or Gly
  SITE (150)..(150): Xaa at position 150 is Met, Ile, Leu, Val, Ala, or Gly
  SITE (153)..(153): Xaa at position 153 is His, Phe, Tyr, Lys, Arg, Gly, Ser Thr, Ala, Val, Leu, Ile, Asn, Met, or Gln
  SITE (154)..(154): Xaa at position 154 is Ile, Ala, Val, Leu, or Gly
  SITE (155)..(155): Xaa at position 155 is Tyr, Phe, Met, His, Ile, Leu, Val Ala, or Gly
  SITE (157)..(157): Xaa at position 157 is Ile, Ala, Val, Leu, or Gly
  SITE (158)..(158): Xaa at position 158 is Ala, Gly, or Pro
  SITE (161)..(161): Xaa at position 161 is Ala, Gly, or Pro
  SITE (165)..(165): Xaa at position 165 is Met, Ile, Leu, Val, Ala, or Gly
  SITE (174)..(174): Xaa at position 174 is Ile, Ala, Val, Leu, or Gly
  SITE (175)..(175): Xaa at position 175 is Leu, Ala, Val, Gly, or Ile
  SITE (176)..(176): Xaa at position 176 is Cys, Ala, Val, Gly, Ser, or Thr
  SITE (182)..(182): Xaa at position 182 is Ala, Gly, or Pro
  SITE (191)..(191): Xaa at position 191 is Val, Ala, Gly, Leu, or Ile
  SITE (192)..(192): Xaa at position 192 is Ile, Ala, Val, Leu, or Gly
  SITE (194)..(194): Xaa at position 194 is Tyr, Phe, Met, His, Ile, Leu, Val Ala, or Gly
  SITE (195)..(195): Xaa at position 195 is Leu, Ala, Val, Gly, or Ile
  SITE (196)..(196): Xaa at position 196 is Ala, Gly, or Pro
  SITE (198)..(198): Xaa at position 198 is Val, Ala, Gly, Leu, or Ile
  SITE (199)..(199): Xaa at position 199 is Ala, Gly, or Pro
  SITE (221)..(221): Xaa at position 221 is Ala, Gly, or Pro
  SITE (224)..(224): Xaa at position 224 is Ile, Ala, Val, Leu, or Gly
  SITE (225)..(225): Xaa at position 225 is Leu, Ala, Val, Gly, or Ile
  SITE (227)..(227): Xaa at position 227 is Ala, Gly, or Pro
  SITE (228)..(228): Xaa at position 228 is Phe, Tyr, Met, His, Ile, Leu, Val Ala, or Gly
  SITE (231)..(231): Xaa at position 231 is Ala, Gly, or Pro
  SITE (242)..(242): Xaa at position 242 is Phe, Tyr, Met, His, Ile, Leu, Val Ala, or Gly
  SITE (245)..(245): Xaa at position 245 is Phe, Tyr, Met, His, Ile, Leu, Val Ala, or Gly
  SITE (246)..(246): Xaa at position 246 is Ile, Ala, Val, Leu, or Gly
  SITE (248)..(248): Xaa at position 248 is Ile, Ala, Val, Leu, or Gly
  SITE (250)..(250): Xaa at position 250 is Phe, Tyr, Met, His, Ile, Leu, Val Ala, or Gly
  SITE (257)..(257): Xaa at position 257 is Val, Ala, Gly, Leu, or Ile
  SITE (259)..(259): Xaa at position 259 is Ala, Gly, or Pro
  SITE (264)..(264): Xaa at position 264 is Tyr, Phe, Met, His, Ile, Leu, Val Ala, or Gly
  SITE (265)..(265): Xaa at position 265 is Leu, Ala, Val, Gly, or Ile
  SITE (271)..(271): Xaa at position 271 is Ala, Gly, or Pro
  SITE (281)..(281): Xaa at position 281 is Phe, Tyr, Met, His, Ile, Leu, Val Ala, or Gly
  SITE (283)..(283): Xaa at position 283 is Ile, Ala, Val, Leu, or Gly
  SITE (284)..(284): Xaa at position 284 is Phe, Tyr, Met, His, Ile, Leu, Val Ala, or Gly
  SITE (285)..(285): Xaa at position 285 is Tyr, Phe, Met, His, Ile, Leu, Val Ala, or Gly
  SITE (286)..(286): Xaa at position 286 is Tyr, Phe, Met, His, Ile, Leu, Val Ala, or Gly
  SITE (287)..(287): Xaa at position 287 is Met, Ile, Leu, Val, Ala, or Gly
  SITE (295)..(295): Xaa at position 295 is Met, Ile, Leu, Val, Ala, or Gly
  SITE (299)..(299): Xaa at position 299 is Leu, Ala, Val, Gly, or Ile
  SITE (300)..(300): Xaa at position 300 is Leu, Ala, Val, Gly, or Ile
  SITE (309)..(309): Xaa at position 309 is Phe, Tyr, Met, His, Ile, Leu, Val Ala, or Gly
  SITE (310)..(310): Xaa at position 310 is Leu, Ala, Val, Gly, or Ile
  SITE (317)..(317): Xaa at position 317 is Ile, Ala, Val, Leu, or Gly
  SITE (326)..(326): Xaa at position 326 is Phe, Tyr, Met, His, Ile, Leu, Val Ala, or Gly
  SITE (332)..(332): Xaa at position 332 is Ala, Gly, or Pro
  SITE (333)..(333): Xaa at position 333 is Met, Ile, Leu, Val, Ala, or Gly
  SITE (336)..(336): Xaa at position 336 is Met, Ile, Leu, Val, Ala, or Gly
  SITE (346)..(346): Xaa at position 346 is Ile, Ala, Val, Leu, or Gly
  SITE (347)..(347): Xaa at position 347 is Leu, Ala, Val, Gly, or Ile
  SITE (349)..(349): Xaa at position 349 is Val, Ala, Gly, Leu, or Ile
  SITE (350)..(350): Xaa at position 350 is Val, Ala, Gly, Leu, or Ile
  SITE (353)..(353): Xaa at position 353 is Val, Ala, Gly, Leu, or Ile
  SITE (354)..(354): Xaa at position 354 is Leu, Ala, Val, Gly, or Ile
  SITE (356)..(356): Xaa at position 356 is Leu, Ala, Val, Gly, or Ile
  SITE (359)..(359): Xaa at position 359 is Ile, Ala, Val, Leu, or Gly
  SITE (361)..(361): Xaa at position 361 is Phe, Tyr, Met, His, Ile, Leu, Val Ala, or Gly
  SITE (370)..(370): Xaa at position 370 is Ala, Gly, or Pro
  SITE (377)..(377): Xaa at position 377 is Ala, Gly, or Pro
  SITE (378)..(378): Xaa at position 378 is Ala, Gly, or Pro
  SITE (381)..(381): Xaa at position 381 is Val, Ala, Gly, Leu, or Ile
  SITE (382)..(382): Xaa at position 382 is Cys, Ala, Val, Gly, Ser, or Thr
  SITE (384)..(384): Xaa at position 384 is Leu, Ala, Val, Gly, or Ile
  SITE (385)..(385): Xaa at position 385 is Met, Ile, Leu, Val, Ala, or Gly
  SITE (392)..(392): Xaa at position 392 is Phe, Tyr, Met, His, Ile, Leu, Val Ala, or Gly
  SITE (396)..(396): Xaa at position 396 is Ile, Ala, Val, Leu, or Gly
  SITE (397)..(397): Xaa at position 397 is Leu, Ala, Val, Gly, or Ile
  SITE (417)..(417): Xaa at position 417 is Ala, Gly, or Pro
  SITE (419)..(419): Xaa at position 419 is Phe, Tyr, Met, His, Ile, Leu, Val Ala, or Gly
  SITE (420)..(420): Xaa at position 420 is Ala, Gly, or Pro
  SITE (421)..(421): Xaa at position 421 is Val, Ala, Gly, Leu, or Ile
  SITE (423)..(423): Xaa at position 423 is Ala, Gly, or Pro
  SITE (424)..(424): Xaa at position 424 is Leu, Ala, Val, Gly, or Ile
  SITE (425)..(425): Xaa at position 425 is Ala, Gly, or Pro
  SITE (427)..(427): Xaa at position 427 is Ala, Gly, or Pro
  SITE (429)..(429): Xaa at position 429 is Tyr, Phe, Met, His, Ile, Leu, Val Ala, or Gly
  SITE (432)..(432): Xaa at position 432 is Leu, Ala, Val, Gly, or Ile
  SITE (433)..(433): Xaa at position 433 is Phe, Tyr, Met, His, Ile, Leu, Val Ala, or Gly
  SITE (436)..(436): Xaa at position 436 is Ile, Ala, Val, Leu, or Gly
  SITE (437)..(437): Xaa at position 437 is Leu, Ala, Val, Gly, or Ile
  SITE (440)..(440): Xaa at position 440 is Val, Ala, Gly, Leu, or Ile
  SITE (444)..(444): Xaa at position 444 is Leu, Ala, Val, Gly, or Ile
  SITE (455)..(455): Xaa at position 455 is Leu, Ala, Val, Gly, or Ile
  SITE (457)..(457): Xaa at position 457 is Ile, Ala, Val, Leu, or Gly
  SITE (458)..(458): Xaa at position 458 is Leu, Ala, Val, Gly, or Ile
  SITE (463)..(463): Xaa at position 463 is Phe, Tyr, Met, His, Ile, Leu, Val Ala, or Gly
  SITE (471)..(471): Xaa at position 471 is Phe, Tyr, Met, His, Ile, Leu, Val Ala, or Gly
  SITE (474)..(474): Xaa at position 474 is Leu, Ala, Val, Gly, or Ile
  SITE (475)..(475): Xaa at position 475 is Cys, Ala, Val, Gly, Ser, or Thr
  SITE (478)..(478): Xaa at position 478 is Tyr, Phe, Met, His, Ile, Leu, Val Ala, or Gly
  SITE (486)..(486): Xaa at position 486 is Leu, Ala, Val, Gly, or Ile
  SITE (487)..(487): Xaa at position 487 is Phe, Tyr, Met, His, Ile, Leu, Val Ala, or Gly
  SITE (499)..(499): Xaa at position 499 is Tyr, Phe, Met, His, Ile, Leu, Val Ala, or Gly
  SITE (504)..(504): Xaa at position 504 is Ile, Ala, Val, Leu, or Gly
  SITE (511)..(511): Xaa at position 511 is Phe, Tyr, Met, His, Ile, Leu, Val Ala, or Gly
  SITE (515)..(515): Xaa at position 515 is Leu, Ala, Val, Gly, or Ile
  SITE (518)..(518): Xaa at position 518 is Cys, Ala, Val, Gly, Ser, or Thr
  SITE (519)..(519): Xaa at position 519 is Ile, Ala, Val, Leu, or Gly
  SITE (521)..(521): Xaa at position 521 is Leu, Ala, Val, Gly, or Ile
  SITE (522)..(522): Xaa at position 522 is Ile, Ala, Val, Leu, or Gly
  SITE (531)..(531): Xaa at position 531 is Val, Ala, Gly, Leu, or Ile
  SITE (532)..(532): Xaa at position 532 is Leu, Ala, Val, Gly, or Ile
  SITE (534)..(534): Xaa at position 534 is Leu, Ala, Val, Gly, or Ile
  SITE (535)..(535): Xaa at position 535 is Leu, Ala, Val, Gly, or Ile
  SITE (549)..(549): Xaa at position 549 is Phe, Tyr, Met, His, Ile, Leu, Val Ala, or Gly
  SITE (553)..(553): Xaa at position 553 is Leu, Ala, Val, Gly, or Ile
  SITE (563)..(563): Xaa at position 563 is Phe, Tyr, Met, His, Ile, Leu, Val Ala, or Gly
  SITE (575)..(575): Xaa at position 575 is Phe, Tyr, Met, His, Ile, Leu, Val Ala, or Gly
  SITE (577)..(577): Xaa at position 577 is Ile, Ala, Val, Leu, or Gly
  SITE (578)..(578): Xaa at position 578 is Ile, Ala, Val, Leu, or Gly
  SITE (579)..(579): Xaa at position 579 is His, Phe, Tyr, Lys, Arg, Gly, Ser Thr, Ala, Val, Leu, Ile, Asn, Met, or Gln
  SITE (584)..(584): Xaa at position 584 is Val, Ala, Gly, Leu, or Ile
  SITE (586)..(586): Xaa at position 586 is Tyr, Phe, Met, His, Ile, Leu, Val Ala, or Gly
  SITE (588)..(588): Xaa at position 588 is Ala, Gly, or Pro
  SITE (591)..(591): Xaa at position 591 is Trp, Tyr, Phe, Met, His, Ile, Leu Val, Ala, or Gly
  SITE (596)..(596): Xaa at position 596 is Met, Ile, Leu, Val, Ala, or Gly
  SITE (603)..(603): Xaa at position 603 is Val, Ala, Gly, Leu, or Ile
  SITE (607)..(607): Xaa at position 607 is Leu, Ala, Val, Gly, or Ile
  SITE (614)..(614): Xaa at position 614 is Phe, Tyr, Met, His, Ile, Leu, Val Ala, or Gly
  SITE (615)..(615): Xaa at position 615 is Val, Ala, Gly, Leu, or Ile
  SITE (619)..(619): Xaa at position 619 is Trp, Tyr, Phe, Met, His, Ile, Leu Val, Ala, or Gly
  SITE (653)..(653): Xaa at position 653 is Val, Ala, Gly, Leu, or Ile
  SITE (657)..(657): Xaa at position 657 is Tyr, Phe, Met, His, Ile, Leu, Val Ala, or Gly
  SITE (661)..(661): Xaa at position 661 is Leu, Ala, Val, Gly, or Ile
  SITE (664)..(664): Xaa at position 664 is Leu, Ala, Val, Gly, or Ile
  SITE (665)..(665): Xaa at position 665 is Met, Ile, Leu, Val, Ala, or Gly
  SITE (668)..(668): Xaa at position 668 is Leu, Ala, Val, Gly, or Ile
  SITE (675)..(675): Xaa at position 675 is Phe, Tyr, Met, His, Ile, Leu, Val Ala, or Gly
  SITE (676)..(676): Xaa at position 676 is Val, Ala, Gly, Leu, or Ile
  SITE (678)..(678): Xaa at position 678 is Cys, Ala, Val, Gly, Ser, or Thr
  SITE (679)..(679): Xaa at position 679 is Ile, Ala, Val, Leu, or Gly
  SITE (680)..(680): Xaa at position 680 is Ile, Ala, Val, Leu, or Gly
  SITE (692)..(692): Xaa at position 692 is Ala, Gly, or Pro
  SITE (695)..(695): Xaa at position 695 is Val, Ala, Gly, Leu, or Ile
  SITE (696)..(696): Xaa at position 696 is Leu, Ala, Val, Gly, or Ile
  SITE (699)..(699): Xaa at position 699 is Leu, Ala, Val, Gly, or Ile
  SITE (704)..(704): Xaa at position 704 is Val, Ala, Gly, Leu, or Ile
  SITE (708)..(708): Xaa at position 708 is Ile, Ala, Val, Leu, or Gly
  SITE (710)..(710): Xaa at position 710 is Ile, Ala, Val, Leu, or Gly
  SITE (715)..(715): Xaa at position 715 is Phe, Tyr, Met, His, Ile, Leu, Val Ala, or Gly
  SITE (721)..(721): Xaa at position 721 is Phe, Tyr, Met, His, Ile, Leu, Val Ala, or Gly
  SITE (724)..(724): Xaa at position 724 is Phe, Tyr, Met, His, Ile, Leu, Val Ala, or Gly
  SITE (728)..(728): Xaa at position 728 is Tyr, Phe, Met, His, Ile, Leu, Val Ala, or Gly
  SITE (736)..(736): Xaa at position 736 is Ile, Ala, Val, Leu, or Gly
  SITE (746)..(746): Xaa at position 746 is Ala, Gly, or Pro
  SITE (747)..(747): Xaa at position 747 is Cys, Ala, Val, Gly, Ser, or Thr
  SITE (750)..(750): Xaa at position 750 is Met, Ile, Leu, Val, Ala, or Gly
  SITE (751)..(751): Xaa at position 751 is Ile, Ala, Val, Leu, or Gly
  SITE (768)..(768): Xaa at position 768 is Ile, Ala, Val, Leu, or Gly
  SITE (769)..(769): Xaa at position 769 is Phe, Tyr, Met, His, Ile, Leu, Val Ala, or Gly
  SITE (770)..(770): Xaa at position 770 is Phe, Tyr, Met, His, Ile, Leu, Val Ala, or Gly
  SITE (774)..(774): Xaa at position 774 is Val, Ala, Gly, Leu, or Ile
  SITE (778)..(778): Xaa at position 778 is Leu, Ala, Val, Gly, or Ile
  SITE (806)..(806): Xaa at position 806 is Phe, Tyr, Met, His, Ile, Leu, Val Ala, or Gly
  SITE (832)..(832): Xaa at position 832 is Trp, Tyr, Phe, Met, His, Ile, Leu Val, Ala, or Gly
  SITE (885)..(885): Xaa at position 885 is Leu, Ala, Val, Gly, or Ile
MAQKGQLSDDEKFLFVDKNFINSPVAQADWAAKRLVWXPSEKQGFEAXSIKEEKGDEXVXEXVENGKKVTVGKDDIQKMNPPKFSKVEDXAEXTCLNEXSXXHNXRERXFSGXXXTXSGLXXXXXNPYKHLPXYSEKXXDMXKGKKRHEXPPXXXAXXDTXYRSXLQDREDQSXXXTGESGXGKTENTKKXXQXXXVXXSSHKGKKDTSITGELEKQLLQXNPXXEXXGNXKTVKNDNSSRXGKXXRXNXDVTGYIXGXNIETXXLEKSRXIRQARDERTXHXXXXXIAGAKEKXRSDXXLEGFNNYTXXSNGFVPXPAAQDDEMXQETVEXXAIXGFSEEEQLSXXKXXSSXXQXGNXVXKKERNTDQXSMPDNTXXQKXXHXXGINVTDXTRSXXTPRIKVGRDVVQKAQTKEQXDXXXEXXXKXTXERXXRWXXTRXNKAXDKTHRQGASFXGXXDIAGXEIFEVNSXEQXXINXTNEKLQQXXNHTMFILEQEEXQREGXEWNFIDXGLDXQPXXEXXERPNNPPGXXAXXDEECWFPKATDKSXVEKXCTEQGSHPKXQKPKQLKDKTEXSXXXYAGKXDXNXSAXLTKNXDPLNDNXTSLXNASSDKXXADLXKDVDRIVGLDQMAKMTESSLPSASKTKKGMFRTXGQLXKEQXGKXXTTXRNTTPNXXRXXXPNHEKRSGKLDXFLXXEQXRCNGXLEGXRXCRQGXPNRIVXQEXRQRXEILAANAXPKGFMDGKQXXILXXKALELDPNLYRIGQSKXXXRTGXLAHXEEERDLKITDVIMAFQAMCRGYLARKAXAKRQQQLTAMKVIQRNCAAYLKLRNXQWWRLFTKVKPLLQVTRQEEEMQAKEDELQKTKERQQKAENELKELEQKHSQXTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 476 - protein, 106 aa, Homo sapiens
  SITE (6)..(6): Xaa at position 6 is Val, Ala, Gly, Leu, or Ile
  SITE (10)..(10): Xaa at position 10 is Ile, Ala, Val, Leu, or Gly
  SITE (15)..(15): Xaa at position 15 is Val, Ala, Gly, Leu, or Ile
  SITE (16)..(16): Xaa at position 16 is Val, Ala, Gly, Leu, or Ile
  SITE (17)..(17): Xaa at position 17 is Val, Ala, Gly, Leu, or Ile
  SITE (18)..(18): Xaa at position 18 is Phe, Tyr, Met, His, Ile, Leu, Val Ala, or Gly
  SITE (19)..(19): Xaa at position 19 is Ile, Ala, Val, Leu, or Gly
  SITE (26)..(26): Xaa at position 26 is Cys, Ala, Val, Gly, Ser, or Thr
  SITE (29)..(29): Xaa at position 29 is Ala, Gly, or Pro
  SITE (32)..(32): Xaa at position 32 is Ile, Ala, Val, Leu, or Gly
  SITE (33)..(33): Xaa at position 33 is Leu, Ala, Val, Gly, or Ile
  SITE (48)..(48): Xaa at position 48 is Ile, Ala, Val, Leu, or Gly
  SITE (57)..(57): Xaa at position 57 is Ile, Ala, Val, Leu, or Gly
  SITE (61)..(61): Xaa at position 61 is Leu, Ala, Val, Gly, or Ile
  SITE (73)..(73): Xaa at position 73 is Val, Ala, Gly, Leu, or Ile
  SITE (74)..(74): Xaa at position 74 is Phe, Tyr, Met, His, Ile, Leu, Val Ala, or Gly
  SITE (75)..(75): Xaa at position 75 is Ile, Ala, Val, Leu, or Gly
  SITE (86)..(86): Xaa at position 86 is Leu, Ala, Val, Gly, or Ile
  SITE (95)..(95): Xaa at position 95 is Leu, Ala, Val, Gly, or Ile
  SITE (99)..(99): Xaa at position 99 is Leu, Ala, Val, Gly, or Ile
  SITE (104)..(104): Xaa at position 104 is Ala, Gly, or Pro
MAQEFXNCKXQPGKXXXXXKPTCPYXRRXQEXXSQLPIKQGLLEFVDXTATNHTNEXQDYXQQLTGARTVPRXXXGKDCIGGCSDXVSLQQSGEXLTRXKQIGXLQ

SEQ ID NO: 477 - protein, 1356 aa, Homo sapiens
  SITE (136)..(136): Xaa at position 136 is Val, Ala, Gly, Leu, or Ile
  SITE (148)..(148): Xaa at position 148 is Ile, Ala, Val, Leu, or Gly
  SITE (150)..(150): Xaa at position 150 is Cys, Ala, Val, Gly, Ser, or Thr
  SITE (161)..(161): Xaa at position 161 is Leu, Ala, Val, Gly, or Ile
  SITE (162)..(162): Xaa at position 162 is Cys, Ala, Val, Gly, Ser, or Thr
  SITE (163)..(163): Xaa at position 163 is Ala, Gly, or Pro
  SITE (185)..(185): Xaa at position 185 is Phe, Tyr, Met, His, Ile, Leu, Val Ala, or Gly
  SITE (187)..(187): Xaa at position 187 is Ile, Ala, Val, Leu, or Gly
  SITE (192)..(192): Xaa at position 192 is Ile, Ala, Val, Leu, or Gly
  SITE (195)..(195): Xaa at position 195 is Ala, Gly, or Pro
  SITE (198)..(198): Xaa at position 198 is Val, Ala, Gly, Leu, or Ile
  SITE (200)..(200): Xaa at position 200 is Cys, Ala, Val, Gly, Ser, or Thr
  SITE (202)..(202): Xaa at position 202 is Ala, Gly, or Pro
  SITE (223)..(223): Xaa at position 223 is Ile, Ala, Val, Leu, or Gly
  SITE (244)..(244): Xaa at position 244 is Leu, Ala, Val, Gly, or Ile
  SITE (246)..(246): Xaa at position 246 is Cys, Ala, Val, Gly, Ser, or Thr
  SITE (248)..(248): Xaa at position 248 is Ala, Gly, or Pro
  SITE (254)..(254): Xaa at position 254 is Val, Ala, Gly, Leu, or Ile
  SITE (292)..(292): Xaa at position 292 is Leu, Ala, Val, Gly, or Ile
  SITE (294)..(294): Xaa at position 294 is Ile, Ala, Val, Leu, or Gly
  SITE (297)..(297): Xaa at position 297 is Val, Ala, Gly, Leu, or Ile
  SITE (305)..(305): Xaa at position 305 is Tyr, Phe, Met, His, Ile, Leu, Val Ala, or Gly
  SITE (307)..(307): Xaa at position 307 is Cys, Ala, Val, Gly, Ser, or Thr
  SITE (309)..(309): Xaa at position 309 is Ala, Gly, or Pro
  SITE (322)..(322): Xaa at position 322 is Val, Ala, Gly, Leu, or Ile
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVXYITENKNKTVVXPXLGSISNLNVSXXXRYPEKRFVPDGNRISWDSKKGXTXPSYMXSYXGMXFXEXKINDESYQSIMYIVVVVGYRXYDVVLSPSHGIELSVGEKLVXNXTXRTELNXGIDFNWEYPSSKHQHKKLVNRDLKTQSGSEMKKFLSTXTXDGXTRSDQGLXTXAXSSGLMTKKNSTFXRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 478 - protein, 659 aa, Mus musculus
  SITE (219)..(219): Xaa at position 219 is Val, Ala, Gly, Leu, or Ile
  SITE (221)..(221): Xaa at position 221 is Ala, Gly, or Pro
  SITE (233)..(233): Xaa at position 233 is Leu, Ala, Val, Gly, or Ile
  SITE (235)..(235): Xaa at position 235 is Leu, Ala, Val, Gly, or Ile
  SITE (241)..(241): Xaa at position 241 is Tyr, Phe, Met, His, Ile, Leu, Val Ala, or Gly
  SITE (254)..(254): Xaa at position 254 is Ala, Gly, or Pro
  SITE (264)..(264): Xaa at position 264 is Ile, Ala, Val, Leu, or Gly
  SITE (291)..(291): Xaa at position 291 is Ala, Gly, or Pro
  SITE (427)..(427): Xaa at position 427 is Val, Ala, Gly, Leu, or Ile
  SITE (429)..(429): Xaa at position 429 is Ile, Ala, Val, Leu, or Gly
  SITE (432)..(432): Xaa at position 432 is Ile, Ala, Val, Leu, or Gly
  SITE (442)..(442): Xaa at position 442 is Phe, Tyr, Met, His, Ile, Leu, Val Ala, or Gly
  SITE (449)..(449): Xaa at position 449 is Met, Ile, Leu, Val, Ala, or Gly
  SITE (457)..(457): Xaa at position 457 is Leu, Ala, Val, Gly, or Ile
  SITE (458)..(458): Xaa at position 458 is Val, Ala, Gly, Leu, or Ile
  SITE (461)..(461): Xaa at position 461 is Tyr, Phe, Met, His, Ile, Leu, Val Ala, or Gly
  SITE (463)..(463): Xaa at position 463 is Val, Ala, Gly, Leu, or Ile
  SITE (464)..(464): Xaa at position 464 is Cys, Ala, Val, Gly, Ser, or Thr
  SITE (470)..(470): Xaa at position 470 is Ile, Ala, Val, Leu, or Gly
  SITE (472)..(472): Xaa at position 472 is Ile, Ala, Val, Leu, or Gly
  SITE (473)..(473): Xaa at position 473 is Ile, Ala, Val, Leu, or Gly
  SITE (482)..(482): Xaa at position 482 is Leu, Ala, Val, Gly, or Ile
  SITE (486)..(486): Xaa at position 486 is Leu, Ala, Val, Gly, or Ile
  SITE (498)..(498): Xaa at position 498 is Leu, Ala, Val, Gly, or Ile
  SITE (502)..(502): Xaa at position 502 is Cys, Ala, Val, Gly, Ser, or Thr
  SITE (505)..(505): Xaa at position 505 is Val, Ala, Gly, Leu, or Ile
  SITE (506)..(506): Xaa at position 506 is Cys, Ala, Val, Gly, Ser, or Thr
  SITE (508)..(508): Xaa at position 508 is Ala, Gly, or Pro
  SITE (509)..(509): Xaa at position 509 is Met, Ile, Leu, Val, Ala, or Gly
  SITE (512)..(512): Xaa at position 512 is Leu, Ala, Val, Gly, or Ile
  SITE (519)..(519): Xaa at position 519 is His, Phe, Tyr, Lys, Arg, Gly, Ser Thr, Ala, Val, Leu, Ile, Asn, Met, or Gln
  SITE (522)..(522): Xaa at position 522 is Leu, Ala, Val, Gly, or Ile
  SITE (523)..(523): Xaa at position 523 is Ala, Gly, or Pro
  SITE (524)..(524): Xaa at position 524 is Ala, Gly, or Pro
  SITE (527)..(527): Xaa at position 527 is Cys, Ala, Val, Gly, Ser, or Thr
  SITE (529)..(529): Xaa at position 529 is Val, Ala, Gly, Leu, or Ile
  SITE (535)..(535): Xaa at position 535 is Val, Ala, Gly, Leu, or Ile
  SITE (537)..(537): Xaa at position 537 is Val, Ala, Gly, Leu, or Ile
  SITE (540)..(540): Xaa at position 540 is Phe, Tyr, Met, His, Ile, Leu, Val Ala, or Gly
  SITE (568)..(568): Xaa at position 568 is Val, Ala, Gly, Leu, or Ile
  SITE (580)..(580): Xaa at position 580 is Ile, Ala, Val, Leu, or Gly
  SITE (581)..(581): Xaa at position 581 is Trp, Tyr, Phe, Met, His, Ile, Leu Val, Ala, or Gly
  SITE (583)..(583): Xaa at position 583 is Phe, Tyr, Met, His, Ile, Leu, Val Ala, or Gly
  SITE (585)..(585): Xaa at position 585 is Val, Ala, Gly, Leu, or Ile
  SITE (586)..(586): Xaa at position 586 is Leu, Ala, Val, Gly, or Ile
  SITE (587)..(587): Xaa at position 587 is Met, Ile, Leu, Val, Ala, or Gly
  SITE (588)..(588): Xaa at position 588 is Trp, Tyr, Phe, Met, His, Ile, Leu Val, Ala, or Gly
  SITE (590)..(590): Xaa at position 590 is Ile, Ala, Val, Leu, or Gly
  SITE (610)..(610): Xaa at position 610 is Ile, Ala, Val, Leu, or Gly
  SITE (622)..(622): Xaa at position 622 is Ala, Gly, or Pro
  SITE (629)..(629): Xaa at position 629 is Ile, Ala, Val, Leu, or Gly
  SITE (630)..(630): Xaa at position 630 is Met, Ile, Leu, Val, Ala, or Gly
  SITE (633)..(633): Xaa at position 633 is Cys, Ala, Val, Gly, Ser, or Thr
  SITE (634)..(634): Xaa at position 634 is Trp, Tyr, Phe, Met, His, Ile, Leu Val, Ala, or Gly
  SITE (644)..(644): Xaa at position 644 is Phe, Tyr, Met, His, Ile, Leu, Val Ala, or Gly
  SITE (647)..(647): Xaa at position 647 is Leu, Ala, Val, Gly, or Ile
  SITE (651)..(651): Xaa at position 651 is Ile, Ala, Val, Leu, or Gly
MAAVILESIFLKRSQQKKKTSPLNFKKRLFLLTVHKLSYYEYDFERGRRGSKKGSIDVEKITCVETVIPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPTAAPISTTELKKXVXLYDYMPMNANDXQXRKGEEXFILEESNLPWWRXRDKNGQEGYXPSNYITEAEDSIEMYEWYSKHMTRSQXEQLLKQEGKEGGFIVRDSSKAGKYTVSVFAKSTGEPQGVIRHYVVCSTPQSQYYLAEKHLFSTIPELINYHQHNSAGLISRLKYPVSKQNKNAPSTAGLGYGSWEIDPKDLTFLKELGTGQFGVVKYGKWRGQYDXAXKMXREGSMSEDEXIEEAKVXMNLSHEKXXQLXGXXTKQRPXFXXTEYMANGCXLNYXREMRHRFQTQQXLEMXKDXXEXXEYXESKQFLXRDXXXRNXLXNDQGVXKXSDXGLSRYVLDDEYTSSVGSKFPVRWSPPEXLMYSKFSSKSDXXAXGXXXXEXYSLGKMPYERFTNSETAEHXAQGLRLYRPHLXSERVYTXXYSXXHEKADERPSXKIXLSNXLDVMDEES

SEQ ID NO: 479 - protein, 383 aa, Homo sapiens
  SITE (24)..(24): Xaa at position 24 is Leu, Ala, Val, Gly, or Ile
  SITE (25)..(25): Xaa at position 25 is Val, Ala, Gly, Leu, or Ile
  SITE (26)..(26): Xaa at position 26 is Cys, Ala, Val, Gly, Ser, or Thr
  SITE (27)..(27): Xaa at position 27 is Tyr, Phe, Met, His, Ile, Leu, Val Ala, or Gly
  SITE (28)..(28): Xaa at position 28 is Tyr, Phe, Met, His, Ile, Leu, Val Ala, or Gly
  SITE (41)..(41): Xaa at position 41 is Cys, Ala, Val, Gly, Ser, or Thr
  SITE (46)..(46): Xaa at position 46 is Leu, Ala, Val, Gly, or Ile
  SITE (50)..(50): Xaa at position 50 is Leu, Ala, Val, Gly, or Ile
  SITE (51)..(51): Xaa at position 51 is Cys, Ala, Val, Gly, Ser, or Thr
  SITE (54)..(54): Xaa at position 54 is Ile, Ala, Val, Leu, or Gly
  SITE (55)..(55): Xaa at position 55 is Ile, Ala, Val, Leu, or Gly
  SITE (56)..(56): Xaa at position 56 is Tyr, Phe, Met, His, Ile, Leu, Val Ala, or Gly
  SITE (58)..(58): Xaa at position 58 is Phe, Tyr, Met, His, Ile, Leu, Val Ala, or Gly
  SITE (59)..(59): Xaa at position 59 is Ala, Gly, or Pro
  SITE (76)..(76): Xaa at position 76 is Leu, Ala, Val, Gly, or Ile
  SITE (77)..(77): Xaa at position 77 is Tyr, Phe, Met, His, Ile, Leu, Val Ala, or Gly
  SITE (80)..(80): Xaa at position 80 is Leu, Ala, Val, Gly, or Ile
  SITE (90)..(90): Xaa at position 90 is Leu, Ala, Val, Gly, or Ile
  SITE (93)..(93): Xaa at position 93 is Leu, Ala, Val, Gly, or Ile
  SITE (94)..(94): Xaa at position 94 is Leu, Ala, Val, Gly, or Ile
  SITE (96)..(96): Xaa at position 96 is Val, Ala, Gly, Leu, or Ile
  SITE (101)..(101): Xaa at position 101 is Phe, Tyr, Met, His, Ile, Leu, Val Ala, or Gly
  SITE (106)..(106): Xaa at position 106 is Phe, Tyr, Met, His, Ile, Leu, Val Ala, or Gly
  SITE (109)..(109): Xaa at position 109 is Ile, Ala, Val, Leu, or Gly
  SITE (110)..(110): Xaa at position 110 is Ala, Gly, or Pro
  SITE (119)..(119): Xaa at position 119 is Phe, Tyr, Met, His, Ile, Leu, Val Ala, or Gly
  SITE (120)..(120): Xaa at position 120 is Ile, Ala, Val, Leu, or Gly
  SITE (123)..(123): Xaa at position 123 is Val, Ala, Gly, Leu, or Ile
  SITE (127)..(127): Xaa at position 127 is Leu, Ala, Val, Gly, or Ile
  SITE (132)..(132): Xaa at position 132 is Phe, Tyr, Met, His, Ile, Leu, Val Ala, or Gly
  SITE (135)..(135): Xaa at position 135 is Leu, Ala, Val, Gly, or Ile
  SITE (137)..(137): Xaa at position 137 is Leu, Ala, Val, Gly, or Ile
  SITE (138)..(138): Xaa at position 138 is Ala, Gly, or Pro
  SITE (139)..(139): Xaa at position 139 is Trp, Tyr, Phe, Met, His, Ile, Leu Val, Ala, or Gly
  SITE (150)..(150): Xaa at position 150 is Phe, Tyr, Met, His, Ile, Leu, Val Ala, or Gly
  SITE (153)..(153): Xaa at position 153 is Leu, Ala, Val, Gly, or Ile
  SITE (154)..(154): Xaa at position 154 is Ile, Ala, Val, Leu, or Gly
  SITE (157)..(157): Xaa at position 157 is Met, Ile, Leu, Val, Ala, or Gly
  SITE (161)..(161): Xaa at position 161 is Phe, Tyr, Met, His, Ile, Leu, Val Ala, or Gly
  SITE (172)..(172): Xaa at position 172 is Leu, Ala, Val, Gly, or Ile
  SITE (173)..(173): Xaa at position 173 is Leu, Ala, Val, Gly, or Ile
  SITE (174)..(174): Xaa at position 174 is Leu, Ala, Val, Gly, or Ile
  SITE (176)..(176): Xaa at position 176 is Ala, Gly, or Pro
  SITE (177)..(177): Xaa at position 177 is Ala, Gly, or Pro
  SITE (178)..(178): Xaa at position 178 is Leu, Ala, Val, Gly, or Ile
  SITE (180)..(180): Xaa at position 180 is Ala, Gly, or Pro
  SITE (185)..(185): Xaa at position 185 is Ile, Ala, Val, Leu, or Gly
  SITE (191)..(191): Xaa at position 191 is Ile, Ala, Val, Leu, or Gly
  SITE (194)..(194): Xaa at position 194 is Ile, Ala, Val, Leu, or Gly
  SITE (198)..(198): Xaa at position 198 is Leu, Ala, Val, Gly, or Ile
  SITE (200)..(200): Xaa at position 200 is Phe, Tyr, Met, His, Ile, Leu, Val Ala, or Gly
  SITE (201)..(201): Xaa at position 201 is Ile, Ala, Val, Leu, or Gly
  SITE (203)..(203): Xaa at position 203 is Ile, Ala, Val, Leu, or Gly
  SITE (218)..(218): Xaa at position 218 is His, Phe, Tyr, Lys, Arg, Gly, Ser Thr, Ala, Val, Leu, Ile, Asn, Met, or Gln
  SITE (219)..(219): Xaa at position 219 is His, Phe, Tyr, Lys, Arg, Gly, Ser Thr, Ala, Val, Leu, Ile, Asn, Met, or Gln
  SITE (222)..(222): Xaa at position 222 is Leu, Ala, Val, Gly, or Ile
  SITE (240)..(240): Xaa at position 240 is Ala, Gly, or Pro
  SITE (241)..(241): Xaa at position 241 is Val, Ala, Gly, Leu, or Ile
  SITE (244)..(244): Xaa at position 244 is Met, Ile, Leu, Val, Ala, or Gly
  SITE (254)..(254): Xaa at position 254 is Leu, Ala, Val, Gly, or Ile
  SITE (255)..(255): Xaa at position 255 is Val, Ala, Gly, Leu, or Ile
  SITE (256)..(256): Xaa at position 256 is Met, Ile, Leu, Val, Ala, or Gly
  SITE (258)..(258): Xaa at position 258 is Ile, Ala, Val, Leu, or Gly
  SITE (265)..(265): Xaa at position 265 is Phe, Tyr, Met, His, Ile, Leu, Val Ala, or Gly
  SITE (274)..(274): Xaa at position 274 is Val, Ala, Gly, Leu, or Ile
  SITE (276)..(276): Xaa at position 276 is Ala, Gly, or Pro
  SITE (295)..(295): Xaa at position 295 is Ala, Gly, or Pro
  SITE (297)..(297): Xaa at position 297 is Tyr, Phe, Met, His, Ile, Leu, Val Ala, or Gly
  SITE (299)..(299): Xaa at position 299 is Ile, Ala, Val, Leu, or Gly
  SITE (316)..(316): Xaa at position 316 is Val, Ala, Gly, Leu, or Ile
  SITE (318)..(318): Xaa at position 318 is Tyr, Phe, Met, His, Ile, Leu, Val Ala, or Gly
  SITE (319)..(319): Xaa at position 319 is Ala, Gly, or Pro
  SITE (325)..(325): Xaa at position 325 is Trp, Tyr, Phe, Met, His, Ile, Leu Val, Ala, or Gly
  SITE (326)..(326): Xaa at position 326 is Val, Ala, Gly, Leu, or Ile
  SITE (328)..(328): Xaa at position 328 is Tyr, Phe, Met, His, Ile, Leu, Val Ala, or Gly
  SITE (334)..(334): Xaa at position 334 is Val, Ala, Gly, Leu, or Ile
  SITE (338)..(338): Xaa at position 338 is Val, Ala, Gly, Leu, or Ile
  SITE (341)..(341): Xaa at position 341 is Leu, Ala, Val, Gly, or Ile
  SITE (349)..(349): Xaa at position 349 is Ala, Gly, or Pro
  SITE (350)..(350): Xaa at position 350 is Met, Ile, Leu, Val, Ala, or Gly
  SITE (351)..(351): Xaa at position 351 is Val, Ala, Gly, Leu, or Ile
  SITE (353)..(353): Xaa at position 353 is Ala, Gly, or Pro
  SITE (354)..(354): Xaa at position 354 is Leu, Ala, Val, Gly, or Ile
  SITE (359)..(359): Xaa at position 359 is Phe, Tyr, Met, His, Ile, Leu, Val Ala, or Gly
  SITE (370)..(370): Xaa at position 370 is Phe, Tyr, Met, His, Ile, Leu, Val Ala, or Gly
  SITE (372)..(372): Xaa at position 372 is Leu, Ala, Val, Gly, or Ile
  SITE (375)..(375): Xaa at position 375 is Ala, Gly, or Pro
  SITE (376)..(376): Xaa at position 376 is Ile, Ala, Val, Leu, or Gly
MGVKASQTGFVVLVLLQCCSAYKXXXXXTSWSQYREGDGSXFPDAXDRFXXTHXXXSXXNISNDHIDTWEWNDVTXXGMXNTLKNRNPNXKTXXSXGGWNXGSQRXSKXXSNTQSRRTXXKSXPPFXRTHGXDGXDXXXLYPGRRDKQHXTTXXKEXKAEXIKEAQPGKKQXXXSXXXSXGKVTXDSSYDXAKXSQHXDXXSXMTYDFHGAWRGTTGXXSPXFRGQEDASPDRFSNTDYXXGYXLRLGAPASKXXXGXPTFGRSXTLASSETGXGXPISGPGIPGRFTKEAGTLXYXEXCDFLRGATVHRILGQQXPXXTKGNQXXGXDDQESXKSKXQYXKDRQLAGXXXWXXDLDDXQGSFCGQDLRXPXTNXXKDALAAT

SEQ ID NO: 480 - protein, 562 aa, Homo sapiens
  SITE (22)..(22): Xaa at position 22 is Leu, Ala, Val, Gly, or Ile
  SITE (26)..(26): Xaa at position 26 is Val, Ala, Gly, Leu, or Ile
  SITE (35)..(35): Xaa at position 35 is Tyr, Phe, Met, His, Ile, Leu, Val Ala, or Gly
  SITE (36)..(36): Xaa at position 36 is Ala, Gly, or Pro
  SITE (39)..(39): Xaa at position 39 is Phe, Tyr, Met, His, Ile, Leu, Val Ala, or Gly
  SITE (40)..(40): Xaa at position 40 is Ile, Ala, Val, Leu, or Gly
  SITE (43)..(43): Xaa at position 43 is Ile, Ala, Val, Leu, or Gly
  SITE (44)..(44): Xaa at position 44 is Ile, Ala, Val, Leu, or Gly
  SITE (55)..(55): Xaa at position 55 is Ala, Gly, or Pro
  SITE (57)..(57): Xaa at position 57 is Leu, Ala, Val, Gly, or Ile
  SITE (58)..(58): Xaa at position 58 is Val, Ala, Gly, Leu, or Ile
  SITE (59)..(59): Xaa at position 59 is Val, Ala, Gly, Leu, or Ile
  SITE (70)..(70): Xaa at position 70 is Ala, Gly, or Pro
  SITE (71)..(71): Xaa at position 71 is Ile, Ala, Val, Leu, or Gly
  SITE (74)..(74): Xaa at position 74 is Ile, Ala, Val, Leu, or Gly
  SITE (75)..(75): Xaa at position 75 is Ala, Gly, or Pro
  SITE (77)..(77): Xaa at position 77 is Ile, Ala, Val, Leu, or Gly
  SITE (78)..(78): Xaa at position 78 is Ala, Gly, or Pro
  SITE (79)..(79): Xaa at position 79 is Ala, Gly, or Pro
  SITE (83)..(83): Xaa at position 83 is Ile, Ala, Val, Leu, or Gly
  SITE (86)..(86): Xaa at position 86 is Leu, Ala, Val, Gly, or Ile
  SITE (88)..(88): Xaa at position 88 is Ile, Ala, Val, Leu, or Gly
  SITE (94)..(94): Xaa at position 94 is Leu, Ala, Val, Gly, or Ile
  SITE (98)..(98): Xaa at position 98 is Ala, Gly, or Pro
  SITE (99)..(99): Xaa at position 99 is Val, Ala, Gly, Leu, or Ile
  SITE (103)..(103): Xaa at position 103 is Ile, Ala, Val, Leu, or Gly
  SITE (106)..(106): Xaa at position 106 is Ile, Ala, Val, Leu, or Gly
  SITE (112)..(112): Xaa at position 112 is Ile, Ala, Val, Leu, or Gly
  SITE (113)..(113): Xaa at position 113 is Ile, Ala, Val, Leu, or Gly
  SITE (114)..(114): Xaa at position 114 is Leu, Ala, Val, Gly, or Ile
  SITE (116)..(116): Xaa at position 116 is Ala, Gly, or Pro
  SITE (127)..(127): Xaa at position 127 is Phe, Tyr, Met, His, Ile, Leu, Val Ala, or Gly
  SITE (129)..(129): Xaa at position 129 is Ile, Ala, Val, Leu, or Gly
  SITE (147)..(147): Xaa at position 147 is Ile, Ala, Val, Leu, or Gly
  SITE (160)..(160): Xaa at position 160 is Cys, Ala, Val, Gly, Ser, or Thr
  SITE (163)..(163): Xaa at position 163 is Leu, Ala, Val, Gly, or Ile
  SITE (165)..(165): Xaa at position 165 is Val, Ala, Gly, Leu, or Ile
  SITE (184)..(184): Xaa at position 184 is Phe, Tyr, Met, His, Ile, Leu, Val Ala, or Gly
  SITE (186)..(186): Xaa at position 186 is Val, Ala, Gly, Leu, or Ile
  SITE (192)..(192): Xaa at position 192 is Val, Ala, Gly, Leu, or Ile
  SITE (195)..(195): Xaa at position 195 is Tyr, Phe, Met, His, Ile, Leu, Val Ala, or Gly
  SITE (199)..(199): Xaa at position 199 is Leu, Ala, Val, Gly, or Ile
  SITE (208)..(208): Xaa at position 208 is Leu, Ala, Val, Gly, or Ile
  SITE (212)..(212): Xaa at position 212 is Leu, Ala, Val, Gly, or Ile
  SITE (218)..(218): Xaa at position 218 is Leu, Ala, Val, Gly, or Ile
  SITE (220)..(220): Xaa at position 220 is Ile, Ala, Val, Leu, or Gly
  SITE (222)..(222): Xaa at position 222 is Ile, Ala, Val, Leu, or Gly
  SITE (224)..(224): Xaa at position 224 is Ala, Gly, or Pro
  SITE (228)..(228): Xaa at position 228 is Val, Ala, Gly, Leu, or Ile
  SITE (232)..(232): Xaa at position 232 is Tyr, Phe, Met, His, Ile, Leu, Val Ala, or Gly
  SITE (233)..(233): Xaa at position 233 is Val, Ala, Gly, Leu, or Ile
  SITE (236)..(236): Xaa at position 236 is Ile, Ala, Val, Leu, or Gly
  SITE (237)..(237): Xaa at position 237 is Leu, Ala, Val, Gly, or Ile
  SITE (241)..(241): Xaa at position 241 is Leu, Ala, Val, Gly, or Ile
  SITE (257)..(257): Xaa at position 257 is Phe, Tyr, Met, His, Ile, Leu, Val Ala, or Gly
  SITE (269)..(269): Xaa at position 269 is Ala, Gly, or Pro
  SITE (272)..(272): Xaa at position 272 is Leu, Ala, Val, Gly, or Ile
  SITE (276)..(276): Xaa at position 276 is Met, Ile, Leu, Val, Ala, or Gly
  SITE (283)..(283): Xaa at position 283 is Phe, Tyr, Met, His, Ile, Leu, Val Ala, or Gly
  SITE (285)..(285): Xaa at position 285 is Ala, Gly, or Pro
  SITE (286)..(286): Xaa at position 286 is Ala, Gly, or Pro
  SITE (287)..(287): Xaa at position 287 is Phe, Tyr, Met, His, Ile, Leu, Val Ala, or Gly
  SITE (295)..(295): Xaa at position 295 is Met, Ile, Leu, Val, Ala, or Gly
  SITE (296)..(296): Xaa at position 296 is Ile, Ala, Val, Leu, or Gly
  SITE (297)..(297): Xaa at position 297 is Leu, Ala, Val, Gly, or Ile
  SITE (304)..(304): Xaa at position 304 is Val, Ala, Gly, Leu, or Ile
  SITE (310)..(310): Xaa at position 310 is Val, Ala, Gly, Leu, or Ile
  SITE (311)..(311): Xaa at position 311 is Ala, Gly, or Pro
  SITE (312)..(312): Xaa at position 312 is Val, Ala, Gly, Leu, or Ile
  SITE (313)..(313): Xaa at position 313 is Ile, Ala, Val, Leu, or Gly
  SITE (320)..(320): Xaa at position 320 is Ile, Ala, Val, Leu, or Gly
  SITE (323)..(323): Xaa at position 323 is Phe, Tyr, Met, His, Ile, Leu, Val Ala, or Gly
  SITE (331)..(331): Xaa at position 331 is Phe, Tyr, Met, His, Ile, Leu, Val Ala, or Gly
  SITE (332)..(332): Xaa at position 332 is Ala, Gly, or Pro
  SITE (335)..(335): Xaa at position 335 is Met, Ile, Leu, Val, Ala, or Gly
  SITE (341)..(341): Xaa at position 341 is Leu, Ala, Val, Gly, or Ile
  SITE (345)..(345): Xaa at position 345 is Ala, Gly, or Pro
  SITE (362)..(362): Xaa at position 362 is Phe, Tyr, Met, His, Ile, Leu, Val Ala, or Gly
  SITE (371)..(371): Xaa at position 371 is Leu, Ala, Val, Gly, or Ile
  SITE (373)..(373): Xaa at position 373 is Leu, Ala, Val, Gly, or Ile
  SITE (374)..(374): Xaa at position 374 is Cys, Ala, Val, Gly, Ser, or Thr
  SITE (386)..(386): Xaa at position 386 is Ile, Ala, Val, Leu, or Gly
  SITE (392)..(392): Xaa at position 392 is Leu, Ala, Val, Gly, or Ile
  SITE (393)..(393): Xaa at position 393 is Trp, Tyr, Phe, Met, His, Ile, Leu Val, Ala, or Gly
  SITE (394)..(394): Xaa at position 394 is Ala, Gly, or Pro
  SITE (395)..(395): Xaa at position 395 is Val, Ala, Gly, Leu, or Ile
  SITE (396)..(396): Xaa at position 396 is Leu, Ala, Val, Gly, or Ile
  SITE (397)..(397): Xaa at position 397 is Ala, Gly, or Pro
  SITE (398)..(398): Xaa at position 398 is Trp, Tyr, Phe, Met, His, Ile, Leu Val, Ala, or Gly
  SITE (399)..(399): Xaa at position 399 is Leu, Ala, Val, Gly, or Ile
  SITE (401)..(401): Xaa at position 401 is Ile, Ala, Val, Leu, or Gly
  SITE (409)..(409): Xaa at position 409 is Val, Ala, Gly, Leu, or Ile
  SITE (412)..(412): Xaa at position 412 is Ile, Ala, Val, Leu, or Gly
  SITE (413)..(413): Xaa at position 413 is Leu, Ala, Val, Gly, or Ile
  SITE (424)..(424): Xaa at position 424 is Phe, Tyr, Met, His, Ile, Leu, Val Ala, or Gly
  SITE (433)..(433): Xaa at position 433 is Val, Ala, Gly, Leu, or Ile
  SITE (438)..(438): Xaa at position 438 is Ala, Gly, or Pro
  SITE (441)..(441): Xaa at position 441 is Met, Ile, Leu, Val, Ala, or Gly
  SITE (445)..(445): Xaa at position 445 is Leu, Ala, Val, Gly, or Ile
  SITE (449)..(449): Xaa at position 449 is Met, Ile, Leu, Val, Ala, or Gly
  SITE (454)..(454): Xaa at position 454 is Phe, Tyr, Met, His, Ile, Leu, Val Ala, or Gly
  SITE (468)..(468): Xaa at position 468 is Val, Ala, Gly, Leu, or Ile
  SITE (490)..(490): Xaa at position 490 is Leu, Ala, Val, Gly, or Ile
  SITE (492)..(492): Xaa at position 492 is Leu, Ala, Val, Gly, or Ile
  SITE (494)..(494): Xaa at position 494 is Phe, Tyr, Met, His, Ile, Leu, Val Ala, or Gly
  SITE (500)..(500): Xaa at position 500 is Ile, Ala, Val, Leu, or Gly
  SITE (501)..(501): Xaa at position 501 is Val, Ala, Gly, Leu, or Ile
  SITE (502)..(502): Xaa at position 502 is Phe, Tyr, Met, His, Ile, Leu, Val Ala, or Gly
  SITE (514)..(514): Xaa at position 514 is Ile, Ala, Val, Leu, or Gly
  SITE (516)..(516): Xaa at position 516 is Leu, Ala, Val, Gly, or Ile
  SITE (517)..(517): Xaa at position 517 is Tyr, Phe, Met, His, Ile, Leu, Val Ala, or Gly
  SITE (518)..(518): Xaa at position 518 is Ile, Ala, Val, Leu, or Gly
  SITE (528)..(528): Xaa at position 528 is Ile, Ala, Val, Leu, or Gly
  SITE (536)..(536): Xaa at position 536 is Leu, Ala, Val, Gly, or Ile
  SITE (539)..(539): Xaa at position 539 is Leu, Ala, Val, Gly, or Ile
  SITE (543)..(543): Xaa at position 543 is Ala, Gly, or Pro
  SITE (549)..(549): Xaa at position 549 is Leu, Ala, Val, Gly, or Ile
MVKIVTVKTQAYQDQKPGTSGXRKRXKVFQSSANXXENXXQSXXSTVEPAQRQEXTXXXGGDGRFYMKEXXQLXXRXXXANGXGRXVXGQNGIXSTPXXSCIXRKXKAIGGXXXTXSHNPGGPNGDXGXKFNISNGGPAPEAITDKXFQISKTIEEYAVXPDXKXDLGVLGKQQFDLENKFKPXTXEIVDSXEAXATMXRSIFDFSAXKELXSGPNRXKXRXDXMHGXVGPXXKKXXCEEXGAPANSAVNCVPLEDXGGHHPDPNLTYXADXVETXKSGEHDXGXXXDGDGDRNXXXGKHGFFXNPSDSXXXXAANIFSXPYXQQTGVRGXXRSXPTSGAXDRVXSATKIALYETPTGWKFXGNLMDASKXSXXGEESFGTGSDHXREKDGXXXXXXXXSXLATRKQSXEDXXKDHWQKYGRNXFTRYDYEEXEAEGXNKXMKDXEALXFDRSXVGKQFSANDKVYTXEKADNFEYSDPVDGSISRNQGXRXIXTDGSRXXXRLSGTGSAGATXRXXXDSYEKDVAKXNQDPQVMXAPXISIXLKVSQXQERTGRTAPTVIT

SEQ ID NO: 481 - protein, 993 aa, Homo sapiens
  SITE (143)..(143): Xaa at position 143 is Leu, Ala, Val, Gly, or Ile
  SITE (182)..(182): Xaa at position 182 is Leu, Ala, Val, Gly, or Ile
  SITE (231)..(231): Xaa at position 231 is Cys, Ala, Val, Gly, Ser, or Thr
  SITE (233)..(233): Xaa at position 233 is Ala, Gly, or Pro
  SITE (268)..(268): Xaa at position 268 is Leu, Ala, Val, Gly, or Ile
  SITE (270)..(270): Xaa at position 270 is Ile, Ala, Val, Leu, or Gly
  SITE (272)..(272): Xaa at position 272 is Cys, Ala, Val, Gly, Ser, or Thr
  SITE (274)..(274): Xaa at position 274 is Ala, Gly, or Pro
  SITE (330)..(330): Xaa at position 330 is Cys, Ala, Val, Gly, Ser, or Thr
  SITE (369)..(369): Xaa at position 369 is Phe, Tyr, Met, His, Ile, Leu, Val Ala, or Gly
  SITE (418)..(418): Xaa at position 418 is Phe, Tyr, Met, His, Ile, Leu, Val Ala, or Gly
  SITE (420)..(420): Xaa at position 420 is Ala, Gly, or Pro
  SITE (443)..(443): Xaa at position 443 is Ala, Gly, or Pro
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLXFIQSEATNYTILFTVSIRNTLLYTLRRPYFRKMENQDAXVCISESVPEPIVEWVLCDSQGESCKEESPAVVKKEEKVLHELFGTDIRXCXRNELGRECTRLFTIDLNQTPQTTLPQLFLKVGEPXWXRXKXVHVNHGFGLTWELENKALEEGNYFEMSTYSTNRTMIRILFAFVSSVARNDTGYYTXSSSKHPSQSALVTIVEKGFINATNSSEDYEIDQYEEFCXSVRFKAYPQIRCTWTFSRKSFPCEQKGLDNGYSISKFCNHKHQPGEYIXHXENDDAQFTKMFTLNIRRKPQVLXEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 482 - protein, 532 aa, Homo sapiens
  SITE (428)..(428): Xaa at position 428 is Ala, Gly, or Pro
  SITE (437)..(437): Xaa at position 437 is Ile, Ala, Val, Leu, or Gly
  SITE (450)..(450): Xaa at position 450 is Val, Ala, Gly, Leu, or Ile
  SITE (473)..(473): Xaa at position 473 is Val, Ala, Gly, Leu, or Ile
  SITE (496)..(496): Xaa at position 496 is Val, Ala, Gly, Leu, or Ile
  SITE (499)..(499): Xaa at position 499 is Leu, Ala, Val, Gly, or Ile
  SITE (504)..(504): Xaa at position 504 is Trp, Tyr, Phe, Met, His, Ile, Leu Val, Ala, or Gly
  SITE (509)..(509): Xaa at position 509 is Ala, Gly, or Pro
  SITE (515)..(515): Xaa at position 515 is Leu, Ala, Val, Gly, or Ile
  SITE (521)..(521): Xaa at position 521 is Leu, Ala, Val, Gly, or Ile
  SITE (524)..(524): Xaa at position 524 is Met, Ile, Leu, Val, Ala, or Gly
  SITE (530)..(530): Xaa at position 530 is Val, Ala, Gly, Leu, or Ile
MPQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMXDIYSFGLIXWEMARRCITGGIXEEYQLPYYNMVPSDPSYEDMREXVCVKRLRPIVSNRWNSDECLRAXLKXMSECXAHNPXSRLTAXRIKKTXAKXVESQDXKI

SEQ ID NO: 483 - protein, 505 aa, Homo sapiens
  SITE (401)..(401): Xaa at position 401 is Ala, Gly, or Pro
  SITE (410)..(410): Xaa at position 410 is Tyr, Phe, Met, His, Ile, Leu, Val Ala, or Gly
  SITE (423)..(423): Xaa at position 423 is His, Phe, Tyr, Lys, Arg, Gly, Ser Thr, Ala, Val, Leu, Ile, Asn, Met, or Gln
  SITE (446)..(446): Xaa at position 446 is Val, Ala, Gly, Leu, or Ile
  SITE (469)..(469): Xaa at position 469 is Met, Ile, Leu, Val, Ala, or Gly
  SITE (472)..(472): Xaa at position 472 is Met, Ile, Leu, Val, Ala, or Gly
  SITE (477)..(477): Xaa at position 477 is Trp, Tyr, Phe, Met, His, Ile, Leu Val, Ala, or Gly
  SITE (482)..(482): Xaa at position 482 is Ala, Gly, or Pro
  SITE (488)..(488): Xaa at position 488 is Leu, Ala, Val, Gly, or Ile
  SITE (494)..(494): Xaa at position 494 is Leu, Ala, Val, Gly, or Ile
  SITE (497)..(497): Xaa at position 497 is Leu, Ala, Val, Gly, or Ile
  SITE (503)..(503): Xaa at position 503 is Val, Ala, Gly, Leu, or Ile
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCXDIYALGLVXWEIARRCNSGGVXEEYQLPYYDLVPSDPSIEEMRKXVCDQKLRPNIPNWWQSYEALRVXGKXMRECXYANGXARLTAXRIKKTXSQXSVQEDXKI

SEQ ID NO: 484 - protein, 503 aa, Homo sapiens
  SITE (399)..(399): Xaa at position 399 is Ala, Gly, or Pro
  SITE (408)..(408): Xaa at position 408 is Phe, Tyr, Met, His, Ile, Leu, Val Ala, or Gly
  SITE (421)..(421): Xaa at position 421 is His, Phe, Tyr, Lys, Arg, Gly, Ser Thr, Ala, Val, Leu, Ile, Asn, Met, or Gln
  SITE (444)..(444): Xaa at position 444 is Val, Ala, Gly, Leu, or Ile
  SITE (467)..(467): Xaa at position 467 is Met, Ile, Leu, Val, Ala, or Gly
  SITE (470)..(470): Xaa at position 470 is Ile, Ala, Val, Leu, or Gly
  SITE (475)..(475): Xaa at position 475 is Trp, Tyr, Phe, Met, His, Ile, Leu Val, Ala, or Gly
  SITE (480)..(480): Xaa at position 480 is Ala, Gly, or Pro
  SITE (486)..(486): Xaa at position 486 is Leu, Ala, Val, Gly, or Ile
  SITE (492)..(492): Xaa at position 492 is Leu, Ala, Val, Gly, or Ile
  SITE (495)..(495): Xaa at position 495 is Leu, Ala, Val, Gly, or Ile
  SITE (501)..(501): Xaa at position 501 is Ile, Ala, Val, Leu, or Gly
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRXDIYAMGLVXWEIARRCSIGGIXEDYQLPYYDLVPSDPSVEEMRKXVCEQKLRPNIPNRWQSCEALRVXAKXMRECXYANGXARLTAXRIKKTXSQXSQQEGXKM

SEQ ID NO: 485 - protein, 607 aa, Homo sapiens
  SITE (363)..(363): Xaa at position 363 is Ile, Ala, Val, Leu, or Gly
  SITE (365)..(365): Xaa at position 365 is Cys, Ala, Val, Gly, Ser, or Thr
  SITE (366)..(366): Xaa at position 366 is Val, Ala, Gly, Leu, or Ile
  SITE (368)..(368): Xaa at position 368 is Phe, Tyr, Met, His, Ile, Leu, Val Ala, or Gly
  SITE (376)..(376): Xaa at position 376 is Leu, Ala, Val, Gly, or Ile
  SITE (377)..(377): Xaa at position 377 is Ile, Ala, Val, Leu, or Gly
  SITE (380)..(380): Xaa at position 380 is Leu, Ala, Val, Gly, or Ile
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTXGXXGXPNVGKSSXXNGXVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 486 - protein, 435 aa, Homo sapiens
  SITE (80)..(80): Xaa at position 80 is Cys, Ala, Val, Gly, Ser, or Thr
MLLPWATSAPGLAWGPLVLGLFGLLAASQPQAVPPYASENQTCRDQEKEYYEPQHRICCSRCPPGTYVSAKCSRIRDTVXATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 487 - protein, 418 aa, Homo sapiens
  SITE (54)..(54): Xaa at position 54 is Leu, Ala, Val, Gly, or Ile
  SITE (55)..(55): Xaa at position 55 is Ala, Gly, or Pro
  SITE (57)..(57): Xaa at position 57 is Ala, Gly, or Pro
  SITE (61)..(61): Xaa at position 61 is Phe, Tyr, Met, His, Ile, Leu, Val Ala, or Gly
  SITE (65)..(65): Xaa at position 65 is Leu, Ala, Val, Gly, or Ile
  SITE (66)..(66): Xaa at position 66 is Tyr, Phe, Met, His, Ile, Leu, Val Ala, or Gly
  SITE (78)..(78): Xaa at position 78 is Val, Ala, Gly, Leu, or Ile
  SITE (80)..(80): Xaa at position 80 is Leu, Ala, Val, Gly, or Ile
  SITE (85)..(85): Xaa at position 85 is Val, Ala, Gly, Leu, or Ile
  SITE (86)..(86): Xaa at position 86 is Ala, Gly, or Pro
  SITE (88)..(88): Xaa at position 88 is Ala, Gly, or Pro
  SITE (89)..(89): Xaa at position 89 is Leu, Ala, Val, Gly, or Ile
  SITE (92)..(92): Xaa at position 92 is Leu, Ala, Val, Gly, or Ile
  SITE (96)..(96): Xaa at position 96 is Ala, Gly, or Pro
  SITE (104)..(104): Xaa at position 104 is Ile, Ala, Val, Leu, or Gly
  SITE (108)..(108): Xaa at position 108 is Leu, Ala, Val, Gly, or Ile
  SITE (122)..(122): Xaa at position 122 is Tyr, Phe, Met, His, Ile, Leu, Val Ala, or Gly
  SITE (125)..(125): Xaa at position 125 is Leu, Ala, Val, Gly, or Ile
  SITE (129)..(129): Xaa at position 129 is Val, Ala, Gly, Leu, or Ile
  SITE (143)..(143): Xaa at position 143 is Val, Ala, Gly, Leu, or Ile
  SITE (144)..(144): Xaa at position 144 is Phe, Tyr, Met, His, Ile, Leu, Val Ala, or Gly
  SITE (154)..(154): Xaa at position 154 is Phe, Tyr, Met, His, Ile, Leu, Val Ala, or Gly
  SITE (158)..(158): Xaa at position 158 is Leu, Ala, Val, Gly, or Ile
  SITE (184)..(184): Xaa at position 184 is Val, Ala, Gly, Leu, or Ile
  SITE (188)..(188): Xaa at position 188 is Met, Ile, Leu, Val, Ala, or Gly
  SITE (205)..(205): Xaa at position 205 is Ile, Ala, Val, Leu, or Gly
  SITE (207)..(207): Xaa at position 207 is Leu, Ala, Val, Gly, or Ile
  SITE (208)..(208): Xaa at position 208 is Leu, Ala, Val, Gly, or Ile
  SITE (210)..(210): Xaa at position 210 is Val, Ala, Gly, Leu, or Ile
  SITE (211)..(211): Xaa at position 211 is Ala, Gly, or Pro
  SITE (213)..(213): Xaa at position 213 is Phe, Tyr, Met, His, Ile, Leu, Val Ala, or Gly
  SITE (231)..(231): Xaa at position 231 is Phe, Tyr, Met, His, Ile, Leu, Val Ala, or Gly
  SITE (244)..(244): Xaa at position 244 is Met, Ile, Leu, Val, Ala, or Gly
  SITE (261)..(261): Xaa at position 261 is Cys, Ala, Val, Gly, Ser, or Thr
  SITE (264)..(264): Xaa at position 264 is Ala, Gly, or Pro
  SITE (274)..(274): Xaa at position 274 is Ile, Ala, Val, Leu, or Gly
  SITE (275)..(275): Xaa at position 275 is Ile, Ala, Val, Leu, or Gly
  SITE (293)..(293): Xaa at position 293 is Leu, Ala, Val, Gly, or Ile
  SITE (298)..(298): Xaa at position 298 is Ile, Ala, Val, Leu, or Gly
  SITE (310)..(310): Xaa at position 310 is Ala, Gly, or Pro
  SITE (314)..(314): Xaa at position 314 is Val, Ala, Gly, Leu, or Ile
  SITE (317)..(317): Xaa at position 317 is Leu, Ala, Val, Gly, or Ile
  SITE (325)..(325): Xaa at position 325 is Val, Ala, Gly, Leu, or Ile
  SITE (329)..(329): Xaa at position 329 is Leu, Ala, Val, Gly, or Ile
  SITE (337)..(337): Xaa at position 337 is Leu, Ala, Val, Gly, or Ile
  SITE (346)..(346): Xaa at position 346 is Ile, Ala, Val, Leu, or Gly
  SITE (353)..(353): Xaa at position 353 is Leu, Ala, Val, Gly, or Ile
  SITE (358)..(358): Xaa at position 358 is His, Phe, Tyr, Lys, Arg, Gly, Ser Thr, Ala, Val, Leu, Ile, Asn, Met, or Gln
  SITE (360)..(360): Xaa at position 360 is Ala, Gly, or Pro
  SITE (362)..(362): Xaa at position 362 is Phe, Tyr, Met, His, Ile, Leu, Val Ala, or Gly
  SITE (388)..(388): Xaa at position 388 is Tyr, Phe, Met, His, Ile, Leu, Val Ala, or Gly
  SITE (390)..(390): Xaa at position 390 is Leu, Ala, Val, Gly, or Ile
  SITE (394)..(394): Xaa at position 394 is Phe, Tyr, Met, His, Ile, Leu, Val Ala, or Gly
  SITE (395)..(395): Xaa at position 395 is Ile, Ala, Val, Leu, or Gly
  SITE (396)..(396): Xaa at position 396 is Phe, Tyr, Met, His, Ile, Leu, Val Ala, or Gly
  SITE (397)..(397): Xaa at position 397 is Val, Ala, Gly, Leu, or Ile
  SITE (398)..(398): Xaa at position 398 is Leu, Ala, Val, Gly, or Ile
  SITE (407)..(407): Xaa at position 407 is Leu, Ala, Val, Gly, or Ile
  SITE (408)..(408): Xaa at position 408 is Phe, Tyr, Met, His, Ile, Leu, Val Ala, or Gly
  SITE (409)..(409): Xaa at position 409 is Ile, Ala, Val, Leu, or Gly
  SITE (412)..(412): Xaa at position 412 is Ile, Ala, Val, Leu, or Gly
MQALVLLLCIGALLGHSSCQNPASPPEEGSPDPDSTGALVEEEDPFFKVPVNKXXAXVSNXGYDXXRVRSSTSPTTNXLXSPLSXXTXXSAXSLGXEQRTESIXHRAXYYDLISSPDIHGTXKEXLDTXTAPQKNLKSASRIXXEKKLRIKSSXVAPXEKSYGTRPRVLTGNPRLDLQEINNWXQAQXKGKLARSTKEIPDEISXLXXGXXHXKGQWVTKFDSRKTSLEDXYLDEERTVRVPMXSDPKAVLRYGLDSDLSXKIXQLPLTGSMSXXFFLPLKVTQNLTLIEESXTSEFXHDIDRELKTVQXVLTXPKXKLSYEGEXTKSXQEMKLQSXFDSPDFSKXTGKPIKXTQVEXRXGXEWNEDGAGTTPSPGLQPAHLTFPLDXHXNQPXXXXXRDTDTGALXXXGKXLDPRGP

SEQ ID NO: 488 - protein, 503 aa, Homo sapiens
  SITE (405)..(405): Xaa at position 405 is Leu, Ala, Val, Gly, or Ile
  SITE (418)..(418): Xaa at position 418 is Val, Ala, Gly, Leu, or Ile
  SITE (441)..(441): Xaa at position 441 is Val, Ala, Gly, Leu, or Ile
  SITE (464)..(464): Xaa at position 464 is Leu, Ala, Val, Gly, or Ile
  SITE (467)..(467): Xaa at position 467 is Met, Ile, Leu, Val, Ala, or Gly
  SITE (472)..(472): Xaa at position 472 is Trp, Tyr, Phe, Met, His, Ile, Leu Val, Ala, or Gly
  SITE (483)..(483): Xaa at position 483 is Leu, Ala, Val, Gly, or Ile
  SITE (489)..(489): Xaa at position 489 is Leu, Ala, Val, Gly, or Ile
  SITE (492)..(492): Xaa at position 492 is Ile, Ala, Val, Leu, or Gly
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVXWEIARRTIVNGIXEDYRPPFYDVVPNDPSFEDMKKXVCVDQQTPTIPNRLAADPVLSGXAQXMRECXYPNPSARLTAXRIKKTXQKXSNSPEKPKVIQ

SEQ ID NO: 489 - protein, 567 aa, Homo sapiens
  SITE (51)..(51): Xaa at position 51 is Cys, Ala, Val, Gly, Ser, or Thr
  SITE (61)..(61): Xaa at position 61 is Cys, Ala, Val, Gly, Ser, or Thr
  SITE (84)..(84): Xaa at position 84 is Cys, Ala, Val, Gly, Ser, or Thr
  SITE (85)..(85): Xaa at position 85 is Val, Ala, Gly, Leu, or Ile
  SITE (86)..(86): Xaa at position 86 is Ala, Gly, or Pro
  SITE (87)..(87): Xaa at position 87 is Val, Ala, Gly, Leu, or Ile
  SITE (100)..(100): Xaa at position 100 is Val, Ala, Gly, Leu, or Ile
  SITE (121)..(121): Xaa at position 121 is Cys, Ala, Val, Gly, Ser, or Thr
  SITE (133)..(133): Xaa at position 133 is Phe, Tyr, Met, His, Ile, Leu, Val Ala, or Gly
  SITE (136)..(136): Xaa at position 136 is Cys, Ala, Val, Gly, Ser, or Thr
  SITE (138)..(138): Xaa at position 138 is Cys, Ala, Val, Gly, Ser, or Thr
  SITE (147)..(147): Xaa at position 147 is Ile, Ala, Val, Leu, or Gly
MGRGLLRGLWPLHIVLWTRIASTIPPHVQKSVNNDMIVTDNNGAVKFPQLXKFCDVRFSTXDNQKSCMSNCSITSICEKPQEVXXXXWRKNDENITLETXCHDPKLPYHDFILEDAASPKXIMKEKKKPGETXFMXSXSSDECNDNXIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 490 - protein, 255 aa, Homo sapiens
  SITE (6)..(6): Xaa at position 6 is Val, Ala, Gly, Leu, or Ile
  SITE (7)..(7): Xaa at position 7 is Leu, Ala, Val, Gly, or Ile
  SITE (8)..(8): Xaa at position 8 is Val, Ala, Gly, Leu, or Ile
  SITE (13)..(13): Xaa at position 13 is Val, Ala, Gly, Leu, or Ile
  SITE (45)..(45): Xaa at position 45 is Ala, Gly, or Pro
  SITE (46)..(46): Xaa at position 46 is Val, Ala, Gly, Leu, or Ile
  SITE (49)..(49): Xaa at position 49 is Ala, Gly, or Pro
  SITE (61)..(61): Xaa at position 61 is Val, Ala, Gly, Leu, or Ile
  SITE (62)..(62): Xaa at position 62 is Ile, Ala, Val, Leu, or Gly
  SITE (63)..(63): Xaa at position 63 is Ala, Gly, or Pro
  SITE (64)..(64): Xaa at position 64 is Val, Ala, Gly, Leu, or Ile
  SITE (75)..(75): Xaa at position 75 is Ile, Ala, Val, Leu, or Gly
  SITE (78)..(78): Xaa at position 78 is Ala, Gly, or Pro
  SITE (79)..(79): Xaa at position 79 is Leu, Ala, Val, Gly, or Ile
  SITE (83)..(83): Xaa at position 83 is Ala, Gly, or Pro
  SITE (87)..(87): Xaa at position 87 is Ile, Ala, Val, Leu, or Gly
  SITE (88)..(88): Xaa at position 88 is His, Phe, Tyr, Lys, Arg, Gly, Ser Thr, Ala, Val, Leu, Ile, Asn, Met, or Gln
  SITE (89)..(89): Xaa at position 89 is Val, Ala, Gly, Leu, or Ile
  SITE (91)..(91): Xaa at position 91 is Val, Ala, Gly, Leu, or Ile
  SITE (105)..(105): Xaa at position 105 is Ala, Gly, or Pro
  SITE (107)..(107): Xaa at position 107 is Val, Ala, Gly, Leu, or Ile
  SITE (108)..(108): Xaa at position 108 is Leu, Ala, Val, Gly, or Ile
  SITE (111)..(111): Xaa at position 111 is Leu, Ala, Val, Gly, or Ile
  SITE (112)..(112): Xaa at position 112 is Ala, Gly, or Pro
  SITE (119)..(119): Xaa at position 119 is Leu, Ala, Val, Gly, or Ile
  SITE (120)..(120): Xaa at position 120 is Val, Ala, Gly, Leu, or Ile
  SITE (139)..(139): Xaa at position 139 is Ala, Gly, or Pro
  SITE (150)..(150): Xaa at position 150 is Ala, Gly, or Pro
  SITE (160)..(160): Xaa at position 160 is Leu, Ala, Val, Gly, or Ile
  SITE (162)..(162): Xaa at position 162 is Val, Ala, Gly, Leu, or Ile
  SITE (179)..(179): Xaa at position 179 is Ala, Gly, or Pro
  SITE (180)..(180): Xaa at position 180 is Val, Ala, Gly, Leu, or Ile
  SITE (181)..(181): Xaa at position 181 is Val, Ala, Gly, Leu, or Ile
  SITE (183)..(183): Xaa at position 183 is Ala, Gly, or Pro
  SITE (201)..(201): Xaa at position 201 is Ala, Gly, or Pro
MAELRXXXAVKRXIDYAVKIRVKPDRTGVVTDGVKHSMNPFCEIXXEEXVRLKEKKLVKEXXXXSCGPAQCQETXRTXXAMGXDRGXXXEXPPAEAERLGPLQVXRXXAKXXEKEKVDXXLLGKQAIDDDCNQTGQMTXGFLDWPQGTFXSQVTLEGDKXKXEREIDGGLETLRLKLPXXXTXDLRLNEPRYATLPNIMKXKKKKIEVIKPGDLGVDLTSKLSVISVEDPPQRTAGVKVETTEDLVAKLKEIGRI

SEQ ID NO: 491 - protein, 145 aa, Homo sapiens
  SITE (6)..(6): Xaa at position 6 is Val, Ala, Gly, Leu, or Ile
  SITE (14)..(14): Xaa at position 14 is Phe, Tyr, Met, His, Ile, Leu, Val Ala, or Gly
  SITE (18)..(18): Xaa at position 18 is Leu, Ala, Val, Gly, or Ile
  SITE (19)..(19): Xaa at position 19 is Ala, Gly, or Pro
  SITE (53)..(53): Xaa at position 53 is Phe, Tyr, Met, His, Ile, Leu, Val Ala, or Gly
  SITE (57)..(57): Xaa at position 57 is Ala, Gly, or Pro
  SITE (58)..(58): Xaa at position 58 is Ala, Gly, or Pro
  SITE (61)..(61): Xaa at position 61 is Ala, Gly, or Pro
  SITE (64)..(64): Xaa at position 64 is Leu, Ala, Val, Gly, or Ile
  SITE (99)..(99): Xaa at position 99 is Val, Ala, Gly, Leu, or Ile
  SITE (100)..(100): Xaa at position 100 is Ala, Gly, or Pro
  SITE (103)..(103): Xaa at position 103 is Val, Ala, Gly, Leu, or Ile
  SITE (104)..(104): Xaa at position 104 is Leu, Ala, Val, Gly, or Ile
  SITE (113)..(113): Xaa at position 113 is Val, Ala, Gly, Leu, or Ile
  SITE (131)..(131): Xaa at position 131 is Leu, Ala, Val, Gly, or Ile
  SITE (135)..(135): Xaa at position 135 is Ala, Gly, or Pro
MPGVTXKDVNQQEXVRAXXAFLKKSGKLKVPEWVDTVKLAKHKELAPYDENWXYTRXXSTXRHXYLRGGAGVGSMTKIYGGRQRNGVMPSHFSRGSKSXXRRXXQALEGLKMXEKDQDGGRKLTPQGQRDXDRIXGQVAAANKKH

SEQ ID NO: 492 - protein, 403 aa, Homo sapiens
  SITE (45)..(45): Xaa at position 45 is Ala, Gly, or Pro
  SITE (46)..(46): Xaa at position 46 is Phe, Tyr, Met, His, Ile, Leu, Val Ala, or Gly
  SITE (47)..(47): Xaa at position 47 is Leu, Ala, Val, Gly, or Ile
  SITE (56)..(56): Xaa at position 56 is Ile, Ala, Val, Leu, or Gly
  SITE (76)..(76): Xaa at position 76 is Val, Ala, Gly, Leu, or Ile
  SITE (78)..(78): Xaa at position 78 is Ile, Ala, Val, Leu, or Gly
  SITE (79)..(79): Xaa at position 79 is Val, Ala, Gly, Leu, or Ile
  SITE (84)..(84): Xaa at position 84 is Met, Ile, Leu, Val, Ala, or Gly
  SITE (87)..(87): Xaa at position 87 is Val, Ala, Gly, Leu, or Ile
  SITE (89)..(89): Xaa at position 89 is Ile, Ala, Val, Leu, or Gly
  SITE (105)..(105): Xaa at position 105 is Val, Ala, Gly, Leu, or Ile
  SITE (114)..(114): Xaa at position 114 is Cys, Ala, Val, Gly, Ser, or Thr
  SITE (153)..(153): Xaa at position 153 is Met, Ile, Leu, Val, Ala, or Gly
  SITE (160)..(160): Xaa at position 160 is Ile, Ala, Val, Leu, or Gly
  SITE (162)..(162): Xaa at position 162 is Val, Ala, Gly, Leu, or Ile
  SITE (164)..(164): Xaa at position 164 is Ala, Gly, or Pro
  SITE (165)..(165): Xaa at position 165 is His, Phe, Tyr, Lys, Arg, Gly, Ser Thr, Ala, Val, Leu, Ile, Asn, Met, or Gln
  SITE (168)..(168): Xaa at position 168 is Met, Ile, Leu, Val, Ala, or Gly
  SITE (178)..(178): Xaa at position 178 is Ala, Gly, or Pro
  SITE (185)..(185): Xaa at position 185 is Val, Ala, Gly, Leu, or Ile
  SITE (194)..(194): Xaa at position 194 is Leu, Ala, Val, Gly, or Ile
  SITE (197)..(197): Xaa at position 197 is Ala, Gly, or Pro
  SITE (207)..(207): Xaa at position 207 is Val, Ala, Gly, Leu, or Ile
  SITE (217)..(217): Xaa at position 217 is Ile, Ala, Val, Leu, or Gly
  SITE (219)..(219): Xaa at position 219 is Val, Ala, Gly, Leu, or Ile
  SITE (220)..(220): Xaa at position 220 is Ile, Ala, Val, Leu, or Gly
  SITE (222)..(222): Xaa at position 222 is Val, Ala, Gly, Leu, or Ile
  SITE (231)..(231): Xaa at position 231 is Val, Ala, Gly, Leu, or Ile
  SITE (284)..(284): Xaa at position 284 is Ile, Ala, Val, Leu, or Gly
  SITE (314)..(314): Xaa at position 314 is Ile, Ala, Val, Leu, or Gly
  SITE (320)..(320): Xaa at position 320 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (331)..(331): Xaa at position 331 is Val, Ala, Gly, Leu, or Ile
  SITE (332)..(332): Xaa at position 332 is Met, Ile, Leu, Val, Ala, or Gly
  SITE (333)..(333): Xaa at position 333 is Leu, Ala, Val, Gly, or Ile
  SITE (345)..(345): Xaa at position 345 is Leu, Ala, Val, Gly, or Ile
  SITE (347)..(347): Xaa at position 347 is Leu, Ala, Val, Gly, or Ile
  SITE (368)..(368): Xaa at position 368 is Ile, Ala, Val, Leu, or Gly
  SITE (382)..(382): Xaa at position 382 is Met, Ile, Leu, Val, Ala, or Gly
MSHRKFSAPRHGSLGFLPRKRSSRHRGKVKSFPKDDPSKPVHLTXXXGYKAGMTHXVREVDRPGSKVNKKEVVEAXTXXETPPXVVXGXVGYVETPRGLRTFKTXFAEHISDEXKRRFYKNWHKSKKKAFTKYCKKWQDEDGKKQLEKDFSSXKKYCQVXRXIXXTQXRLLPLRQKKXHLMEIQXNGGTVAEKXDWXRERLEQQVPXNQVFGQDEMXDXXGXTKGKGYKGXTSRWHTKKLPRKTHRGLRKVACIGAWHPARVAFSVARAGQKGYHHRTEINKKXYKIGQGYLIKDGKLIKNNASTDYDLSDKSXNPLGGXVHYGEVTNDXXXXKGCVVGTKKRVXTXRKSLLVQTKRRALEKIDLKFXDTTSKFGHGRFQTXEEKKAFMGPLKKDRIAKEEGA

SEQ ID NO: 493 - protein, 1754 aa, Homo sapiens
  SITE (1454)..(1454): Xaa at position 1454 is Met, Ile, Leu, Val, Ala, or Gly
  SITE (1461)..(1461): Xaa at position 1461 is Val, Ala, Gly, Leu, or Ile
  SITE (1467)..(1467): Xaa at position 1467 is Ile, Ala, Val, Leu, or Gly
  SITE (1469)..(1469): Xaa at position 1469 is Val, Ala, Gly, Leu, or Ile
  SITE (1581)..(1581): Xaa at position 1581 is Leu, Ala, Val, Gly, or Ile
  SITE (1583)..(1583): Xaa at position 1583 is Leu, Ala, Val, Gly, or Ile
  SITE (1584)..(1584): Xaa at position 1584 is Val, Ala, Gly, Leu, or Ile
  SITE (1585)..(1585): Xaa at position 1585 is Ala, Gly, or Pro
  SITE (1586)..(1586): Xaa at position 1586 is Leu, Ala, Val, Gly, or Ile
  SITE (1600)..(1600): Xaa at position 1600 is Ala, Gly, or Pro
  SITE (1604)..(1604): Xaa at position 1604 is Cys, Ala, Val, Gly, Ser, or Thr
  SITE (1608)..(1608): Xaa at position 1608 is Ala, Gly, or Pro
  SITE (1619)..(1619): Xaa at position 1619 is Ala, Gly, or Pro
  SITE (1620)..(1620): Xaa at position 1620 is Phe, Tyr, Met, His, Ile, Leu Val, Ala, or Gly
  SITE (1621)..(1621): Xaa at position 1621 is Leu, Ala, Val, Gly, or Ile
  SITE (1628)..(1628): Xaa at position 1628 is Leu, Ala, Val, Gly, or Ile
  SITE (1631)..(1631): Xaa at position 1631 is Ile, Ala, Val, Leu, or Gly
  SITE (1632)..(1632): Xaa at position 1632 is Val, Ala, Gly, Leu, or Ile
  SITE (1642)..(1642): Xaa at position 1642 is Ile, Ala, Val, Leu, or Gly
  SITE (1654)..(1654): Xaa at position 1654 is Trp, Tyr, Phe, Met, His, Ile Leu, Val, Ala, or Gly
  SITE (1657)..(1657): Xaa at position 1657 is Leu, Ala, Val, Gly, or Ile
  SITE (1679)..(1679): Xaa at position 1679 is Val, Ala, Gly, Leu, or Ile
  SITE (1685)..(1685): Xaa at position 1685 is Trp, Tyr, Phe, Met, His, Ile Leu, Val, Ala, or Gly
  SITE (1690)..(1690): Xaa at position 1690 is Val, Ala, Gly, Leu, or Ile
  SITE (1691)..(1691): Xaa at position 1691 is Trp, Tyr, Phe, Met, His, Ile Leu, Val, Ala, or Gly
  SITE (1692)..(1692): Xaa at position 1692 is His, Phe, Tyr, Lys, Arg, Gly Ser, Thr, Ala, Val, Leu, Ile, Asn, Met, or Gln
  SITE (1706)..(1706): Xaa at position 1706 is Cys, Ala, Val, Gly, Ser, or Thr
  SITE (1709)..(1709): Xaa at position 1709 is Trp, Tyr, Phe, Met, His, Ile Leu, Val, Ala, or Gly
  SITE (1720)..(1720): Xaa at position 1720 is Ala, Gly, or Pro
  SITE (1723)..(1723): Xaa at position 1723 is Leu, Ala, Val, Gly, or Ile
  SITE (1728)..(1728): Xaa at position 1728 is Leu, Ala, Val, Gly, or Ile
  SITE (1729)..(1729): Xaa at position 1729 is Leu, Ala, Val, Gly, or Ile
  SITE (1736)..(1736): Xaa at position 1736 is Cys, Ala, Val, Gly, Ser, or Thr
  SITE (1741)..(1741): Xaa at position 1741 is Ile, Ala, Val, Leu, or Gly
  SITE (1742)..(1742): Xaa at position 1742 is Val, Ala, Gly, Leu, or Ile
  SITE (1743)..(1743): Xaa at position 1743 is Leu, Ala, Val, Gly, or Ile
  SITE (1744)..(1744): Xaa at position 1744 is Cys, Ala, Val, Gly, Ser, or Thr
  SITE (1745)..(1745): Xaa at position 1745 is Ile, Ala, Val, Leu, or Gly
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAXLGQVHEXPEGWLXFXAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVXHXXXXNSPLSGGMRGIRGXDFQXFQQXRAVGLAGTFRXXXSSRLQDXYSXXRRADRAAVPXVNLKDELLFPSXEAXFSGSEGPLKPGARIFSFDGKDXLRHPTXPQKSXXXGSDPNGRRLTESYXETXRTEAPSATGQXSSXLGGRXXGQSAASXHHAYXXXXXENSFMTASK

SEQ ID NO: 494 - protein, 211 aa, Homo sapiens
  SITE (127)..(127): Xaa at position 127 is Val, Ala, Gly, Leu, or Ile
  SITE (190)..(190): Xaa at position 190 is Phe, Tyr, Met, His, Ile, Leu, Val Ala, or Gly
  SITE (205)..(205): Xaa at position 205 is Ala, Gly, or Pro
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNXTDLGLGYETKEELIFRYCSGSCDAAETTYDKILKNLSRNRRLVSDKVGQACCRPIAFDDDLSXLDDNLVYHILRKHSXKRCGCI

SEQ ID NO: 495 - protein, 353 aa, Homo sapiens
  SITE (33)..(33): Xaa at position 33 is Leu, Ala, Val, Gly, or Ile
  SITE (56)..(56): Xaa at position 56 is Leu, Ala, Val, Gly, or Ile
  SITE (60)..(60): Xaa at position 60 is Val, Ala, Gly, Leu, or Ile
  SITE (62)..(62): Xaa at position 62 is Leu, Ala, Val, Gly, or Ile
  SITE (81)..(81): Xaa at position 81 is Ala, Gly, or Pro
  SITE (84)..(84): Xaa at position 84 is Ile, Ala, Val, Leu, or Gly
  SITE (85)..(85): Xaa at position 85 is Leu, Ala, Val, Gly, or Ile
  SITE (88)..(88): Xaa at position 88 is Val, Ala, Gly, Leu, or Ile
  SITE (91)..(91): Xaa at position 91 is Leu, Ala, Val, Gly, or Ile
  SITE (95)..(95): Xaa at position 95 is Val, Ala, Gly, Leu, or Ile
  SITE (98)..(98): Xaa at position 98 is Ala, Gly, or Pro
  SITE (111)..(111): Xaa at position 111 is Leu, Ala, Val, Gly, or Ile
  SITE (114)..(114): Xaa at position 114 is Leu, Ala, Val, Gly, or Ile
  SITE (118)..(118): Xaa at position 118 is Val, Ala, Gly, Leu, or Ile
  SITE (148)..(148): Xaa at position 148 is Ile, Ala, Val, Leu, or Gly
  SITE (149)..(149): Xaa at position 149 is Phe, Tyr, Met, His, Ile, Leu, Val Ala, or Gly
  SITE (152)..(152): Xaa at position 152 is Phe, Tyr, Met, His, Ile, Leu, Val Ala, or Gly
  SITE (156)..(156): Xaa at position 156 is Leu, Ala, Val, Gly, or Ile
MELTELLLVVMLLLTARLTLSSPAPPACDLRVXSKLLRDSHVLHSRLSQCPEVHPXPTPXLXPAVDFSLGEWKTQMEETKXQDXXGAXTLXLEGXMAXRGQLGPTCLSSLXGQXSGQXRLLLGALQSLLGTQLPPQGRTTAHKDPNAXXLSXQHLXRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 496 - protein, 635 aa, Homo sapiens
  SITE (30)..(30): Xaa at position 30 is Leu, Ala, Val, Gly, or Ile
  SITE (31)..(31): Xaa at position 31 is Leu, Ala, Val, Gly, or Ile
  SITE (40)..(40): Xaa at position 40 is Cys, Ala, Val, Gly, Ser, or Thr
  SITE (41)..(41): Xaa at position 41 is Phe, Tyr, Met, His, Ile, Leu, Val Ala, or Gly
  SITE (45)..(45): Xaa at position 45 is Phe, Tyr, Met, His, Ile, Leu, Val Ala, or Gly
  SITE (48)..(48): Xaa at position 48 is Leu, Ala, Val, Gly, or Ile
  SITE (50)..(50): Xaa at position 50 is Cys, Ala, Val, Gly, Ser, or Thr
  SITE (51)..(51): Xaa at position 51 is Phe, Tyr, Met, His, Ile, Leu, Val Ala, or Gly
  SITE (52)..(52): Xaa at position 52 is Trp, Tyr, Phe, Met, His, Ile, Leu Val, Ala, or Gly
  SITE (65)..(65): Xaa at position 65 is Leu, Ala, Val, Gly, or Ile
  SITE (67)..(67): Xaa at position 67 is Tyr, Phe, Met, His, Ile, Leu, Val Ala, or Gly
  SITE (77)..(77): Xaa at position 77 is Cys, Ala, Val, Gly, Ser, or Thr
  SITE (93)..(93): Xaa at position 93 is Cys, Ala, Val, Gly, Ser, or Thr
  SITE (95)..(95): Xaa at position 95 is Phe, Tyr, Met, His, Ile, Leu, Val Ala, or Gly
  SITE (101)..(101): Xaa at position 101 is Val, Ala, Gly, Leu, or Ile
  SITE (103)..(103): Xaa at position 103 is Leu, Ala, Val, Gly, or Ile
  SITE (104)..(104): Xaa at position 104 is Phe, Tyr, Met, His, Ile, Leu, Val Ala, or Gly
  SITE (107)..(107): Xaa at position 107 is Leu, Ala, Val, Gly, or Ile
  SITE (109)..(109): Xaa at position 109 is Leu, Ala, Val, Gly, or Ile
  SITE (111)..(111): Xaa at position 111 is Val, Ala, Gly, Leu, or Ile
  SITE (127)..(127): Xaa at position 127 is Val, Ala, Gly, Leu, or Ile
  SITE (130)..(130): Xaa at position 130 is Val, Ala, Gly, Leu, or Ile
  SITE (132)..(132): Xaa at position 132 is Leu, Ala, Val, Gly, or Ile
  SITE (134)..(134): Xaa at position 134 is Ala, Gly, or Pro
  SITE (139)..(139): Xaa at position 139 is Ile, Ala, Val, Leu, or Gly
  SITE (141)..(141): Xaa at position 141 is Ala, Gly, or Pro
  SITE (150)..(150): Xaa at position 150 is Leu, Ala, Val, Gly, or Ile
  SITE (152)..(152): Xaa at position 152 is Ile, Ala, Val, Leu, or Gly
  SITE (154)..(154): Xaa at position 154 is Trp, Tyr, Phe, Met, His, Ile, Leu Val, Ala, or Gly
  SITE (164)..(164): Xaa at position 164 is Phe, Tyr, Met, His, Ile, Leu, Val Ala, or Gly
  SITE (165)..(165): Xaa at position 165 is Leu, Ala, Val, Gly, or Ile
  SITE (167)..(167): Xaa at position 167 is Tyr, Phe, Met, His, Ile, Leu, Val Ala, or Gly
  SITE (234)..(234): Xaa at position 234 is Leu, Ala, Val, Gly, or Ile
  SITE (246)..(246): Xaa at position 246 is Leu, Ala, Val, Gly, or Ile
  SITE (252)..(252): Xaa at position 252 is Tyr, Phe, Met, His, Ile, Leu, Val Ala, or Gly
  SITE (269)..(269): Xaa at position 269 is Trp, Tyr, Phe, Met, His, Ile, Leu Val, Ala, or Gly
  SITE (272)..(272): Xaa at position 272 is Trp, Tyr, Phe, Met, His, Ile, Leu Val, Ala, or Gly
  SITE (396)..(396): Xaa at position 396 is Leu, Ala, Val, Gly, or Ile
  SITE (401)..(401): Xaa at position 401 is Ile, Ala, Val, Leu, or Gly
  SITE (406)..(406): Xaa at position 406 is Leu, Ala, Val, Gly, or Ile
  SITE (408)..(408): Xaa at position 408 is Leu, Ala, Val, Gly, or Ile
  SITE (410)..(410): Xaa at position 410 is Trp, Tyr, Phe, Met, His, Ile, Leu Val, Ala, or Gly
  SITE (418)..(418): Xaa at position 418 is Ala, Gly, or Pro
  SITE (423)..(423): Xaa at position 423 is Tyr, Phe, Met, His, Ile, Leu, Val Ala, or Gly
  SITE (427)..(427): Xaa at position 427 is Tyr, Phe, Met, His, Ile, Leu, Val Ala, or Gly
  SITE (435)..(435): Xaa at position 435 is Trp, Tyr, Phe, Met, His, Ile, Leu Val, Ala, or Gly
  SITE (437)..(437): Xaa at position 437 is Val, Ala, Gly, Leu, or Ile
  SITE (438)..(438): Xaa at position 438 is Leu, Ala, Val, Gly, or Ile
  SITE (444)..(444): Xaa at position 444 is Ala, Gly, or Pro
  SITE (449)..(449): Xaa at position 449 is Leu, Ala, Val, Gly, or Ile
  SITE (451)..(451): Xaa at position 451 is Leu, Ala, Val, Gly, or Ile
  SITE (457)..(457): Xaa at position 457 is Tyr, Phe, Met, His, Ile, Leu, Val Ala, or Gly
  SITE (463)..(463): Xaa at position 463 is Ala, Gly, or Pro
  SITE (470)..(470): Xaa at position 470 is Tyr, Phe, Met, His, Ile, Leu, Val Ala, or Gly
  SITE (474)..(474): Xaa at position 474 is Trp, Tyr, Phe, Met, His, Ile, Leu Val, Ala, or Gly
  SITE (477)..(477): Xaa at position 477 is Trp, Tyr, Phe, Met, His, Ile, Leu Val, Ala, or Gly
MPSWALFMVTSCLLLAPQNLAQVSSQDVSXXASDSEPLKXXSRTXEDXTXXXDEEEAAPSGTYQXLXAYPREKPRAXPLSSQSMPHFGTRYVXQXPDQEEXRXXFPXHXWXKNVFLNQTRTQRVLFXDSXGXPXPPSIXKXMGGSQPGEXQXSXEEPAPEISDXXRXELRYGPRDPKNSTGPTVIQLIATETCCPALQRPHSASALDQSPCAQPTMPWQDGPKQTSPSREASAXTAEGGSCLISGXQPGNSXWLQLRSEPDGISLGGSXGSXSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNXHWREXSSGHXEXEXQHPSSWAXQETCXQLRXTGEGHQDXKXXEPPLGXRGGTXEXRPRSRXRLQLRXRLNGPTXQGPXSSXSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 497 - protein, 229 aa, Homo sapiens
  SITE (61)..(61): Xaa at position 61 is Val, Ala, Gly, Leu, or Ile
  SITE (63)..(63): Xaa at position 63 is Met, Ile, Leu, Val, Ala, or Gly
  SITE (65)..(65): Xaa at position 65 is Cys, Ala, Val, Gly, Ser, or Thr
  SITE (76)..(76): Xaa at position 76 is Trp, Tyr, Phe, Met, His, Ile, Leu Val, Ala, or Gly
  SITE (105)..(105): Xaa at position 105 is Ala, Gly, or Pro
  SITE (107)..(107): Xaa at position 107 is Leu, Ala, Val, Gly, or Ile
  SITE (109)..(109): Xaa at position 109 is Ile, Ala, Val, Leu, or Gly
  SITE (120)..(120): Xaa at position 120 is Tyr, Phe, Met, His, Ile, Leu, Val Ala, or Gly
  SITE (122)..(122): Xaa at position 122 is Cys, Ala, Val, Gly, Ser, or Thr
MARLALSPVPSHWMVALLLLLSAEPVPAARSEDRYRNPKGSACSRIWQSPRFIARKRGFTXKXHXYMNSASGNVSXLWKQEMDENPQQLKLEKGRMEESQNESLXTXTXQGIRFEDNGIXFXQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 498 - protein, 386 aa, Homo sapiens
  SITE (24)..(24): Xaa at position 24 is Ala, Gly, or Pro
  SITE (25)..(25): Xaa at position 25 is Ala, Gly, or Pro
  SITE (26)..(26): Xaa at position 26 is Val, Ala, Gly, Leu, or Ile
  SITE (27)..(27): Xaa at position 27 is Leu, Ala, Val, Gly, or Ile
  SITE (34)..(34): Xaa at position 34 is Phe, Tyr, Met, His, Ile, Leu, Val Ala, or Gly
  SITE (39)..(39): Xaa at position 39 is Ile, Ala, Val, Leu, or Gly
  SITE (41)..(41): Xaa at position 41 is Val, Ala, Gly, Leu, or Ile
  SITE (49)..(49): Xaa at position 49 is Val, Ala, Gly, Leu, or Ile
  SITE (51)..(51): Xaa at position 51 is Ile, Ala, Val, Leu, or Gly
  SITE (53)..(53): Xaa at position 53 is Ile, Ala, Val, Leu, or Gly
  SITE (55)..(55): Xaa at position 55 is Ala, Gly, or Pro
  SITE (58)..(58): Xaa at position 58 is Ile, Ala, Val, Leu, or Gly
  SITE (64)..(64): Xaa at position 64 is His, Phe, Tyr, Lys, Arg, Gly, Ser Thr, Ala, Val, Leu, Ile, Asn, Met, or Gln
  SITE (65)..(65): Xaa at position 65 is Val, Ala, Gly, Leu, or Ile
  SITE (76)..(76): Xaa at position 76 is Val, Ala, Gly, Leu, or Ile
  SITE (77)..(77): Xaa at position 77 is Ile, Ala, Val, Leu, or Gly
  SITE (78)..(78): Xaa at position 78 is Val, Ala, Gly, Leu, or Ile
  SITE (80)..(80): Xaa at position 80 is His, Phe, Tyr, Lys, Arg, Gly, Ser Thr, Ala, Val, Leu, Ile, Asn, Met, or Gln
  SITE (82)..(82): Xaa at position 82 is Ala, Gly, or Pro
  SITE (96)..(96): Xaa at position 96 is Val, Ala, Gly, Leu, or Ile
  SITE (102)..(102): Xaa at position 102 is Val, Ala, Gly, Leu, or Ile
  SITE (103)..(103): Xaa at position 103 is Ile, Ala, Val, Leu, or Gly
  SITE (105)..(105): Xaa at position 105 is Leu, Ala, Val, Gly, or Ile
  SITE (107)..(107): Xaa at position 107 is Leu, Ala, Val, Gly, or Ile
  SITE (116)..(116): Xaa at position 116 is Cys, Ala, Val, Gly, Ser, or Thr
  SITE (124)..(124): Xaa at position 124 is Cys, Ala, Val, Gly, Ser, or Thr
  SITE (135)..(135): Xaa at position 135 is Leu, Ala, Val, Gly, or Ile
  SITE (136)..(136): Xaa at position 136 is Ala, Gly, or Pro
  SITE (142)..(142): Xaa at position 142 is Phe, Tyr, Met, His, Ile, Leu, Val Ala, or Gly
  SITE (144)..(144): Xaa at position 144 is Cys, Ala, Val, Gly, Ser, or Thr
  SITE (149)..(149): Xaa at position 149 is Val, Ala, Gly, Leu, or Ile
  SITE (151)..(151): Xaa at position 151 is His, Phe, Tyr, Lys, Arg, Gly, Ser Thr, Ala, Val, Leu, Ile, Asn, Met, or Gln
  SITE (152)..(152): Xaa at position 152 is Phe, Tyr, Met, His, Ile, Leu, Val Ala, or Gly
  SITE (158)..(158): Xaa at position 158 is Phe, Tyr, Met, His, Ile, Leu, Val Ala, or Gly
  SITE (163)..(163): Xaa at position 163 is Val, Ala, Gly, Leu, or Ile
  SITE (164)..(164): Xaa at position 164 is Val, Ala, Gly, Leu, or Ile
  SITE (169)..(169): Xaa at position 169 is Val, Ala, Gly, Leu, or Ile
  SITE (170)..(170): Xaa at position 170 is Ala, Gly, or Pro
  SITE (172)..(172): Xaa at position 172 is Ile, Ala, Val, Leu, or Gly
  SITE (176)..(176): Xaa at position 176 is Ala, Gly, or Pro
  SITE (181)..(181): Xaa at position 181 is Val, Ala, Gly, Leu, or Ile
  SITE (182)..(182): Xaa at position 182 is Cys, Ala, Val, Gly, Ser, or Thr
  SITE (183)..(183): Xaa at position 183 is Leu, Ala, Val, Gly, or Ile
  SITE (184)..(184): Xaa at position 184 is Ile, Ala, Val, Leu, or Gly
  SITE (188)..(188): Xaa at position 188 is Phe, Tyr, Met, His, Ile, Leu, Val Ala, or Gly
  SITE (192)..(192): Xaa at position 192 is Tyr, Phe, Met, His, Ile, Leu, Val Ala, or Gly
  SITE (194)..(194): Xaa at position 194 is Ala, Gly, or Pro
  SITE (195)..(195): Xaa at position 195 is Ala, Gly, or Pro
  SITE (207)..(207): Xaa at position 207 is Cys, Ala, Val, Gly, Ser, or Thr
  SITE (208)..(208): Xaa at position 208 is Val, Ala, Gly, Leu, or Ile
  SITE (209)..(209): Xaa at position 209 is Val, Ala, Gly, Leu, or Ile
  SITE (210)..(210): Xaa at position 210 is Phe, Tyr, Met, His, Ile, Leu, Val Ala, or Gly
  SITE (212)..(212): Xaa at position 212 is Leu, Ala, Val, Gly, or Ile
  SITE (217)..(217): Xaa at position 217 is Leu, Ala, Val, Gly, or Ile
  SITE (219)..(219): Xaa at position 219 is Val, Ala, Gly, Leu, or Ile
  SITE (220)..(220): Xaa at position 220 is Ile, Ala, Val, Leu, or Gly
  SITE (223)..(223): Xaa at position 223 is Cys, Ala, Val, Gly, Ser, or Thr
  SITE (231)..(231): Xaa at position 231 is Ile, Ala, Val, Leu, or Gly
  SITE (232)..(232): Xaa at position 232 is Ile, Ala, Val, Leu, or Gly
  SITE (234)..(234): Xaa at position 234 is Ile, Ala, Val, Leu, or Gly
  SITE (244)..(244): Xaa at position 244 is Ala, Gly, or Pro
  SITE (253)..(253): Xaa at position 253 is Ile, Ala, Val, Leu, or Gly
  SITE (265)..(265): Xaa at position 265 is Val, Ala, Gly, Leu, or Ile
  SITE (266)..(266): Xaa at position 266 is Leu, Ala, Val, Gly, or Ile
  SITE (274)..(274): Xaa at position 274 is Val, Ala, Gly, Leu, or Ile
  SITE (278)..(278): Xaa at position 278 is Phe, Tyr, Met, His, Ile, Leu, Val Ala, or Gly
  SITE (290)..(290): Xaa at position 290 is Ala, Gly, or Pro
  SITE (291)..(291): Xaa at position 291 is Leu, Ala, Val, Gly, or Ile
  SITE (294)..(294): Xaa at position 294 is Cys, Ala, Val, Gly, Ser, or Thr
  SITE (302)..(302): Xaa at position 302 is Val, Ala, Gly, Leu, or Ile
  SITE (303)..(303): Xaa at position 303 is Val, Ala, Gly, Leu, or Ile
  SITE (331)..(331): Xaa at position 331 is Phe, Tyr, Met, His, Ile, Leu, Val Ala, or Gly
  SITE (340)..(340): Xaa at position 340 is Val, Ala, Gly, Leu, or Ile
  SITE (343)..(343): Xaa at position 343 is Leu, Ala, Val, Gly, or Ile
  SITE (344)..(344): Xaa at position 344 is Val, Ala, Gly, Leu, or Ile
  SITE (354)..(354): Xaa at position 354 is Leu, Ala, Val, Gly, or Ile
  SITE (357)..(357): Xaa at position 357 is Leu, Ala, Val, Gly, or Ile
  SITE (364)..(364): Xaa at position 364 is Phe, Tyr, Met, His, Ile, Leu, Val Ala, or Gly
  SITE (367)..(367): Xaa at position 367 is Ile, Ala, Val, Leu, or Gly
  SITE (371)..(371): Xaa at position 371 is Phe, Tyr, Met, His, Ile, Leu, Val Ala, or Gly
  SITE (383)..(383): Xaa at position 383 is Val, Ala, Gly, Leu, or Ile
  SITE (384)..(384): Xaa at position 384 is Leu, Ala, Val, Gly, or Ile
MFAEIQIQDKDRMGTAGKVIKCKXXXXWEQKQPXSIEEXEXAPPKTKEXRXKXLXTGXCRTDDXXIKGTMVSKFPXXXGXEXTGIVESIGEGVTTXKPGDKXXPXFXPQCRECNAXRNPDGNLXIRSDITGRGVXXDGTTRXTXKGKPXHXXMNTSTXTEYTXXDESSXXKXDDAXPPEKXXXXGCGXSTGXGXXVKTGKVKPGSTXXXXGXGGVGXSXXMGXKSAGASRXXGXDLNKDKFEKXMAVGATECXSPKDSTKPISEXXSEMTGNNXGYTXEVIGHLETMIDXXASXHMNYGTSXXVGVPPSAKMLTYDPMLLFTGRTWKGCVXGGLKSRDDXPKXXTEFLAKKFDXDQXITHVLPXKKXSEGXELLNSGQSIRTXXTF

SEQ ID NO: 499 - protein, 167 aa, Homo sapiens
  SITE (35)..(35): Xaa at position 35 is Ile, Ala, Val, Leu, or Gly
  SITE (38)..(38): Xaa at position 38 is Ile, Ala, Val, Leu, or Gly
  SITE (72)..(72): Xaa at position 72 is Leu, Ala, Val, Gly, or Ile
  SITE (75)..(75): Xaa at position 75 is Met, Ile, Leu, Val, Ala, or Gly
  SITE (79)..(79): Xaa at position 79 is Leu, Ala, Val, Gly, or Ile
  SITE (82)..(82): Xaa at position 82 is Tyr, Phe, Met, His, Ile, Leu, Val Ala, or Gly
  SITE (85)..(85): Xaa at position 85 is Ile, Ala, Val, Leu, or Gly
  SITE (97)..(97): Xaa at position 97 is Ile, Ala, Val, Leu, or Gly
  SITE (101)..(101): Xaa at position 101 is Leu, Ala, Val, Gly, or Ile
  SITE (104)..(104): Xaa at position 104 is Leu, Ala, Val, Gly, or Ile
  SITE (108)..(108): Xaa at position 108 is Leu, Ala, Val, Gly, or Ile
  SITE (112)..(112): Xaa at position 112 is Ala, Gly, or Pro
  SITE (146)..(146): Xaa at position 146 is Ala, Gly, or Pro
  SITE (150)..(150): Xaa at position 150 is Leu, Ala, Val, Gly, or Ile
  SITE (154)..(154): Xaa at position 154 is Leu, Ala, Val, Gly, or Ile
  SITE (157)..(157): Xaa at position 157 is Met, Ile, Leu, Val, Ala, or Gly
MHWGTLCGFLWLWPYLFYVQAVPIQKVQDDTKTLXKTXVTRINDISHTQSVSSKQKVTGLDFIPGLHPILTXSKXDQTXAVXQQXLTSMPSRNVIQXSNDXENXRDLXHVLXFSKSCHLPWASGLETLDSLGGVLEASGYSTEVVXLSRXQGSXQDXLWQLDLSPGC

SEQ ID NO: 500 - protein, 1078 aa, Homo sapiens
  SITE (46)..(46): Xaa at position 46 is Ala, Gly, or Pro
  SITE (115)..(115): Xaa at position 115 is Val, Ala, Gly, Leu, or Ile
  SITE (135)..(135): Xaa at position 135 is Ile, Ala, Val, Leu, or Gly
  SITE (320)..(320): Xaa at position 320 is Phe, Tyr, Met, His, Ile, Leu, Val Ala, or Gly
  SITE (321)..(321): Xaa at position 321 is Ala, Gly, or Pro
MAFYSCCWVLLALTWHTSAYGPDQRAQKKGDIILGGLFPIHFGVAXKDQDLKSRPESVECIRYNFRGFRWLQAMIFAIEEINSSPALLPNLTLGYRIFDTCNTVSKALEATLSFXAQNKIDSLNLDEFCNCSEHXPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGXXLKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 501 - protein, 271 aa, Homo sapiens
  SITE (112)..(112): Xaa at position 112 is Ile, Ala, Val, Leu, or Gly
  SITE (116)..(116): Xaa at position 116 is Leu, Ala, Val, Gly, or Ile
  SITE (127)..(127): Xaa at position 127 is Ala, Gly, or Pro
  SITE (181)..(181): Xaa at position 181 is Cys, Ala, Val, Gly, Ser, or Thr
  SITE (183)..(183): Xaa at position 183 is Met, Ile, Leu, Val, Ala, or Gly
  SITE (186)..(186): Xaa at position 186 is Ala, Gly, or Pro
  SITE (190)..(190): Xaa at position 190 is Ala, Gly, or Pro
  SITE (192)..(192): Xaa at position 192 is Ala, Gly, or Pro
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADXRGDXAVNALSNSTTXGQAVTVELFLTLQLVLCIFASTDERRGENPGTPALSIGFSVALGHLLGIHYTGXSXNPXRSLXPXVVTGKFDDHWVFWIGPLVGAILGSLLYNYVLFPPAKSLSERLAVLKGLEPDTDWEEREVRRRQSVELHSPQSLPRGTKA

SEQ ID NO: 502 - protein, 739 aa, Homo sapiens
  SITE (124)..(124): Xaa at position 124 is Met, Ile, Leu, Val, Ala, or Gly
  SITE (128)..(128): Xaa at position 128 is Leu, Ala, Val, Gly, or Ile
  SITE (133)..(133): Xaa at position 133 is Phe, Tyr, Met, His, Ile, Leu, Val Ala, or Gly
  SITE (137)..(137): Xaa at position 137 is Ala, Gly, or Pro
  SITE (157)..(157): Xaa at position 157 is Leu, Ala, Val, Gly, or Ile
  SITE (161)..(161): Xaa at position 161 is Ile, Ala, Val, Leu, or Gly
  SITE (165)..(165): Xaa at position 165 is Trp, Tyr, Phe, Met, His, Ile, Leu Val, Ala, or Gly
  SITE (169)..(169): Xaa at position 169 is Phe, Tyr, Met, His, Ile, Leu, Val Ala, or Gly
  SITE (189)..(189): Xaa at position 189 is Leu, Ala, Val, Gly, or Ile
  SITE (203)..(203): Xaa at position 203 is Val, Ala, Gly, Leu, or Ile
  SITE (214)..(214): Xaa at position 214 is Ala, Gly, or Pro
  SITE (218)..(218): Xaa at position 218 is Leu, Ala, Val, Gly, or Ile
  SITE (222)..(222): Xaa at position 222 is Leu, Ala, Val, Gly, or Ile
  SITE (239)..(239): Xaa at position 239 is Met, Ile, Leu, Val, Ala, or Gly
  SITE (254)..(254): Xaa at position 254 is Leu, Ala, Val, Gly, or Ile
  SITE (280)..(280): Xaa at position 280 is Leu, Ala, Val, Gly, or Ile
  SITE (301)..(301): Xaa at position 301 is Ala, Gly, or Pro
  SITE (304)..(304): Xaa at position 304 is Ile, Ala, Val, Leu, or Gly
  SITE (305)..(305): Xaa at position 305 is Phe, Tyr, Met, His, Ile, Leu, Val Ala, or Gly
  SITE (308)..(308): Xaa at position 308 is Phe, Tyr, Met, His, Ile, Leu, Val Ala, or Gly
  SITE (323)..(323): Xaa at position 323 is Ala, Gly, or Pro
  SITE (324)..(324): Xaa at position 324 is Ala, Gly, or Pro
  SITE (349)..(349): Xaa at position 349 is Ala, Gly, or Pro
  SITE (351)..(351): Xaa at position 351 is Ile, Ala, Val, Leu, or Gly
  SITE (354)..(354): Xaa at position 354 is Phe, Tyr, Met, His, Ile, Leu, Val Ala, or Gly
  SITE (368)..(368): Xaa at position 368 is Val, Ala, Gly, Leu, or Ile
  SITE (369)..(369): Xaa at position 369 is Ala, Gly, or Pro
  SITE (373)..(373): Xaa at position 373 is Leu, Ala, Val, Gly, or Ile
  SITE (380)..(380): Xaa at position 380 is Ala, Gly, or Pro
  SITE (387)..(387): Xaa at position 387 is Ala, Gly, or Pro
  SITE (392)..(392): Xaa at position 392 is Leu, Ala, Val, Gly, or Ile
  SITE (395)..(395): Xaa at position 395 is Ala, Gly, or Pro
  SITE (401)..(401): Xaa at position 401 is Ile, Ala, Val, Leu, or Gly
  SITE (405)..(405): Xaa at position 405 is Val, Ala, Gly, Leu, or Ile
  SITE (406)..(406): Xaa at position 406 is Leu, Ala, Val, Gly, or Ile
  SITE (409)..(409): Xaa at position 409 is Phe, Tyr, Met, His, Ile, Leu, Val Ala, or Gly
  SITE (410)..(410): Xaa at position 410 is Ile, Ala, Val, Leu, or Gly
  SITE (413)..(413): Xaa at position 413 is Ile, Ala, Val, Leu, or Gly
  SITE (416)..(416): Xaa at position 416 is Tyr, Phe, Met, His, Ile, Leu, Val Ala, or Gly
  SITE (417)..(417): Xaa at position 417 is Leu, Ala, Val, Gly, or Ile
  SITE (420)..(420): Xaa at position 420 is Val, Ala, Gly, Leu, or Ile
  SITE (427)..(427): Xaa at position 427 is Leu, Ala, Val, Gly, or Ile
  SITE (429)..(429): Xaa at position 429 is Phe, Tyr, Met, His, Ile, Leu, Val Ala, or Gly
  SITE (445)..(445): Xaa at position 445 is Trp, Tyr, Phe, Met, His, Ile, Leu Val, Ala, or Gly
  SITE (447)..(447): Xaa at position 447 is Ala, Gly, or Pro
  SITE (458)..(458): Xaa at position 458 is Ile, Ala, Val, Leu, or Gly
  SITE (459)..(459): Xaa at position 459 is Val, Ala, Gly, Leu, or Ile
  SITE (461)..(461): Xaa at position 461 is Cys, Ala, Val, Gly, Ser, or Thr
  SITE (466)..(466): Xaa at position 466 is Cys, Ala, Val, Gly, Ser, or Thr
  SITE (469)..(469): Xaa at position 469 is Leu, Ala, Val, Gly, or Ile
  SITE (480)..(480): Xaa at position 480 is Leu, Ala, Val, Gly, or Ile
  SITE (482)..(482): Xaa at position 482 is Ala, Gly, or Pro
  SITE (503)..(503): Xaa at position 503 is Ala, Gly, or Pro
  SITE (504)..(504): Xaa at position 504 is Ile, Ala, Val, Leu, or Gly
  SITE (515)..(515): Xaa at position 515 is Val, Ala, Gly, Leu, or Ile
  SITE (521)..(521): Xaa at position 521 is Ile, Ala, Val, Leu, or Gly
  SITE (542)..(542): Xaa at position 542 is Ile, Ala, Val, Leu, or Gly
  SITE (551)..(551): Xaa at position 551 is Leu, Ala, Val, Gly, or Ile
  SITE (574)..(574): Xaa at position 574 is Val, Ala, Gly, Leu, or Ile
  SITE (575)..(575): Xaa at position 575 is Ile, Ala, Val, Leu, or Gly
  SITE (579)..(579): Xaa at position 579 is Phe, Tyr, Met, His, Ile, Leu, Val Ala, or Gly
  SITE (581)..(581): Xaa at position 581 is Leu, Ala, Val, Gly, or Ile
  SITE (584)..(584): Xaa at position 584 is Ile, Ala, Val, Leu, or Gly
  SITE (585)..(585): Xaa at position 585 is Met, Ile, Leu, Val, Ala, or Gly
  SITE (586)..(586): Xaa at position 586 is Tyr, Phe, Met, His, Ile, Leu, Val Ala, or Gly
  SITE (588)..(588): Xaa at position 588 is Val, Ala, Gly, Leu, or Ile
  SITE (589)..(589): Xaa at position 589 is Phe, Tyr, Met, His, Ile, Leu, Val Ala, or Gly
  SITE (593)..(593): Xaa at position 593 is Phe, Tyr, Met, His, Ile, Leu, Val Ala, or Gly
  SITE (605)..(605): Xaa at position 605 is Phe, Tyr, Met, His, Ile, Leu, Val Ala, or Gly
  SITE (607)..(607): Xaa at position 607 is Phe, Tyr, Met, His, Ile, Leu, Val Ala, or Gly
  SITE (611)..(611): Xaa at position 611 is Val, Ala, Gly, Leu, or Ile
  SITE (612)..(612): Xaa at position 612 is Ala, Gly, or Pro
  SITE (616)..(616): Xaa at position 616 is Cys, Ala, Val, Gly, Ser, or Thr
  SITE (618)..(618): Xaa at position 618 is Val, Ala, Gly, Leu, or Ile
  SITE (619)..(619): Xaa at position 619 is Leu, Ala, Val, Gly, or Ile
  SITE (627)..(627): Xaa at position 627 is Phe, Tyr, Met, His, Ile, Leu, Val Ala, or Gly
  SITE (634)..(634): Xaa at position 634 is Leu, Ala, Val, Gly, or Ile
  SITE (638)..(638): Xaa at position 638 is Leu, Ala, Val, Gly, or Ile
  SITE (643)..(643): Xaa at position 643 is Val, Ala, Gly, Leu, or Ile
  SITE (658)..(658): Xaa at position 658 is Tyr, Phe, Met, His, Ile, Leu, Val Ala, or Gly
  SITE (666)..(666): Xaa at position 666 is Val, Ala, Gly, Leu, or Ile
  SITE (667)..(667): Xaa at position 667 is Ala, Gly, or Pro
  SITE (668)..(668): Xaa at position 668 is Phe, Tyr, Met, His, Ile, Leu, Val Ala, or Gly
  SITE (670)..(670): Xaa at position 670 is Val, Ala, Gly, Leu, or Ile
  SITE (672)..(672): Xaa at position 672 is Ile, Ala, Val, Leu, or Gly
  SITE (684)..(684): Xaa at position 684 is Ala, Gly, or Pro
  SITE (686)..(686): Xaa at position 686 is Leu, Ala, Val, Gly, or Ile
  SITE (695)..(695): Xaa at position 695 is Ile, Ala, Val, Leu, or Gly
  SITE (697)..(697): Xaa at position 697 is Ala, Gly, or Pro
  SITE (702)..(702): Xaa at position 702 is Leu, Ala, Val, Gly, or Ile
  SITE (705)..(705): Xaa at position 705 is Ile, Ala, Val, Leu, or Gly
  SITE (706)..(706): Xaa at position 706 is Val, Ala, Gly, Leu, or Ile
  SITE (719)..(719): Xaa at position 719 is Val, Ala, Gly, Leu, or Ile
MPSPRPVLLRGARAALLLLLPPRLLARPSLLLRRSLSAASCPPISLPAAASRSSMDGAGAEEVLAPLRLAVRQQGDLVRKLKEDKAPQVDVDKAVAELKARKRVLEAKELALQPKDDIVDRAKXEDTXKRRFXYDQXFAIYGGVSGLYDFGPVGCAXKNNXIQTXRQHXIQEEQILEIDCTMLTPEPVXKTSGHVDKFADFMXKDVKNGECFRXDHLXKAHXQKLMSDKKCSVEKKSEXESVLAQLDNYGQQEXADLFVNYNVKSPITGNDLSPPVSFNXMFKTFIGPGGNMPGYLRPETXQGXXLNXKRLLEFNQGKLPFAXXQIGNSFRNEISPRSGLIRVREFTMXEXEHXVDPSEKDHPKFQNXXDLHXYLYSAKXQVSGQSXRKMRXGDXVEQGVXNNTXXGYXXGRXYLXXTKXGISPDKXRXRQHMENEMAHYACDCXDXESKTSYGWIEXXGXADRSXYDXSCHARATKVPXVXEKPLKEPKTVNVVQFEPSKGXXGKAYKKDAKLXMEYLAXCDECYITEMEMLLNEKGEFTXETEGKTFQXTKDMINVKRFQKTLYVEEVVPNXXEPSXGXGRXXXTXXEHTXHVREGDEQRTFXSXPAVXXPFKXSXXPLSQNQEXMPFVKEXSEAXTRHGXSHKVDDSSGSIGRRXARTDEIGXXXGXTXDFDTVNKTPHTXTXRDRDSMRQXRXEISEXPSXXQDLANGNITWADXEARYPLFEGQETGKKETIEE

SEQ ID NO: 503 - protein, 329 aa, Homo sapiens
  SITE (36)..(36): Xaa at position 36 is Ala, Gly, or Pro
  SITE (38)..(38): Xaa at position 38 is Leu, Ala, Val, Gly, or Ile
  SITE (40)..(40): Xaa at position 40 is Cys, Ala, Val, Gly, Ser, or Thr
  SITE (53)..(53): Xaa at position 53 is Leu, Ala, Val, Gly, or Ile
  SITE (54)..(54): Xaa at position 54 is Val, Ala, Gly, Leu, or Ile
  SITE (55)..(55): Xaa at position 55 is Val, Ala, Gly, Leu, or Ile
  SITE (95)..(95): Xaa at position 95 is Leu, Ala, Val, Gly, or Ile
  SITE (97)..(97): Xaa at position 97 is Leu, Ala, Val, Gly, or Ile
  SITE (100)..(100): Xaa at position 100 is Leu, Ala, Val, Gly, or Ile
  SITE (110)..(110): Xaa at position 110 is Cys, Ala, Val, Gly, Ser, or Thr
  SITE (111)..(111): Xaa at position 111 is Ile, Ala, Val, Leu, or Gly
  SITE (112)..(112): Xaa at position 112 is Ile, Ala, Val, Leu, or Gly
MDPQCTMGLSNILFVMAFLLSGAAPLKIQAYFNETXDXPXQFANSQNQSLSEXXXFWQDQENLVLNEVYLGKEKFDSVHSKYMGRTSFDSDSWTXRXHNXQIKDKGLYQXXXHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 504 - protein, 906 aa, Homo sapiens
  SITE (25)..(25): Xaa at position 25 is Ile, Ala, Val, Leu, or Gly
  SITE (27)..(27): Xaa at position 27 is Ile, Ala, Val, Leu, or Gly
  SITE (30)..(30): Xaa at position 30 is Leu, Ala, Val, Gly, or Ile
  SITE (31)..(31): Xaa at position 31 is Phe, Tyr, Met, His, Ile, Leu, Val Ala, or Gly
  SITE (41)..(41): Xaa at position 41 is Ala, Gly, or Pro
  SITE (42)..(42): Xaa at position 42 is Phe, Tyr, Met, His, Ile, Leu, Val Ala, or Gly
  SITE (46)..(46): Xaa at position 46 is Leu, Ala, Val, Gly, or Ile
  SITE (55)..(55): Xaa at position 55 is Leu, Ala, Val, Gly, or Ile
  SITE (70)..(70): Xaa at position 70 is Met, Ile, Leu, Val, Ala, or Gly
  SITE (74)..(74): Xaa at position 74 is Phe, Tyr, Met, His, Ile, Leu, Val Ala, or Gly
  SITE (82)..(82): Xaa at position 82 is Val, Ala, Gly, Leu, or Ile
  SITE (84)..(84): Xaa at position 84 is Ala, Gly, or Pro
  SITE (85)..(85): Xaa at position 85 is Ile, Ala, Val, Leu, or Gly
  SITE (86)..(86): Xaa at position 86 is Phe, Tyr, Met, His, Ile, Leu, Val Ala, or Gly
  SITE (94)..(94): Xaa at position 94 is Val, Ala, Gly, Leu, or Ile
  SITE (97)..(97): Xaa at position 97 is Leu, Ala, Val, Gly, or Ile
  SITE (101)..(101): Xaa at position 101 is Cys, Ala, Val, Gly, Ser, or Thr
  SITE (106)..(106): Xaa at position 106 is Val, Ala, Gly, Leu, or Ile
  SITE (108)..(108): Xaa at position 108 is Phe, Tyr, Met, His, Ile, Leu, Val Ala, or Gly
  SITE (109)..(109): Xaa at position 109 is Ile, Ala, Val, Leu, or Gly
  SITE (113)..(113): Xaa at position 113 is Phe, Tyr, Met, His, Ile, Leu, Val Ala, or Gly
  SITE (121)..(121): Xaa at position 121 is Phe, Tyr, Met, His, Ile, Leu, Val Ala, or Gly
  SITE (122)..(122): Xaa at position 122 is Val, Ala, Gly, Leu, or Ile
  SITE (123)..(123): Xaa at position 123 is Leu, Ala, Val, Gly, or Ile
  SITE (125)..(125): Xaa at position 125 is Leu, Ala, Val, Gly, or Ile
  SITE (129)..(129): Xaa at position 129 is Leu, Ala, Val, Gly, or Ile
  SITE (132)..(132): Xaa at position 132 is Ala, Gly, or Pro
  SITE (133)..(133): Xaa at position 133 is Leu, Ala, Val, Gly, or Ile
  SITE (136)..(136): Xaa at position 136 is Ile, Ala, Val, Leu, or Gly
  SITE (137)..(137): Xaa at position 137 is Ile, Ala, Val, Leu, or Gly
  SITE (145)..(145): Xaa at position 145 is Phe, Tyr, Met, His, Ile, Leu, Val Ala, or Gly
  SITE (146)..(146): Xaa at position 146 is Val, Ala, Gly, Leu, or Ile
  SITE (147)..(147): Xaa at position 147 is Tyr, Phe, Met, His, Ile, Leu, Val Ala, or Gly
  SITE (161)..(161): Xaa at position 161 is Val, Ala, Gly, Leu, or Ile
  SITE (165)..(165): Xaa at position 165 is Ala, Gly, or Pro
  SITE (177)..(177): Xaa at position 177 is Ile, Ala, Val, Leu, or Gly
  SITE (192)..(192): Xaa at position 192 is Leu, Ala, Val, Gly, or Ile
  SITE (200)..(200): Xaa at position 200 is Val, Ala, Gly, Leu, or Ile
  SITE (201)..(201): Xaa at position 201 is Val, Ala, Gly, Leu, or Ile
  SITE (202)..(202): Xaa at position 202 is Val, Ala, Gly, Leu, or Ile
  SITE (204)..(204): Xaa at position 204 is Cys, Ala, Val, Gly, Ser, or Thr
  SITE (209)..(209): Xaa at position 209 is Leu, Ala, Val, Gly, or Ile
  SITE (213)..(213): Xaa at position 213 is Leu, Ala, Val, Gly, or Ile
  SITE (216)..(216): Xaa at position 216 is Ile, Ala, Val, Leu, or Gly
  SITE (217)..(217): Xaa at position 217 is Ile, Ala, Val, Leu, or Gly
  SITE (228)..(228): Xaa at position 228 is Tyr, Phe, Met, His, Ile, Leu, Val Ala, or Gly
  SITE (229)..(229): Xaa at position 229 is Ile, Ala, Val, Leu, or Gly
  SITE (230)..(230): Xaa at position 230 is Leu, Ala, Val, Gly, or Ile
  SITE (231)..(231): Xaa at position 231 is Ala, Gly, or Pro
  SITE (233)..(233): Xaa at position 233 is Leu, Ala, Val, Gly, or Ile
  SITE (235)..(235): Xaa at position 235 is Phe, Tyr, Met, His, Ile, Leu, Val Ala, or Gly
  SITE (243)..(243): Xaa at position 243 is Phe, Tyr, Met, His, Ile, Leu, Val Ala, or Gly
  SITE (248)..(248): Xaa at position 248 is Ala, Gly, or Pro
  SITE (250)..(250): Xaa at position 250 is Val, Ala, Gly, Leu, or Ile
  SITE (253)..(253): Xaa at position 253 is Phe, Tyr, Met, His, Ile, Leu, Val Ala, or Gly
  SITE (256)..(256): Xaa at position 256 is Val, Ala, Gly, Leu, or Ile
  SITE (266)..(266): Xaa at position 266 is Ile, Ala, Val, Leu, or Gly
  SITE (270)..(270): Xaa at position 270 is Trp, Tyr, Phe, Met, His, Ile, Leu Val, Ala, or Gly
  SITE (281)..(281): Xaa at position 281 is Val, Ala, Gly, Leu, or Ile
  SITE (291)..(291): Xaa at position 291 is Ala, Gly, or Pro
  SITE (292)..(292): Xaa at position 292 is Leu, Ala, Val, Gly, or Ile
  SITE (297)..(297): Xaa at position 297 is Val, Ala, Gly, Leu, or Ile
  SITE (299)..(299): Xaa at position 299 is Val, Ala, Gly, Leu, or Ile
  SITE (300)..(300): Xaa at position 300 is Met, Ile, Leu, Val, Ala, or Gly
  SITE (303)..(303): Xaa at position 303 is Ala, Gly, or Pro
  SITE (304)..(304): Xaa at position 304 is Phe, Tyr, Met, His, Ile, Leu, Val Ala, or Gly
  SITE (307)..(307): Xaa at position 307 is Leu, Ala, Val, Gly, or Ile
  SITE (320)..(320): Xaa at position 320 is Ala, Gly, or Pro
  SITE (337)..(337): Xaa at position 337 is Ile, Ala, Val, Leu, or Gly
  SITE (340)..(340): Xaa at position 340 is Ala, Gly, or Pro
  SITE (341)..(341): Xaa at position 341 is Leu, Ala, Val, Gly, or Ile
  SITE (349)..(349): Xaa at position 349 is Leu, Ala, Val, Gly, or Ile
  SITE (353)..(353): Xaa at position 353 is Val, Ala, Gly, Leu, or Ile
  SITE (366)..(366): Xaa at position 366 is Leu, Ala, Val, Gly, or Ile
  SITE (368)..(368): Xaa at position 368 is Val, Ala, Gly, Leu, or Ile
  SITE (409)..(409): Xaa at position 409 is Tyr, Phe, Met, His, Ile, Leu, Val Ala, or Gly
  SITE (410)..(410): Xaa at position 410 is Ile, Ala, Val, Leu, or Gly
  SITE (411)..(411): Xaa at position 411 is Val, Ala, Gly, Leu, or Ile
  SITE (419)..(419): Xaa at position 419 is Tyr, Phe, Met, His, Ile, Leu, Val Ala, or Gly
  SITE (420)..(420): Xaa at position 420 is Val, Ala, Gly, Leu, or Ile
  SITE (422)..(422): Xaa at position 422 is Leu, Ala, Val, Gly, or Ile
  SITE (429)..(429): Xaa at position 429 is Phe, Tyr, Met, His, Ile, Leu, Val Ala, or Gly
  SITE (435)..(435): Xaa at position 435 is Tyr, Phe, Met, His, Ile, Leu, Val Ala, or Gly
  SITE (438)..(438): Xaa at position 438 is Tyr, Phe, Met, His, Ile, Leu, Val Ala, or Gly
  SITE (439)..(439): Xaa at position 439 is Cys, Ala, Val, Gly, Ser, or Thr
  SITE (440)..(440): Xaa at position 440 is Val, Ala, Gly, Leu, or Ile
  SITE (442)..(442): Xaa at position 442 is Leu, Ala, Val, Gly, or Ile
  SITE (443)..(443): Xaa at position 443 is Ala, Gly, or Pro
  SITE (444)..(444): Xaa at position 444 is Ala, Gly, or Pro
  SITE (446)..(446): Xaa at position 446 is Ile, Ala, Val, Leu, or Gly
  SITE (447)..(447): Xaa at position 447 is Ala, Gly, or Pro
  SITE (456)..(456): Xaa at position 456 is Leu, Ala, Val, Gly, or Ile
  SITE (466)..(466): Xaa at position 466 is Ala, Gly, or Pro
  SITE (477)..(477): Xaa at position 477 is Met, Ile, Leu, Val, Ala, or Gly
  SITE (478)..(478): Xaa at position 478 is Val, Ala, Gly, Leu, or Ile
  SITE (481)..(481): Xaa at position 481 is Leu, Ala, Val, Gly, or Ile
  SITE (486)..(486): Xaa at position 486 is Ala, Gly, or Pro
  SITE (488)..(488): Xaa at position 488 is Val, Ala, Gly, Leu, or Ile
  SITE (489)..(489): Xaa at position 489 is Ala, Gly, or Pro
  SITE (490)..(490): Xaa at position 490 is Val, Ala, Gly, Leu, or Ile
  SITE (491)..(491): Xaa at position 491 is Ala, Gly, or Pro
  SITE (493)..(493): Xaa at position 493 is Leu, Ala, Val, Gly, or Ile
  SITE (495)..(495): Xaa at position 495 is Ile, Ala, Val, Leu, or Gly
  SITE (503)..(503): Xaa at position 503 is Ile, Ala, Val, Leu, or Gly
  SITE (509)..(509): Xaa at position 509 is Phe, Tyr, Met, His, Ile, Leu, Val Ala, or Gly
  SITE (512)..(512): Xaa at position 512 is Leu, Ala, Val, Gly, or Ile
  SITE (514)..(514): Xaa at position 514 is Ile, Ala, Val, Leu, or Gly
  SITE (516)..(516): Xaa at position 516 is Ile, Ala, Val, Leu, or Gly
  SITE (517)..(517): Xaa at position 517 is Met, Ile, Leu, Val, Ala, or Gly
  SITE (518)..(518): Xaa at position 518 is Ile, Ala, Val, Leu, or Gly
  SITE (647)..(647): Xaa at position 647 is Ile, Ala, Val, Leu, or Gly
  SITE (653)..(653): Xaa at position 653 is Leu, Ala, Val, Gly, or Ile
  SITE (654)..(654): Xaa at position 654 is Ala, Gly, or Pro
  SITE (661)..(661): Xaa at position 661 is Tyr, Phe, Met, His, Ile, Leu, Val Ala, or Gly
  SITE (672)..(672): Xaa at position 672 is Phe, Tyr, Met, His, Ile, Leu, Val Ala, or Gly
  SITE (673)..(673): Xaa at position 673 is Phe, Tyr, Met, His, Ile, Leu, Val Ala, or Gly
  SITE (684)..(684): Xaa at position 684 is Met, Ile, Leu, Val, Ala, or Gly
  SITE (687)..(687): Xaa at position 687 is Tyr, Phe, Met, His, Ile, Leu, Val Ala, or Gly
  SITE (688)..(688): Xaa at position 688 is Met, Ile, Leu, Val, Ala, or Gly
  SITE (695)..(695): Xaa at position 695 is Val, Ala, Gly, Leu, or Ile
  SITE (697)..(697): Xaa at position 697 is Val, Ala, Gly, Leu, or Ile
  SITE (704)..(704): Xaa at position 704 is Met, Ile, Leu, Val, Ala, or Gly
  SITE (707)..(707): Xaa at position 707 is Val, Ala, Gly, Leu, or Ile
  SITE (714)..(714): Xaa at position 714 is Tyr, Phe, Met, His, Ile, Leu, Val Ala, or Gly
  SITE (715)..(715): Xaa at position 715 is Ala, Gly, or Pro
  SITE (716)..(716): Xaa at position 716 is Tyr, Phe, Met, His, Ile, Leu, Val Ala, or Gly
  SITE (717)..(717): Xaa at position 717 is Leu, Ala, Val, Gly, or Ile
  SITE (718)..(718): Xaa at position 718 is Leu, Ala, Val, Gly, or Ile
  SITE (725)..(725): Xaa at position 725 is Tyr, Phe, Met, His, Ile, Leu, Val Ala, or Gly
  SITE (746)..(746): Xaa at position 746 is Tyr, Phe, Met, His, Ile, Leu, Val Ala, or Gly
  SITE (748)..(748): Xaa at position 748 is Ile, Ala, Val, Leu, or Gly
  SITE (749)..(749): Xaa at position 749 is Ala, Gly, or Pro
  SITE (760)..(760): Xaa at position 760 is Val, Ala, Gly, Leu, or Ile
  SITE (763)..(763): Xaa at position 763 is Ala, Gly, or Pro
  SITE (764)..(764): Xaa at position 764 is Val, Ala, Gly, Leu, or Ile
  SITE (765)..(765): Xaa at position 765 is Leu, Ala, Val, Gly, or Ile
  SITE (767)..(767): Xaa at position 767 is Leu, Ala, Val, Gly, or Ile
  SITE (772)..(772): Xaa at position 772 is Leu, Ala, Val, Gly, or Ile
  SITE (773)..(773): Xaa at position 773 is Leu, Ala, Val, Gly, or Ile
  SITE (776)..(776): Xaa at position 776 is Leu, Ala, Val, Gly, or Ile
  SITE (780)..(780): Xaa at position 780 is Trp, Tyr, Phe, Met, His, Ile, Leu Val, Ala, or Gly
  SITE (781)..(781): Xaa at position 781 is Trp, Tyr, Phe, Met, His, Ile, Leu Val, Ala, or Gly
MQHIFAFFCTGFLGAVVGANFPNNXQXGGXXPNQQSQEHAXXRFAXSQLTEPPKXLPQIDIVNISDSFEXTYRXCSQFSKGXYXXXGFYERRTXNMXTSFXGALHXCXXTPSXPVDTSNQXXXQXRPEXQDXXISXXDHYKWQKXXXIYDADRGLSVLQKXLDTXAEKNWQVTAVNXLTTTEEGYRMLFQDXEKKKERLXXXDXESERXNAIXGQXXKLEKNGIGYHXXXXNXGXMDIDLNKXKESGXNXTGXQLXNYTDTIPAKXMQQXKNSDARDHTRXDWKRPKYTSXXTYDGXKXXAEXXQSXRRQRIDISRRGNXGDCLANPAVPWGQGIDXQRXXQQVRFEGXTGNXQFNEKGRRTNYTXHXIEMKHDGIRKIGYWNEDDKFVPAATDAQAGGDNSSVQNRTXXXTTILEDPXXMXKKNANQXEGNDRXEGXXXEXXXEXXKHVGYSYRXEIVSDGKYGXRDPDTKAWNGXXGEXVYGRXDXXXXPXTXTLVREEVXDFSKPXMSXGXSXXXKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPXESAEDXXKQTEIAXGTLEAGSTKEXXRRSKIAVFEKXWTXXKSAEPSXFXRTTEEGXIRXRKSKGKXXXXXESTMNEXIEQRKPCDTMKVGGNLDSKGXGXXTPKGSALRNPXNLXXXKXNEQGXXDKXKNKXXYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 505 - protein, 894 aa, Homo sapiens
  SITE (34)..(34): Xaa at position 34 is Ile, Ala, Val, Leu, or Gly
  SITE (36)..(36): Xaa at position 36 is Ile, Ala, Val, Leu, or Gly
  SITE (39)..(39): Xaa at position 39 is Leu, Ala, Val, Gly, or Ile
  SITE (40)..(40): Xaa at position 40 is Phe, Tyr, Met, His, Ile, Leu, Val Ala, or Gly
  SITE (50)..(50): Xaa at position 50 is Ala, Gly, or Pro
  SITE (51)..(51): Xaa at position 51 is Phe, Tyr, Met, His, Ile, Leu, Val Ala, or Gly
  SITE (55)..(55): Xaa at position 55 is Val, Ala, Gly, Leu, or Ile
  SITE (69)..(69): Xaa at position 69 is Phe, Tyr, Met, His, Ile, Leu, Val Ala, or Gly
  SITE (71)..(71): Xaa at position 71 is Leu, Ala, Val, Gly, or Ile
  SITE (86)..(86): Xaa at position 86 is Val, Ala, Gly, Leu, or Ile
  SITE (90)..(90): Xaa at position 90 is Phe, Tyr, Met, His, Ile, Leu, Val Ala, or Gly
  SITE (98)..(98): Xaa at position 98 is Val, Ala, Gly, Leu, or Ile
  SITE (100)..(100): Xaa at position 100 is Ala, Gly, or Pro
  SITE (101)..(101): Xaa at position 101 is Ile, Ala, Val, Leu, or Gly
  SITE (102)..(102): Xaa at position 102 is Phe, Tyr, Met, His, Ile, Leu, Val Ala, or Gly
  SITE (110)..(110): Xaa at position 110 is Met, Ile, Leu, Val, Ala, or Gly
  SITE (113)..(113): Xaa at position 113 is Leu, Ala, Val, Gly, or Ile
  SITE (117)..(117): Xaa at position 117 is Cys, Ala, Val, Gly, Ser, or Thr
  SITE (124)..(124): Xaa at position 124 is Phe, Tyr, Met, His, Ile, Leu, Val Ala, or Gly
  SITE (125)..(125): Xaa at position 125 is Val, Ala, Gly, Leu, or Ile
  SITE (129)..(129): Xaa at position 129 is Phe, Tyr, Met, His, Ile, Leu, Val Ala, or Gly
  SITE (137)..(137): Xaa at position 137 is Phe, Tyr, Met, His, Ile, Leu, Val Ala, or Gly
  SITE (138)..(138): Xaa at position 138 is Val, Ala, Gly, Leu, or Ile
  SITE (139)..(139): Xaa at position 139 is Ile, Ala, Val, Leu, or Gly
  SITE (141)..(141): Xaa at position 141 is Met, Ile, Leu, Val, Ala, or Gly
  SITE (145)..(145): Xaa at position 145 is Leu, Ala, Val, Gly, or Ile
  SITE (148)..(148): Xaa at position 148 is Ala, Gly, or Pro
  SITE (149)..(149): Xaa at position 149 is Ile, Ala, Val, Leu, or Gly
  SITE (152)..(152): Xaa at position 152 is Leu, Ala, Val, Gly, or Ile
  SITE (153)..(153): Xaa at position 153 is Leu, Ala, Val, Gly, or Ile
  SITE (161)..(161): Xaa at position 161 is Phe, Tyr, Met, His, Ile, Leu, Val Ala, or Gly
  SITE (162)..(162): Xaa at position 162 is Val, Ala, Gly, Leu, or Ile
  SITE (163)..(163): Xaa at position 163 is Tyr, Phe, Met, His, Ile, Leu, Val Ala, or Gly
  SITE (177)..(177): Xaa at position 177 is Ile, Ala, Val, Leu, or Gly
  SITE (181)..(181): Xaa at position 181 is Ala, Gly, or Pro
  SITE (193)..(193): Xaa at position 193 is Val, Ala, Gly, Leu, or Ile
  SITE (209)..(209): Xaa at position 209 is Met, Ile, Leu, Val, Ala, or Gly
  SITE (217)..(217): Xaa at position 217 is Tyr, Phe, Met, His, Ile, Leu, Val Ala, or Gly
  SITE (218)..(218): Xaa at position 218 is Leu, Ala, Val, Gly, or Ile
  SITE (219)..(219): Xaa at position 219 is Ile, Ala, Val, Leu, or Gly
  SITE (221)..(221): Xaa at position 221 is Cys, Ala, Val, Gly, Ser, or Thr
  SITE (226)..(226): Xaa at position 226 is Ile, Ala, Val, Leu, or Gly
  SITE (230)..(230): Xaa at position 230 is Leu, Ala, Val, Gly, or Ile
  SITE (233)..(233): Xaa at position 233 is Val, Ala, Gly, Leu, or Ile
  SITE (234)..(234): Xaa at position 234 is Val, Ala, Gly, Leu, or Ile
  SITE (245)..(245): Xaa at position 245 is Tyr, Phe, Met, His, Ile, Leu, Val Ala, or Gly
  SITE (246)..(246): Xaa at position 246 is Met, Ile, Leu, Val, Ala, or Gly
  SITE (247)..(247): Xaa at position 247 is Leu, Ala, Val, Gly, or Ile
  SITE (248)..(248): Xaa at position 248 is Ala, Gly, or Pro
  SITE (250)..(250): Xaa at position 250 is Leu, Ala, Val, Gly, or Ile
  SITE (252)..(252): Xaa at position 252 is Phe, Tyr, Met, His, Ile, Leu, Val Ala, or Gly
  SITE (260)..(260): Xaa at position 260 is Val, Ala, Gly, Leu, or Ile
  SITE (265)..(265): Xaa at position 265 is Ala, Gly, or Pro
  SITE (267)..(267): Xaa at position 267 is Ile, Ala, Val, Leu, or Gly
  SITE (270)..(270): Xaa at position 270 is Phe, Tyr, Met, His, Ile, Leu, Val Ala, or Gly
  SITE (273)..(273): Xaa at position 273 is Val, Ala, Gly, Leu, or Ile
  SITE (280)..(280): Xaa at position 280 is Val, Ala, Gly, Leu, or Ile
  SITE (283)..(283): Xaa at position 283 is Phe, Tyr, Met, His, Ile, Leu, Val Ala, or Gly
  SITE (287)..(287): Xaa at position 287 is Trp, Tyr, Phe, Met, His, Ile, Leu Val, Ala, or Gly
  SITE (298)..(298): Xaa at position 298 is Ala, Gly, or Pro
  SITE (301)..(301): Xaa at position 301 is Ala, Gly, or Pro
  SITE (303)..(303): Xaa at position 303 is Leu, Ala, Val, Gly, or Ile
  SITE (308)..(308): Xaa at position 308 is Ala, Gly, or Pro
  SITE (309)..(309): Xaa at position 309 is Leu, Ala, Val, Gly, or Ile
  SITE (313)..(313): Xaa at position 313 is Ala, Gly, or Pro
  SITE (314)..(314): Xaa at position 314 is Ile, Ala, Val, Leu, or Gly
  SITE (316)..(316): Xaa at position 316 is Val, Ala, Gly, Leu, or Ile
  SITE (317)..(317): Xaa at position 317 is Ile, Ala, Val, Leu, or Gly
  SITE (320)..(320): Xaa at position 320 is Ala, Gly, or Pro
  SITE (321)..(321): Xaa at position 321 is Phe, Tyr, Met, His, Ile, Leu, Val Ala, or Gly
  SITE (324)..(324): Xaa at position 324 is Leu, Ala, Val, Gly, or Ile
  SITE (337)..(337): Xaa at position 337 is Ala, Gly, or Pro
  SITE (354)..(354): Xaa at position 354 is Ile, Ala, Val, Leu, or Gly
  SITE (357)..(357): Xaa at position 357 is Ala, Gly, or Pro
  SITE (358)..(358): Xaa at position 358 is Leu, Ala, Val, Gly, or Ile
  SITE (366)..(366): Xaa at position 366 is Met, Ile, Leu, Val, Ala, or Gly
  SITE (370)..(370): Xaa at position 370 is Ile, Ala, Val, Leu, or Gly
  SITE (383)..(383): Xaa at position 383 is Ile, Ala, Val, Leu, or Gly
  SITE (385)..(385): Xaa at position 385 is Val, Ala, Gly, Leu, or Ile
  SITE (425)..(425): Xaa at position 425 is Ile, Ala, Val, Leu, or Gly
  SITE (426)..(426): Xaa at position 426 is Val, Ala, Gly, Leu, or Ile
  SITE (427)..(427): Xaa at position 427 is Val, Ala, Gly, Leu, or Ile
  SITE (435)..(435): Xaa at position 435 is Tyr, Phe, Met, His, Ile, Leu, Val Ala, or Gly
  SITE (436)..(436): Xaa at position 436 is Val, Ala, Gly, Leu, or Ile
  SITE (438)..(438): Xaa at position 438 is Tyr, Phe, Met, His, Ile, Leu, Val Ala, or Gly
  SITE (445)..(445): Xaa at position 445 is Leu, Ala, Val, Gly, or Ile
  SITE (451)..(451): Xaa at position 451 is Tyr, Phe, Met, His, Ile, Leu, Val Ala, or Gly
  SITE (454)..(454): Xaa at position 454 is Tyr, Phe, Met, His, Ile, Leu, Val Ala, or Gly
  SITE (455)..(455): Xaa at position 455 is Cys, Ala, Val, Gly, Ser, or Thr
  SITE (456)..(456): Xaa at position 456 is Val, Ala, Gly, Leu, or Ile
  SITE (458)..(458): Xaa at position 458 is Leu, Ala, Val, Gly, or Ile
  SITE (459)..(459): Xaa at position 459 is Ala, Gly, or Pro
  SITE (460)..(460): Xaa at position 460 is Tyr, Phe, Met, His, Ile, Leu, Val Ala, or Gly
  SITE (462)..(462): Xaa at position 462 is Ile, Ala, Val, Leu, or Gly
  SITE (463)..(463): Xaa at position 463 is Ala, Gly, or Pro
  SITE (472)..(472): Xaa at position 472 is Leu, Ala, Val, Gly, or Ile
  SITE (482)..(482): Xaa at position 482 is Ala, Gly, or Pro
  SITE (493)..(493): Xaa at position 493 is Met, Ile, Leu, Val, Ala, or Gly
  SITE (494)..(494): Xaa at position 494 is Val, Ala, Gly, Leu, or Ile
  SITE (497)..(497): Xaa at position 497 is Leu, Ala, Val, Gly, or Ile
  SITE (502)..(502): Xaa at position 502 is Ala, Gly, or Pro
  SITE (504)..(504): Xaa at position 504 is Ile, Ala, Val, Leu, or Gly
  SITE (505)..(505): Xaa at position 505 is Ala, Gly, or Pro
  SITE (506)..(506): Xaa at position 506 is Val, Ala, Gly, Leu, or Ile
  SITE (507)..(507): Xaa at position 507 is Ala, Gly, or Pro
  SITE (509)..(509): Xaa at position 509 is Leu, Ala, Val, Gly, or Ile
  SITE (511)..(511): Xaa at position 511 is Ile, Ala, Val, Leu, or Gly
  SITE (519)..(519): Xaa at position 519 is Ile, Ala, Val, Leu, or Gly
  SITE (525)..(525): Xaa at position 525 is Phe, Tyr, Met, His, Ile, Leu, Val Ala, or Gly
  SITE (528)..(528): Xaa at position 528 is Leu, Ala, Val, Gly, or Ile
  SITE (530)..(530): Xaa at position 530 is Ile, Ala, Val, Leu, or Gly
  SITE (532)..(532): Xaa at position 532 is Ile, Ala, Val, Leu, or Gly
  SITE (533)..(533): Xaa at position 533 is Met, Ile, Leu, Val, Ala, or Gly
  SITE (534)..(534): Xaa at position 534 is Ile, Ala, Val, Leu, or Gly
  SITE (665)..(665): Xaa at position 665 is Ile, Ala, Val, Leu, or Gly
  SITE (671)..(671): Xaa at position 671 is Leu, Ala, Val, Gly, or Ile
  SITE (679)..(679): Xaa at position 679 is Tyr, Phe, Met, His, Ile, Leu, Val Ala, or Gly
  SITE (690)..(690): Xaa at position 690 is Phe, Tyr, Met, His, Ile, Leu, Val Ala, or Gly
  SITE (691)..(691): Xaa at position 691 is Phe, Tyr, Met, His, Ile, Leu, Val Ala, or Gly
  SITE (702)..(702): Xaa at position 702 is Met, Ile, Leu, Val, Ala, or Gly
  SITE (705)..(705): Xaa at position 705 is Tyr, Phe, Met, His, Ile, Leu, Val Ala, or Gly
  SITE (706)..(706): Xaa at position 706 is Met, Ile, Leu, Val, Ala, or Gly
  SITE (713)..(713): Xaa at position 713 is Val, Ala, Gly, Leu, or Ile
  SITE (722)..(722): Xaa at position 722 is Val, Ala, Gly, Leu, or Ile
  SITE (725)..(725): Xaa at position 725 is Val, Ala, Gly, Leu, or Ile
  SITE (732)..(732): Xaa at position 732 is Phe, Tyr, Met, His, Ile, Leu, Val Ala, or Gly
  SITE (733)..(733): Xaa at position 733 is Ala, Gly, or Pro
  SITE (734)..(734): Xaa at position 734 is Phe, Tyr, Met, His, Ile, Leu, Val Ala, or Gly
  SITE (735)..(735): Xaa at position 735 is Leu, Ala, Val, Gly, or Ile
  SITE (736)..(736): Xaa at position 736 is Leu, Ala, Val, Gly, or Ile
  SITE (743)..(743): Xaa at position 743 is Tyr, Phe, Met, His, Ile, Leu, Val Ala, or Gly
  SITE (764)..(764): Xaa at position 764 is Tyr, Phe, Met, His, Ile, Leu, Val Ala, or Gly
  SITE (766)..(766): Xaa at position 766 is Val, Ala, Gly, Leu, or Ile
  SITE (767)..(767): Xaa at position 767 is Ala, Gly, or Pro
  SITE (778)..(778): Xaa at position 778 is Val, Ala, Gly, Leu, or Ile
  SITE (781)..(781): Xaa at position 781 is Ala, Gly, or Pro
  SITE (782)..(782): Xaa at position 782 is Val, Ala, Gly, Leu, or Ile
  SITE (783)..(783): Xaa at position 783 is Leu, Ala, Val, Gly, or Ile
  SITE (785)..(785): Xaa at position 785 is Leu, Ala, Val, Gly, or Ile
  SITE (790)..(790): Xaa at position 790 is Leu, Ala, Val, Gly, or Ile
  SITE (791)..(791): Xaa at position 791 is Leu, Ala, Val, Gly, or Ile
  SITE (794)..(794): Xaa at position 794 is Leu, Ala, Val, Gly, or Ile
  SITE (798)..(798): Xaa at position 798 is Trp, Tyr, Phe, Met, His, Ile, Leu Val, Ala, or Gly
  SITE (799)..(799): Xaa at position 799 is Trp, Tyr, Phe, Met, His, Ile, Leu Val, Ala, or Gly
MARQKKMGQSVLRAVFFLVLGLLGHSHGGFPNTXSXGGXXMRNTVQEHSXXRFAXQLYNTNQNTTEKPXHXNYHVDHLDSSNSFSXTNAXCSQFSRGXYXXXGFYDQMSXNTXTSFXGALHTSXXTPSXPTDADVQXXXQXRPAXKGXXLSXXGHYKWEKXXXLYDTERGFSILQAXMEAXVQNNWQVTARSXGNIKDVQEFRRIIEEXDRRQEKRXXXDXEVERXNTIXEQXXILGKHSRGYHXXXXNXGXTDILLERXMHGGXNXTGXQIXNNENPMXQQXIQRXVRLDEREFPEXKNXPXKYTSXXTHDXXLXXAEXXRYXRRQRVDVSRRGSXGDCLANPAVPWSQGIDXERXXKMVQVQGXTGNXQFDTYGRRTNYTXDXYEMKVSGSRKAGYWNEYERFVPFSDQQISNDSASSENRTXXXTTILESPXXMXKKNHEQXEGNERXEGXXXDXXXEXXKHVRIKYKXSIVGDGKYGXRDPETKIWNGXXGEXVYGRXDXXXXPXTXTLVREEVXDFSKPXMSXGXSXXXKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPXESAEDXAKQTEIAXGTLDSGSTKEXXRRSKIAVYEKXWSXXKSAEPSXFTKTTADGXARXRKSKGKXXXXXESTMNEXIEQRKPCDTMKVGGNLDSKGXGXXTPKGSALRNAXNLXXXKXNEQGXXDKXKNKXXYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 506 - protein, 1068 aa, Homo sapiens
  SITE (16)..(16): Xaa at position 16 is Met, Ile, Leu, Val, Ala, or Gly
  SITE (21)..(21): Xaa at position 21 is Leu, Ala, Val, Gly, or Ile
  SITE (22)..(22): Xaa at position 22 is Val, Ala, Gly, Leu, or Ile
  SITE (24)..(24): Xaa at position 24 is Cys, Ala, Val, Gly, Ser, or Thr
  SITE (25)..(25): Xaa at position 25 is Leu, Ala, Val, Gly, or Ile
  SITE (26)..(26): Xaa at position 26 is Leu, Ala, Val, Gly, or Ile
  SITE (30)..(30): Xaa at position 30 is Met, Ile, Leu, Val, Ala, or Gly
  SITE (31)..(31): Xaa at position 31 is Ile, Ala, Val, Leu, or Gly
  SITE (32)..(32): Xaa at position 32 is Val, Ala, Gly, Leu, or Ile
  SITE (36)..(36): Xaa at position 36 is Cys, Ala, Val, Gly, Ser, or Thr
  SITE (42)..(42): Xaa at position 42 is Leu, Ala, Val, Gly, or Ile
  SITE (45)..(45): Xaa at position 45 is Ile, Ala, Val, Leu, or Gly
  SITE (49)..(49): Xaa at position 49 is Leu, Ala, Val, Gly, or Ile
  SITE (53)..(53): Xaa at position 53 is Ala, Gly, or Pro
  SITE (61)..(61): Xaa at position 61 is Leu, Ala, Val, Gly, or Ile
  SITE (69)..(69): Xaa at position 69 is Ile, Ala, Val, Leu, or Gly
  SITE (70)..(70): Xaa at position 70 is Phe, Tyr, Met, His, Ile, Leu, Val Ala, or Gly
  SITE (71)..(71): Xaa at position 71 is Val, Ala, Gly, Leu, or Ile
  SITE (73)..(73): Xaa at position 73 is Val, Ala, Gly, Leu, or Ile
  SITE (82)..(82): Xaa at position 82 is Phe, Tyr, Met, His, Ile, Leu, Val Ala, or Gly
  SITE (83)..(83): Xaa at position 83 is Phe, Tyr, Met, His, Ile, Leu, Val Ala, or Gly
  SITE (89)..(89): Xaa at position 89 is Leu, Ala, Val, Gly, or Ile
  SITE (92)..(92): Xaa at position 92 is Leu, Ala, Val, Gly, or Ile
  SITE (94)..(94): Xaa at position 94 is Leu, Ala, Val, Gly, or Ile
  SITE (95)..(95): Xaa at position 95 is Phe, Tyr, Met, His, Ile, Leu, Val Ala, or Gly
  SITE (99)..(99): Xaa at position 99 is Leu, Ala, Val, Gly, or Ile
  SITE (101)..(101): Xaa at position 101 is Val, Ala, Gly, Leu, or Ile
  SITE (117)..(117): Xaa at position 117 is Ile, Ala, Val, Leu, or Gly
  SITE (120)..(120): Xaa at position 120 is Ala, Gly, or Pro
  SITE (121)..(121): Xaa at position 121 is Ile, Ala, Val, Leu, or Gly
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (136)..(136): Xaa at position 136 is Val, Ala, Gly, Leu, or Ile
  SITE (139)..(139): Xaa at position 139 is Phe, Tyr, Met, His, Ile, Leu, Val Ala, or Gly
  SITE (143)..(143): Xaa at position 143 is Ile, Ala, Val, Leu, or Gly
  SITE (144)..(144): Xaa at position 144 is Leu, Ala, Val, Gly, or Ile
  SITE (147)..(147): Xaa at position 147 is Cys, Ala, Val, Gly, Ser, or Thr
  SITE (150)..(150): Xaa at position 150 is Ala, Gly, or Pro
  SITE (163)..(163): Xaa at position 163 is Ala, Gly, or Pro
  SITE (165)..(165): Xaa at position 165 is Tyr, Phe, Met, His, Ile, Leu, Val Ala, or Gly
  SITE (181)..(181): Xaa at position 181 is Ile, Ala, Val, Leu, or Gly
  SITE (190)..(190): Xaa at position 190 is Ile, Ala, Val, Leu, or Gly
  SITE (192)..(192): Xaa at position 192 is Val, Ala, Gly, Leu, or Ile
  SITE (193)..(193): Xaa at position 193 is Val, Ala, Gly, Leu, or Ile
  SITE (194)..(194): Xaa at position 194 is Ile, Ala, Val, Leu, or Gly
  SITE (209)..(209): Xaa at position 209 is Leu, Ala, Val, Gly, or Ile
  SITE (211)..(211): Xaa at position 211 is Ile, Ala, Val, Leu, or Gly
  SITE (220)..(220): Xaa at position 220 is Val, Ala, Gly, Leu, or Ile
  SITE (221)..(221): Xaa at position 221 is Ile, Ala, Val, Leu, or Gly
  SITE (222)..(222): Xaa at position 222 is Ala, Gly, or Pro
  SITE (224)..(224): Xaa at position 224 is Ala, Gly, or Pro
  SITE (239)..(239): Xaa at position 239 is Leu, Ala, Val, Gly, or Ile
  SITE (244)..(244): Xaa at position 244 is Leu, Ala, Val, Gly, or Ile
  SITE (252)..(252): Xaa at position 252 is Leu, Ala, Val, Gly, or Ile
  SITE (254)..(254): Xaa at position 254 is Val, Ala, Gly, Leu, or Ile
  SITE (255)..(255): Xaa at position 255 is Cys, Ala, Val, Gly, Ser, or Thr
  SITE (257)..(257): Xaa at position 257 is Cys, Ala, Val, Gly, Ser, or Thr
  SITE (260)..(260): Xaa at position 260 is Tyr, Phe, Met, His, Ile, Leu, Val Ala, or Gly
  SITE (261)..(261): Xaa at position 261 is Phe, Tyr, Met, His, Ile, Leu, Val Ala, or Gly
  SITE (262)..(262): Xaa at position 262 is Leu, Ala, Val, Gly, or Ile
  SITE (267)..(267): Xaa at position 267 is Leu, Ala, Val, Gly, or Ile
  SITE (270)..(270): Xaa at position 270 is Tyr, Phe, Met, His, Ile, Leu, Val Ala, or Gly
  SITE (272)..(272): Xaa at position 272 is Tyr, Phe, Met, His, Ile, Leu, Val Ala, or Gly
  SITE (273)..(273): Xaa at position 273 is Ile, Ala, Val, Leu, or Gly
  SITE (276)..(276): Xaa at position 276 is Cys, Ala, Val, Gly, Ser, or Thr
  SITE (285)..(285): Xaa at position 285 is Leu, Ala, Val, Gly, or Ile
  SITE (293)..(293): Xaa at position 293 is Leu, Ala, Val, Gly, or Ile
  SITE (327)..(327): Xaa at position 327 is Leu, Ala, Val, Gly, or Ile
  SITE (330)..(330): Xaa at position 330 is Ile, Ala, Val, Leu, or Gly
  SITE (334)..(334): Xaa at position 334 is Leu, Ala, Val, Gly, or Ile
  SITE (336)..(336): Xaa at position 336 is Ile, Ala, Val, Leu, or Gly
  SITE (338)..(338): Xaa at position 338 is Ile, Ala, Val, Leu, or Gly
  SITE (341)..(341): Xaa at position 341 is Ala, Gly, or Pro
  SITE (354)..(354): Xaa at position 354 is Ile, Ala, Val, Leu, or Gly
  SITE (355)..(355): Xaa at position 355 is Tyr, Phe, Met, His, Ile, Leu, Val Ala, or Gly
  SITE (356)..(356): Xaa at position 356 is Val, Ala, Gly, Leu, or Ile
  SITE (360)..(360): Xaa at position 360 is Ile, Ala, Val, Leu, or Gly
  SITE (361)..(361): Xaa at position 361 is Tyr, Phe, Met, His, Ile, Leu, Val Ala, or Gly
  SITE (376)..(376): Xaa at position 376 is Val, Ala, Gly, Leu, or Ile
  SITE (387)..(387): Xaa at position 387 is Leu, Ala, Val, Gly, or Ile
  SITE (389)..(389): Xaa at position 389 is Tyr, Phe, Met, His, Ile, Leu, Val Ala, or Gly
  SITE (393)..(393): Xaa at position 393 is Ile, Ala, Val, Leu, or Gly
  SITE (396)..(396): Xaa at position 396 is Leu, Ala, Val, Gly, or Ile
  SITE (399)..(399): Xaa at position 399 is Ala, Gly, or Pro
  SITE (400)..(400): Xaa at position 400 is Ala, Gly, or Pro
  SITE (402)..(402): Xaa at position 402 is Leu, Ala, Val, Gly, or Ile
  SITE (403)..(403): Xaa at position 403 is Cys, Ala, Val, Gly, Ser, or Thr
  SITE (404)..(404): Xaa at position 404 is Leu, Ala, Val, Gly, or Ile
  SITE (406)..(406): Xaa at position 406 is Ile, Ala, Val, Leu, or Gly
  SITE (407)..(407): Xaa at position 407 is Cys, Ala, Val, Gly, Ser, or Thr
  SITE (409)..(409): Xaa at position 409 is Val, Ala, Gly, Leu, or Ile
  SITE (420)..(420): Xaa at position 420 is Cys, Ala, Val, Gly, Ser, or Thr
  SITE (422)..(422): Xaa at position 422 is Leu, Ala, Val, Gly, or Ile
  SITE (423)..(423): Xaa at position 423 is Ala, Gly, or Pro
  SITE (429)..(429): Xaa at position 429 is Leu, Ala, Val, Gly, or Ile
  SITE (430)..(430): Xaa at position 430 is Phe, Tyr, Met, His, Ile, Leu, Val Ala, or Gly
  SITE (443)..(443): Xaa at position 443 is Leu, Ala, Val, Gly, or Ile
  SITE (445)..(445): Xaa at position 445 is Leu, Ala, Val, Gly, or Ile
  SITE (452)..(452): Xaa at position 452 is Leu, Ala, Val, Gly, or Ile
  SITE (456)..(456): Xaa at position 456 is Leu, Ala, Val, Gly, or Ile
  SITE (461)..(461): Xaa at position 461 is Val, Ala, Gly, Leu, or Ile
  SITE (473)..(473): Xaa at position 473 is Leu, Ala, Val, Gly, or Ile
  SITE (475)..(475): Xaa at position 475 is Leu, Ala, Val, Gly, or Ile
  SITE (484)..(484): Xaa at position 484 is Val, Ala, Gly, Leu, or Ile
  SITE (492)..(492): Xaa at position 492 is Ile, Ala, Val, Leu, or Gly
  SITE (496)..(496): Xaa at position 496 is Ala, Gly, or Pro
  SITE (531)..(531): Xaa at position 531 is Leu, Ala, Val, Gly, or Ile
  SITE (534)..(534): Xaa at position 534 is Ile, Ala, Val, Leu, or Gly
  SITE (540)..(540): Xaa at position 540 is Leu, Ala, Val, Gly, or Ile
  SITE (551)..(551): Xaa at position 551 is Leu, Ala, Val, Gly, or Ile
  SITE (558)..(558): Xaa at position 558 is Cys, Ala, Val, Gly, Ser, or Thr
  SITE (559)..(559): Xaa at position 559 is Val, Ala, Gly, Leu, or Ile
  SITE (564)..(564): Xaa at position 564 is Ile, Ala, Val, Leu, or Gly
  SITE (565)..(565): Xaa at position 565 is Leu, Ala, Val, Gly, or Ile
  SITE (568)..(568): Xaa at position 568 is Leu, Ala, Val, Gly, or Ile
  SITE (569)..(569): Xaa at position 569 is Leu, Ala, Val, Gly, or Ile
  SITE (570)..(570): Xaa at position 570 is Leu, Ala, Val, Gly, or Ile
  SITE (580)..(580): Xaa at position 580 is Val, Ala, Gly, Leu, or Ile
  SITE (581)..(581): Xaa at position 581 is Ala, Gly, or Pro
  SITE (583)..(583): Xaa at position 583 is Met, Ile, Leu, Val, Ala, or Gly
  SITE (587)..(587): Xaa at position 587 is Val, Ala, Gly, Leu, or Ile
  SITE (593)..(593): Xaa at position 593 is Ile, Ala, Val, Leu, or Gly
  SITE (598)..(598): Xaa at position 598 is Ala, Gly, or Pro
  SITE (599)..(599): Xaa at position 599 is Met, Ile, Leu, Val, Ala, or Gly
  SITE (601)..(601): Xaa at position 601 is Leu, Ala, Val, Gly, or Ile
  SITE (602)..(602): Xaa at position 602 is Leu, Ala, Val, Gly, or Ile
  SITE (611)..(611): Xaa at position 611 is Val, Ala, Gly, Leu, or Ile
  SITE (614)..(614): Xaa at position 614 is Phe, Tyr, Met, His, Ile, Leu, Val Ala, or Gly
  SITE (615)..(615): Xaa at position 615 is Ala, Gly, or Pro
  SITE (616)..(616): Xaa at position 616 is Val, Ala, Gly, Leu, or Ile
  SITE (618)..(618): Xaa at position 618 is Cys, Ala, Val, Gly, Ser, or Thr
  SITE (619)..(619): Xaa at position 619 is Leu, Ala, Val, Gly, or Ile
  SITE (628)..(628): Xaa at position 628 is Leu, Ala, Val, Gly, or Ile
  SITE (631)..(631): Xaa at position 631 is Tyr, Phe, Met, His, Ile, Leu, Val Ala, or Gly
  SITE (632)..(632): Xaa at position 632 is Leu, Ala, Val, Gly, or Ile
  SITE (635)..(635): Xaa at position 635 is Leu, Ala, Val, Gly, or Ile
  SITE (636)..(636): Xaa at position 636 is Val, Ala, Gly, Leu, or Ile
  SITE (638)..(638): Xaa at position 638 is Val, Ala, Gly, Leu, or Ile
  SITE (639)..(639): Xaa at position 639 is Leu, Ala, Val, Gly, or Ile
  SITE (648)..(648): Xaa at position 648 is Leu, Ala, Val, Gly, or Ile
  SITE (649)..(649): Xaa at position 649 is Leu, Ala, Val, Gly, or Ile
  SITE (650)..(650): Xaa at position 650 is Val, Ala, Gly, Leu, or Ile
  SITE (653)..(653): Xaa at position 653 is Leu, Ala, Val, Gly, or Ile
  SITE (654)..(654): Xaa at position 654 is Leu, Ala, Val, Gly, or Ile
  SITE (657)..(657): Xaa at position 657 is Ala, Gly, or Pro
  SITE (658)..(658): Xaa at position 658 is Leu, Ala, Val, Gly, or Ile
  SITE (663)..(663): Xaa at position 663 is Ile, Ala, Val, Leu, or Gly
  SITE (665)..(665): Xaa at position 665 is His, Phe, Tyr, Lys, Arg, Gly, Ser Thr, Ala, Val, Leu, Ile, Asn, Met, or Gln
  SITE (667)..(667): Xaa at position 667 is Phe, Tyr, Met, His, Ile, Leu, Val Ala, or Gly
  SITE (668)..(668): Xaa at position 668 is Phe, Tyr, Met, His, Ile, Leu, Val Ala, or Gly
  SITE (669)..(669): Xaa at position 669 is Trp, Tyr, Phe, Met, His, Ile, Leu Val, Ala, or Gly
  SITE (671)..(671): Xaa at position 671 is Leu, Ala, Val, Gly, or Ile
  SITE (680)..(680): Xaa at position 680 is Val, Ala, Gly, Leu, or Ile
  SITE (684)..(684): Xaa at position 684 is Phe, Tyr, Met, His, Ile, Leu, Val Ala, or Gly
  SITE (686)..(686): Xaa at position 686 is Leu, Ala, Val, Gly, or Ile
  SITE (687)..(687): Xaa at position 687 is Leu, Ala, Val, Gly, or Ile
  SITE (688)..(688): Xaa at position 688 is Leu, Ala, Val, Gly, or Ile
  SITE (691)..(691): Xaa at position 691 is Tyr, Phe, Met, His, Ile, Leu, Val Ala, or Gly
  SITE (692)..(692): Xaa at position 692 is Cys, Ala, Val, Gly, Ser, or Thr
  SITE (694)..(694): Xaa at position 694 is Ala, Gly, or Pro
  SITE (695)..(695): Xaa at position 695 is Cys, Ala, Val, Gly, Ser, or Thr
  SITE (698)..(698): Xaa at position 698 is Tyr, Phe, Met, His, Ile, Leu, Val Ala, or Gly
  SITE (699)..(699): Xaa at position 699 is Leu, Ala, Val, Gly, or Ile
  SITE (702)..(702): Xaa at position 702 is Leu, Ala, Val, Gly, or Ile
  SITE (706)..(706): Xaa at position 706 is Val, Ala, Gly, Leu, or Ile
  SITE (708)..(708): Xaa at position 708 is Ala, Gly, or Pro
  SITE (709)..(709): Xaa at position 709 is Met, Ile, Leu, Val, Ala, or Gly
  SITE (712)..(712): Xaa at position 712 is Leu, Ala, Val, Gly, or Ile
  SITE (715)..(715): Xaa at position 715 is Leu, Ala, Val, Gly, or Ile
  SITE (718)..(718): Xaa at position 718 is Ile, Ala, Val, Leu, or Gly
  SITE (719)..(719): Xaa at position 719 is Leu, Ala, Val, Gly, or Ile
  SITE (735)..(735): Xaa at position 735 is Leu, Ala, Val, Gly, or Ile
  SITE (739)..(739): Xaa at position 739 is Met, Ile, Leu, Val, Ala, or Gly
  SITE (744)..(744): Xaa at position 744 is Phe, Tyr, Met, His, Ile, Leu, Val Ala, or Gly
  SITE (747)..(747): Xaa at position 747 is Ala, Gly, or Pro
  SITE (748)..(748): Xaa at position 748 is Leu, Ala, Val, Gly, or Ile
  SITE (751)..(751): Xaa at position 751 is Phe, Tyr, Met, His, Ile, Leu, Val Ala, or Gly
  SITE (755)..(755): Xaa at position 755 is Leu, Ala, Val, Gly, or Ile
  SITE (761)..(761): Xaa at position 761 is Leu, Ala, Val, Gly, or Ile
  SITE (764)..(764): Xaa at position 764 is Leu, Ala, Val, Gly, or Ile
  SITE (769)..(769): Xaa at position 769 is Cys, Ala, Val, Gly, Ser, or Thr
  SITE (771)..(771): Xaa at position 771 is Ile, Ala, Val, Leu, or Gly
  SITE (779)..(779): Xaa at position 779 is Leu, Ala, Val, Gly, or Ile
  SITE (781)..(781): Xaa at position 781 is Leu, Ala, Val, Gly, or Ile
  SITE (783)..(783): Xaa at position 783 is Trp, Tyr, Phe, Met, His, Ile, Leu Val, Ala, or Gly
  SITE (788)..(788): Xaa at position 788 is Ile, Ala, Val, Leu, or Gly
  SITE (789)..(789): Xaa at position 789 is Met, Ile, Leu, Val, Ala, or Gly
  SITE (792)..(792): Xaa at position 792 is Leu, Ala, Val, Gly, or Ile
  SITE (793)..(793): Xaa at position 793 is Leu, Ala, Val, Gly, or Ile
  SITE (799)..(799): Xaa at position 799 is Ile, Ala, Val, Leu, or Gly
  SITE (801)..(801): Xaa at position 801 is Phe, Tyr, Met, His, Ile, Leu, Val Ala, or Gly
  SITE (807)..(807): Xaa at position 807 is Leu, Ala, Val, Gly, or Ile
  SITE (812)..(812): Xaa at position 812 is Leu, Ala, Val, Gly, or Ile
  SITE (814)..(814): Xaa at position 814 is Leu, Ala, Val, Gly, or Ile
  SITE (816)..(816): Xaa at position 816 is Ile, Ala, Val, Leu, or Gly
  SITE (817)..(817): Xaa at position 817 is Ile, Ala, Val, Leu, or Gly
  SITE (820)..(820): Xaa at position 820 is Met, Ile, Leu, Val, Ala, or Gly
  SITE (824)..(824): Xaa at position 824 is Trp, Tyr, Phe, Met, His, Ile, Leu Val, Ala, or Gly
  SITE (831)..(831): Xaa at position 831 is Leu, Ala, Val, Gly, or Ile
  SITE (833)..(833): Xaa at position 833 is Met, Ile, Leu, Val, Ala, or Gly
  SITE (834)..(834): Xaa at position 834 is Leu, Ala, Val, Gly, or Ile
  SITE (839)..(839): Xaa at position 839 is Leu, Ala, Val, Gly, or Ile
  SITE (847)..(847): Xaa at position 847 is Leu, Ala, Val, Gly, or Ile
  SITE (857)..(857): Xaa at position 857 is Ile, Ala, Val, Leu, or Gly
  SITE (860)..(860): Xaa at position 860 is Ile, Ala, Val, Leu, or Gly
  SITE (877)..(877): Xaa at position 877 is Leu, Ala, Val, Gly, or Ile
  SITE (878)..(878): Xaa at position 878 is His, Phe, Tyr, Lys, Arg, Gly, Ser Thr, Ala, Val, Leu, Ile, Asn, Met, or Gln
  SITE (881)..(881): Xaa at position 881 is Leu, Ala, Val, Gly, or Ile
  SITE (893)..(893): Xaa at position 893 is Ala, Gly, or Pro
  SITE (896)..(896): Xaa at position 896 is Leu, Ala, Val, Gly, or Ile
  SITE (897)..(897): Xaa at position 897 is Phe, Tyr, Met, His, Ile, Leu, Val Ala, or Gly
  SITE (901)..(901): Xaa at position 901 is Cys, Ala, Val, Gly, Ser, or Thr
  SITE (902)..(902): Xaa at position 902 is Ala, Gly, or Pro
  SITE (904)..(904): Xaa at position 904 is Tyr, Phe, Met, His, Ile, Leu, Val Ala, or Gly
  SITE (905)..(905): Xaa at position 905 is Cys, Ala, Val, Gly, Ser, or Thr
  SITE (906)..(906): Xaa at position 906 is Val, Ala, Gly, Leu, or Ile
  SITE (907)..(907): Xaa at position 907 is Ala, Gly, or Pro
  SITE (909)..(909): Xaa at position 909 is Phe, Tyr, Met, His, Ile, Leu, Val Ala, or Gly
  SITE (910)..(910): Xaa at position 910 is Ile, Ala, Val, Leu, or Gly
  SITE (911)..(911): Xaa at position 911 is Leu, Ala, Val, Gly, or Ile
  SITE (913)..(913): Xaa at position 913 is Ile, Ala, Val, Leu, or Gly
  SITE (921)..(921): Xaa at position 921 is Ile, Ala, Val, Leu, or Gly
  SITE (922)..(922): Xaa at position 922 is Met, Ile, Leu, Val, Ala, or Gly
  SITE (923)..(923): Xaa at position 923 is Val, Ala, Gly, Leu, or Ile
  SITE (929)..(929): Xaa at position 929 is Leu, Ala, Val, Gly, or Ile
  SITE (930)..(930): Xaa at position 930 is Phe, Tyr, Met, His, Ile, Leu, Val Ala, or Gly
  SITE (931)..(931): Xaa at position 931 is His, Phe, Tyr, Lys, Arg, Gly, Ser Thr, Ala, Val, Leu, Ile, Asn, Met, or Gln
  SITE (934)..(934): Xaa at position 934 is Phe, Tyr, Met, His, Ile, Leu, Val Ala, or Gly
  SITE (937)..(937): Xaa at position 937 is Phe, Tyr, Met, His, Ile, Leu, Val Ala, or Gly
  SITE (938)..(938): Xaa at position 938 is Leu, Ala, Val, Gly, or Ile
  SITE (954)..(954): Xaa at position 954 is Phe, Tyr, Met, His, Ile, Leu, Val Ala, or Gly
  SITE (960)..(960): Xaa at position 960 is Phe, Tyr, Met, His, Ile, Leu, Val Ala, or Gly
  SITE (961)..(961): Xaa at position 961 is Leu, Ala, Val, Gly, or Ile
  SITE (962)..(962): Xaa at position 962 is Ile, Ala, Val, Leu, or Gly
  SITE (963)..(963): Xaa at position 963 is Val, Ala, Gly, Leu, or Ile
  SITE (964)..(964): Xaa at position 964 is Ile, Ala, Val, Leu, or Gly
  SITE (971)..(971): Xaa at position 971 is Cys, Ala, Val, Gly, Ser, or Thr
  SITE (977)..(977): Xaa at position 977 is Phe, Tyr, Met, His, Ile, Leu, Val Ala, or Gly
  SITE (980)..(980): Xaa at position 980 is Phe, Tyr, Met, His, Ile, Leu, Val Ala, or Gly
  SITE (984)..(984): Xaa at position 984 is Cys, Ala, Val, Gly, Ser, or Thr
  SITE (987)..(987): Xaa at position 987 is Ala, Gly, or Pro
  SITE (988)..(988): Xaa at position 988 is Tyr, Phe, Met, His, Ile, Leu, Val Ala, or Gly
  SITE (990)..(990): Xaa at position 990 is Ala, Gly, or Pro
  SITE (991)..(991): Xaa at position 991 is Ile, Ala, Val, Leu, or Gly
  SITE (995)..(995): Xaa at position 995 is Ala, Gly, or Pro
  SITE (998)..(998): Xaa at position 998 is Phe, Tyr, Met, His, Ile, Leu, Val Ala, or Gly
  SITE (999)..(999): Xaa at position 999 is Ile, Ala, Val, Leu, or Gly
  SITE (1001)..(1001): Xaa at position 1001 is Leu, Ala, Val, Gly, or Ile
  SITE (1002)..(1002): Xaa at position 1002 is Phe, Tyr, Met, His, Ile, Leu Val, Ala, or Gly
  SITE (1004)..(1004): Xaa at position 1004 is Met, Ile, Leu, Val, Ala, or Gly
  SITE (1005)..(1005): Xaa at position 1005 is Met, Ile, Leu, Val, Ala, or Gly
  SITE (1010)..(1010): Xaa at position 1010 is Met, Ile, Leu, Val, Ala, or Gly
  SITE (1013)..(1013): Xaa at position 1013 is Leu, Ala, Val, Gly, or Ile
  SITE (1016)..(1016): Xaa at position 1016 is Phe, Tyr, Met, His, Ile, Leu Val, Ala, or Gly
  SITE (1019)..(1019): Xaa at position 1019 is Ile, Ala, Val, Leu, or Gly
  SITE (1021)..(1021): Xaa at position 1021 is Tyr, Phe, Met, His, Ile, Leu Val, Ala, or Gly
  SITE (1022)..(1022): Xaa at position 1022 is Ile, Ala, Val, Leu, or Gly
  SITE (1026)..(1026): Xaa at position 1026 is Leu, Ala, Val, Gly, or Ile
  SITE (1035)..(1035): Xaa at position 1035 is Ala, Gly, or Pro
  SITE (1039)..(1039): Xaa at position 1039 is Phe, Tyr, Met, His, Ile, Leu Val, Ala, or Gly
  SITE (1043)..(1043): Xaa at position 1043 is Met, Ile, Leu, Val, Ala, or Gly
  SITE (1051)..(1051): Xaa at position 1051 is Trp, Tyr, Phe, Met, His, Ile Leu, Val, Ala, or Gly
MPPRPSSGELWGIHLXPPRIXXEXXXPNGXXXTLEXLREATXITXKHEXFKEXRKYPLHQXLQDESSYXXXSXTQEAEREEXXDETRRXCDXRXXQPFXKXIEPVGNREEKILNREXGFXXGMPXCEXDMVKDPEXQDXRRNXXNVXKEXVDLRDLNSPHSRXMXVYPPNVESSPELPKHXYNKLDKGQXIXXXWVIVSPNNDKQKYTXKXNHDCVPEQXXXEXIRKKTRSMLLSSEQXKLCVXEYQGKYIXKXXGXDEXXXEKYPXSQXKXXRSXIMLGRMPNXMLMAKESXYSQLPMDCFTMPSYSRRISTATPYMNGETSTKSXWVXNSAXRXKXLCXTYVNVNIRDIDKXXXRTGXXHGGEPLCDNVNTQRXPCSNPRWNEWXNXDIYXPDXPRXXRXXXSXXSXKGRKGAKEEHXPXXWGNINXXDYTDTLVSGKMAXNXWPVPHGXEDLXNPIGXTGSNPNKETPCXEXEFDWFSSVXKFPDMSVXEEHXNWSVSREAGFSYSHAGLSNRLARDNELRENDKEQXKAXSTRDPXSEITEQEKDFXWSHRHYXXTIPEXXPKXXXSVKWNSRDEXXQXYCLXKDWPPXKPEQXXEXXDCNYPDPMXRGXXXRXXEKYLTDDKXSQXXIQXXQXXKYEQYLDNXXXRFXXKKXXTNQRXGXFXXXHXKSEMHNKTXSQRXGXXXESXXRXXGMXXKHXNRQXEXXEKXINXTDXXKQEKKDETQKVQMKFXVEQXRRPDXMDXXQGXLSPXNPAHQXGNXRLEEXRXMSSAKRPXWXNXENPDXXSEXXFQNNEXIXKNGDDXRQDMXTXQXXRIXENIXQNQGLDXRXXPYGCXSIGDCVGXIEVVRNSHTXMQXQCKGGLKGALQFNSHTXXQWXKDKNKGEIYDAXIDXXTRSXXGXXXXTXXXGXGDRHNSNXXXKDDGQXXXIDXGHXXDHKKKKFGYKRERVPXVLTQDXXXXXSKGAQEXTKTREXERXQEMXYKXXLXXRQHXNLXXNXXSXXLGSGXPEXQSXDDXAXXRKTXALDKTEQEXLEYXMKQXNDAHHGGXTTKMDWIFHTIKQHALN

SEQ ID NO: 507 - protein, 568 aa, Homo sapiens
  SITE (7)..(7): Xaa at position 7 is Val, Ala, Gly, Leu, or Ile
  SITE (11)..(11): Xaa at position 11 is Leu, Ala, Val, Gly, or Ile
  SITE (13)..(13): Xaa at position 13 is Leu, Ala, Val, Gly, or Ile
  SITE (15)..(15): Xaa at position 15 is His, Phe, Tyr, Lys, Arg, Gly, Ser Thr, Ala, Val, Leu, Ile, Asn, Met, or Gln
  SITE (17)..(17): Xaa at position 17 is Ala, Gly, or Pro
  SITE (34)..(34): Xaa at position 34 is Val, Ala, Gly, Leu, or Ile
  SITE (36)..(36): Xaa at position 36 is Val, Ala, Gly, Leu, or Ile
  SITE (47)..(47): Xaa at position 47 is Phe, Tyr, Met, His, Ile, Leu, Val Ala, or Gly
  SITE (48)..(48): Xaa at position 48 is Val, Ala, Gly, Leu, or Ile
  SITE (51)..(51): Xaa at position 51 is Val, Ala, Gly, Leu, or Ile
  SITE (52)..(52): Xaa at position 52 is Val, Ala, Gly, Leu, or Ile
  SITE (53)..(53): Xaa at position 53 is Phe, Tyr, Met, His, Ile, Leu, Val Ala, or Gly
  SITE (71)..(71): Xaa at position 71 is Tyr, Phe, Met, His, Ile, Leu, Val Ala, or Gly
  SITE (82)..(82): Xaa at position 82 is Ile, Ala, Val, Leu, or Gly
  SITE (83)..(83): Xaa at position 83 is Leu, Ala, Val, Gly, or Ile
  SITE (85)..(85): Xaa at position 85 is Ile, Ala, Val, Leu, or Gly
  SITE (87)..(87): Xaa at position 87 is Val, Ala, Gly, Leu, or Ile
  SITE (89)..(89): Xaa at position 89 is Phe, Tyr, Met, His, Ile, Leu, Val Ala, or Gly
  SITE (102)..(102): Xaa at position 102 is Tyr, Phe, Met, His, Ile, Leu, Val Ala, or Gly
  SITE (104)..(104): Xaa at position 104 is Leu, Ala, Val, Gly, or Ile
  SITE (131)..(131): Xaa at position 131 is Phe, Tyr, Met, His, Ile, Leu, Val Ala, or Gly
  SITE (135)..(135): Xaa at position 135 is Leu, Ala, Val, Gly, or Ile
  SITE (522)..(522): Xaa at position 522 is Ile, Ala, Val, Leu, or Gly
  SITE (526)..(526): Xaa at position 526 is Ile, Ala, Val, Leu, or Gly
  SITE (530)..(530): Xaa at position 530 is Ile, Ala, Val, Leu, or Gly
  SITE (555)..(555): Xaa at position 555 is Val, Ala, Gly, Leu, or Ile
  SITE (558)..(558): Xaa at position 558 is Leu, Ala, Val, Gly, or Ile
MASSCAXQVKXEXGXRXQVRKKPTVEGFTHDWMXFXRGPEHSNIQHXXEKXXXHLHESFPRPKRVCKDPPXKVEESGYAGFXXPXEXYXKNKEEPRKVRFDXDXFLHLEGHPPVNHLRCEKLTFNNPTEDXRRKXLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHXLQQXVNLXEETGHFHITNTTFDFDLCSLDKTTXRKXQSYLETSGTS

SEQ ID NO: 508 - protein, 865 aa, Homo sapiens
  SITE (131)..(131): Xaa at position 131 is Val, Ala, Gly, Leu, or Ile
  SITE (133)..(133): Xaa at position 133 is Val, Ala, Gly, Leu, or Ile
  SITE (156)..(156): Xaa at position 156 is Phe, Tyr, Met, His, Ile, Leu, Val Ala, or Gly
  SITE (165)..(165): Xaa at position 165 is Val, Ala, Gly, Leu, or Ile
  SITE (201)..(201): Xaa at position 201 is Ala, Gly, or Pro
  SITE (202)..(202): Xaa at position 202 is Leu, Ala, Val, Gly, or Ile
  SITE (220)..(220): Xaa at position 220 is Val, Ala, Gly, Leu, or Ile
  SITE (242)..(242): Xaa at position 242 is Leu, Ala, Val, Gly, or Ile
  SITE (245)..(245): Xaa at position 245 is Ala, Gly, or Pro
  SITE (255)..(255): Xaa at position 255 is Ile, Ala, Val, Leu, or Gly
  SITE (256)..(256): Xaa at position 256 is Phe, Tyr, Met, His, Ile, Leu, Val Ala, or Gly
  SITE (257)..(257): Xaa at position 257 is Ile, Ala, Val, Leu, or Gly
  SITE (262)..(262): Xaa at position 262 is Ile, Ala, Val, Leu, or Gly
  SITE (291)..(291): Xaa at position 291 is Trp, Tyr, Phe, Met, His, Ile, Leu Val, Ala, or Gly
  SITE (292)..(292): Xaa at position 292 is Leu, Ala, Val, Gly, or Ile
  SITE (293)..(293): Xaa at position 293 is Tyr, Phe, Met, His, Ile, Leu, Val Ala, or Gly
  SITE (303)..(303): Xaa at position 303 is Ala, Gly, or Pro
  SITE (314)..(314): Xaa at position 314 is Ala, Gly, or Pro
  SITE (318)..(318): Xaa at position 318 is Ile, Ala, Val, Leu, or Gly
  SITE (328)..(328): Xaa at position 328 is Leu, Ala, Val, Gly, or Ile
  SITE (356)..(356): Xaa at position 356 is Leu, Ala, Val, Gly, or Ile
  SITE (357)..(357): Xaa at position 357 is His, Phe, Tyr, Lys, Arg, Gly, Ser Thr, Ala, Val, Leu, Ile, Asn, Met, or Gln
  SITE (358)..(358): Xaa at position 358 is Val, Ala, Gly, Leu, or Ile
  SITE (361)..(361): Xaa at position 361 is Leu, Ala, Val, Gly, or Ile
  SITE (368)..(368): Xaa at position 368 is Leu, Ala, Val, Gly, or Ile
  SITE (370)..(370): Xaa at position 370 is Met, Ile, Leu, Val, Ala, or Gly
  SITE (382)..(382): Xaa at position 382 is Tyr, Phe, Met, His, Ile, Leu, Val Ala, or Gly
  SITE (383)..(383): Xaa at position 383 is Ile, Ala, Val, Leu, or Gly
  SITE (394)..(394): Xaa at position 394 is Val, Ala, Gly, Leu, or Ile
  SITE (395)..(395): Xaa at position 395 is Ala, Gly, or Pro
  SITE (396)..(396): Xaa at position 396 is Val, Ala, Gly, Leu, or Ile
  SITE (398)..(398): Xaa at position 398 is Trp, Tyr, Phe, Met, His, Ile, Leu Val, Ala, or Gly
  SITE (407)..(407): Xaa at position 407 is Ile, Ala, Val, Leu, or Gly
  SITE (411)..(411): Xaa at position 411 is Cys, Ala, Val, Gly, Ser, or Thr
  SITE (413)..(413): Xaa at position 413 is Ala, Gly, or Pro
  SITE (429)..(429): Xaa at position 429 is Trp, Tyr, Phe, Met, His, Ile, Leu Val, Ala, or Gly
  SITE (447)..(447): Xaa at position 447 is Phe, Tyr, Met, His, Ile, Leu, Val Ala, or Gly
  SITE (462)..(462): Xaa at position 462 is His, Phe, Tyr, Lys, Arg, Gly, Ser Thr, Ala, Val, Leu, Ile, Asn, Met, or Gln
  SITE (463)..(463): Xaa at position 463 is Ile, Ala, Val, Leu, or Gly
  SITE (487)..(487): Xaa at position 487 is Val, Ala, Gly, Leu, or Ile
  SITE (500)..(500): Xaa at position 500 is Ile, Ala, Val, Leu, or Gly
  SITE (502)..(502): Xaa at position 502 is Phe, Tyr, Met, His, Ile, Leu, Val Ala, or Gly
  SITE (514)..(514): Xaa at position 514 is Leu, Ala, Val, Gly, or Ile
  SITE (517)..(517): Xaa at position 517 is Ala, Gly, or Pro
  SITE (520)..(520): Xaa at position 520 is Val, Ala, Gly, Leu, or Ile
  SITE (528)..(528): Xaa at position 528 is Leu, Ala, Val, Gly, or Ile
  SITE (536)..(536): Xaa at position 536 is Cys, Ala, Val, Gly, Ser, or Thr
  SITE (550)..(550): Xaa at position 550 is Phe, Tyr, Met, His, Ile, Leu, Val Ala, or Gly
  SITE (554)..(554): Xaa at position 554 is Cys, Ala, Val, Gly, Ser, or Thr
  SITE (564)..(564): Xaa at position 564 is Val, Ala, Gly, Leu, or Ile
  SITE (565)..(565): Xaa at position 565 is His, Phe, Tyr, Lys, Arg, Gly, Ser Thr, Ala, Val, Leu, Ile, Asn, Met, or Gln
  SITE (606)..(606): Xaa at position 606 is Leu, Ala, Val, Gly, or Ile
  SITE (608)..(608): Xaa at position 608 is Met, Ile, Leu, Val, Ala, or Gly
  SITE (610)..(610): Xaa at position 610 is Ile, Ala, Val, Leu, or Gly
  SITE (624)..(624): Xaa at position 624 is Leu, Ala, Val, Gly, or Ile
  SITE (625)..(625): Xaa at position 625 is Leu, Ala, Val, Gly, or Ile
  SITE (649)..(649): Xaa at position 649 is Met, Ile, Leu, Val, Ala, or Gly
  SITE (650)..(650): Xaa at position 650 is Val, Ala, Gly, Leu, or Ile
  SITE (655)..(655): Xaa at position 655 is Ala, Gly, or Pro
  SITE (656)..(656): Xaa at position 656 is Val, Ala, Gly, Leu, or Ile
  SITE (657)..(657): Xaa at position 657 is Val, Ala, Gly, Leu, or Ile
  SITE (672)..(672): Xaa at position 672 is Leu, Ala, Val, Gly, or Ile
  SITE (676)..(676): Xaa at position 676 is Val, Ala, Gly, Leu, or Ile
  SITE (689)..(689): Xaa at position 689 is Met, Ile, Leu, Val, Ala, or Gly
  SITE (692)..(692): Xaa at position 692 is Val, Ala, Gly, Leu, or Ile
  SITE (695)..(695): Xaa at position 695 is Met, Ile, Leu, Val, Ala, or Gly
  SITE (706)..(706): Xaa at position 706 is Val, Ala, Gly, Leu, or Ile
  SITE (707)..(707): Xaa at position 707 is Ala, Gly, or Pro
  SITE (708)..(708): Xaa at position 708 is Val, Ala, Gly, Leu, or Ile
  SITE (716)..(716): Xaa at position 716 is Tyr, Phe, Met, His, Ile, Leu, Val Ala, or Gly
  SITE (717)..(717): Xaa at position 717 is Leu, Ala, Val, Gly, or Ile
  SITE (721)..(721): Xaa at position 721 is Ile, Ala, Val, Leu, or Gly
  SITE (733)..(733): Xaa at position 733 is Phe, Tyr, Met, His, Ile, Leu, Val Ala, or Gly
  SITE (735)..(735): Xaa at position 735 is Cys, Ala, Val, Gly, Ser, or Thr
  SITE (738)..(738): Xaa at position 738 is Ala, Gly, or Pro
  SITE (742)..(742): Xaa at position 742 is Ile, Ala, Val, Leu, or Gly
  SITE (745)..(745): Xaa at position 745 is Phe, Tyr, Met, His, Ile, Leu, Val Ala, or Gly
  SITE (749)..(749): Xaa at position 749 is Ala, Gly, or Pro
  SITE (751)..(751): Xaa at position 751 is Ala, Gly, or Pro
  SITE (757)..(757): Xaa at position 757 is Leu, Ala, Val, Gly, or Ile
  SITE (767)..(767): Xaa at position 767 is Tyr, Phe, Met, His, Ile, Leu, Val Ala, or Gly
  SITE (772)..(772): Xaa at position 772 is Val, Ala, Gly, Leu, or Ile
  SITE (776)..(776): Xaa at position 776 is Val, Ala, Gly, Leu, or Ile
  SITE (785)..(785): Xaa at position 785 is Leu, Ala, Val, Gly, or Ile
  SITE (786)..(786): Xaa at position 786 is Ile, Ala, Val, Leu, or Gly
  SITE (787)..(787): Xaa at position 787 is Ile, Ala, Val, Leu, or Gly
  SITE (788)..(788): Xaa at position 788 is His, Phe, Tyr, Lys, Arg, Gly, Ser Thr, Ala, Val, Leu, Ile, Asn, Met, or Gln
  SITE (795)..(795): Xaa at position 795 is Ile, Ala, Val, Leu, or Gly
  SITE (797)..(797): Xaa at position 797 is Phe, Tyr, Met, His, Ile, Leu, Val Ala, or Gly
  SITE (799)..(799): Xaa at position 799 is His, Phe, Tyr, Lys, Arg, Gly, Ser Thr, Ala, Val, Leu, Ile, Asn, Met, or Gln
  SITE (807)..(807): Xaa at position 807 is Leu, Ala, Val, Gly, or Ile
  SITE (839)..(839): Xaa at position 839 is Ile, Ala, Val, Leu, or Gly
  SITE (843)..(843): Xaa at position 843 is Phe, Tyr, Met, His, Ile, Leu, Val Ala, or Gly
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKXTXEDLFSEDFKIHDPEAKWISDTEXIYREQKGTXRLWNVETNTSTVLIEGKKIESLRAIRYEISPDREYXXFSYNVEPIYQHSYTGYYXLSKIPHGDPQSLDPPEVSNAKXQYXGWGPKGQQLXXXFENNXYYCAHVGKQAIRVVSTGKEGVIYNGLSDXXXEEEILKTHIXHWWSPDGTRLXYAAXNDSRVPIMEXPTYTGSIYPTVKPYHYPKAGSENPSISXXXIGXNGPTHDXEXMPPDDPRMREYXXTMVKWATSTKXXXTXLNRAQNVSXLTLXDXTTGVCTKKHEDESEAXLHRQNEEPVFSKDGRKFXFIRAIPQGGRGKFYXXTVSSSQPNSSNDNIQSITSGDWDXTKILAYDEKGNKXYXLSTEDLPRRRQXYSXNTXGNFNRQCXSCDLVENXTYFSASFSHSMDFXLLKXEGPGVPMVTXXNTTDKKKMFDLETNEHVKKAINDRQMPKVEYRDIEIDDYNXPXQXLKPATFTDTTHYPXXLVVDGTPGSQSVAEKFEVSWETVXXSSHGXXXVKCDGRGSGFQGTKXLHEXRRRLGLLEEKDQXEAXRTXLKEQYIDRTRXXXFGKDYGGXXSTYXLPAKGENQGQTXTXGSXLSPXTDXKLYXSXFSERYXGLHGLDNRAXEMTKXAHRXSALEEQQFXXXXPTADEKXHXQXTAELITQXIRGKANYSLQIYPDESHYFTSSSLKQHLYRSXINFXVECFRIQDKLLTVTAKEDEEED

SEQ ID NO: 509 - protein, 1097 aa, Homo sapiens
  SITE (81)..(81): Xaa at position 81 is Val, Ala, Gly, Leu, or Ile
  SITE (112)..(112): Xaa at position 112 is Ile, Ala, Val, Leu, or Gly
  SITE (134)..(134): Xaa at position 134 is Leu, Ala, Val, Gly, or Ile
  SITE (153)..(153): Xaa at position 153 is Leu, Ala, Val, Gly, or Ile
  SITE (170)..(170): Xaa at position 170 is Val, Ala, Gly, Leu, or Ile
  SITE (176)..(176): Xaa at position 176 is Val, Ala, Gly, Leu, or Ile
  SITE (211)..(211): Xaa at position 211 is Leu, Ala, Val, Gly, or Ile
  SITE (216)..(216): Xaa at position 216 is His, Phe, Tyr, Lys, Arg, Gly, Ser Thr, Ala, Val, Leu, Ile, Asn, Met, or Gln
  SITE (218)..(218): Xaa at position 218 is Val, Ala, Gly, Leu, or Ile
  SITE (220)..(220): Xaa at position 220 is Ile, Ala, Val, Leu, or Gly
  SITE (254)..(254): Xaa at position 254 is Val, Ala, Gly, Leu, or Ile
  SITE (269)..(269): Xaa at position 269 is Phe, Tyr, Met, His, Ile, Leu, Val Ala, or Gly
  SITE (270)..(270): Xaa at position 270 is Cys, Ala, Val, Gly, Ser, or Thr
  SITE (271)..(271): Xaa at position 271 is Cys, Ala, Val, Gly, Ser, or Thr
  SITE (277)..(277): Xaa at position 277 is Val, Ala, Gly, Leu, or Ile
  SITE (280)..(280): Xaa at position 280 is Ala, Gly, or Pro
  SITE (299)..(299): Xaa at position 299 is Ile, Ala, Val, Leu, or Gly
  SITE (314)..(314): Xaa at position 314 is Val, Ala, Gly, Leu, or Ile
  SITE (316)..(316): Xaa at position 316 is Phe, Tyr, Met, His, Ile, Leu, Val Ala, or Gly
  SITE (327)..(327): Xaa at position 327 is Ile, Ala, Val, Leu, or Gly
  SITE (329)..(329): Xaa at position 329 is Ala, Gly, or Pro
  SITE (349)..(349): Xaa at position 349 is Ile, Ala, Val, Leu, or Gly
  SITE (351)..(351): Xaa at position 351 is Cys, Ala, Val, Gly, Ser, or Thr
  SITE (353)..(353): Xaa at position 353 is Trp, Tyr, Phe, Met, His, Ile, Leu Val, Ala, or Gly
  SITE (371)..(371): Xaa at position 371 is Leu, Ala, Val, Gly, or Ile
  SITE (397)..(397): Xaa at position 397 is Phe, Tyr, Met, His, Ile, Leu, Val Ala, or Gly
  SITE (406)..(406): Xaa at position 406 is Tyr, Phe, Met, His, Ile, Leu, Val Ala, or Gly
  SITE (408)..(408): Xaa at position 408 is Phe, Tyr, Met, His, Ile, Leu, Val Ala, or Gly
  SITE (410)..(410): Xaa at position 410 is Leu, Ala, Val, Gly, or Ile
  SITE (412)..(412): Xaa at position 412 is Ala, Gly, or Pro
  SITE (427)..(427): Xaa at position 427 is Ile, Ala, Val, Leu, or Gly
  SITE (431)..(431): Xaa at position 431 is Val, Ala, Gly, Leu, or Ile
  SITE (451)..(451): Xaa at position 451 is Leu, Ala, Val, Gly, or Ile
  SITE (459)..(459): Xaa at position 459 is Phe, Tyr, Met, His, Ile, Leu, Val Ala, or Gly
  SITE (466)..(466): Xaa at position 466 is Cys, Ala, Val, Gly, Ser, or Thr
  SITE (468)..(468): Xaa at position 468 is Ile, Ala, Val, Leu, or Gly
  SITE (494)..(494): Xaa at position 494 is Val, Ala, Gly, Leu, or Ile
  SITE (509)..(509): Xaa at position 509 is Ile, Ala, Val, Leu, or Gly
MMDIYVCLKRPSWMVDNKRMRTASNFQWLLSTFILLYLMNQVNSQKKGAPHDLKCVTNNLQVWNCSWKAPSGTGRGTDYEXCIENRSRSCYQLEKTSIKIPALSHGDYEITXNSLHDFGSSTSKFTLNEQNVSXIPDTPEILNLSADFSTSTXYLKWNDRGSVFPHRSNXIWEIKXLRKESMELVKLVTHNTTLNGKDTLHHWSWASDMPXECAIXFXEXRCYIDNLHFSGLEEWSDWSPVKNISWIPDSQTKXFPQDKVILVGSDITXXXVSQEKXLSXLIGHTNCPLIHLDGENVAXKIRNISVSASSGTNXVXTTEDNIFGTVXFXGYPPDTPQQLNCETHDLKEXIXSXNPGRVTALVGPRATSYTXVESFSGKYVRLKRAEAPTNESYQLLXQMLPNQEIXNXTXNXHNPLGRSQSTILVNXTEKXYPHTPTSFKVKDINSTAVKXSWHLPGNXAKINFLXEXEIKKSNSVQEQRNVTIKGVENSSYLXALDKLNPYTLYTFRXRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 510 - protein, 502 aa, Homo sapiens
  SITE (258)..(258): Xaa at position 258 is Phe, Tyr, Met, His, Ile, Leu, Val Ala, or Gly
  SITE (267)..(267): Xaa at position 267 is Leu, Ala, Val, Gly, or Ile
  SITE (270)..(270): Xaa at position 270 is Leu, Ala, Val, Gly, or Ile
  SITE (271)..(271): Xaa at position 271 is Phe, Tyr, Met, His, Ile, Leu, Val Ala, or Gly
  SITE (281)..(281): Xaa at position 281 is Leu, Ala, Val, Gly, or Ile
  SITE (290)..(290): Xaa at position 290 is Ile, Ala, Val, Leu, or Gly
  SITE (293)..(293): Xaa at position 293 is Phe, Tyr, Met, His, Ile, Leu, Val Ala, or Gly
  SITE (294)..(294): Xaa at position 294 is Ile, Ala, Val, Leu, or Gly
  SITE (303)..(303): Xaa at position 303 is Val, Ala, Gly, Leu, or Ile
  SITE (326)..(326): Xaa at position 326 is Leu, Ala, Val, Gly, or Ile
  SITE (438)..(438): Xaa at position 438 is Ile, Ala, Val, Leu, or Gly
  SITE (470)..(470): Xaa at position 470 is Leu, Ala, Val, Gly, or Ile
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGXDVNNLDPDXRSXXSRAGISEAQXTDAETSKLXYDXXEDQGGLEAXRQEMRRQEPLPPPPPPSRGGNQXPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQXRQGIQLNKTPGAPESSALQPPPQSSEGLVGAXMHVMQKRSRAIHSSDEGEDQAGDEDEDDEWDD

SEQ ID NO: 511 - protein, 501 aa, Homo sapiens
  SITE (400)..(400): Xaa at position 400 is Cys, Ala, Val, Gly, Ser, or Thr
  SITE (409)..(409): Xaa at position 409 is Phe, Tyr, Met, His, Ile, Leu, Val Ala, or Gly
  SITE (433)..(433): Xaa at position 433 is Cys, Ala, Val, Gly, Ser, or Thr
  SITE (447)..(447): Xaa at position 447 is Ala, Gly, or Pro
  SITE (476)..(476): Xaa at position 476 is Ile, Ala, Val, Leu, or Gly
  SITE (498)..(498): Xaa at position 498 is Cys, Ala, Val, Gly, Ser, or Thr
  SITE (500)..(500): Xaa at position 500 is Cys, Ala, Val, Gly, Ser, or Thr
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARXSRKALHVNXKDMGWDDWIIAPLEYEAFHCEGLXEFPLRSHLEPTNHXVIQTLMNSMDPESTPPTCCVPTRLSPISXLFIDSANNVVYKQYEDMVVESXGXR

SEQ ID NO: 512 - protein, 410 aa, Homo sapiens
  SITE (111)..(111): Xaa at position 111 is Val, Ala, Gly, Leu, or Ile
  SITE (123)..(123): Xaa at position 123 is Met, Ile, Leu, Val, Ala, or Gly
  SITE (124)..(124): Xaa at position 124 is Val, Ala, Gly, Leu, or Ile
  SITE (126)..(126): Xaa at position 126 is Ala, Gly, or Pro
  SITE (132)..(132): Xaa at position 132 is Ile, Ala, Val, Leu, or Gly
  SITE (146)..(146): Xaa at position 146 is Leu, Ala, Val, Gly, or Ile
  SITE (153)..(153): Xaa at position 153 is Val, Ala, Gly, Leu, or Ile
  SITE (165)..(165): Xaa at position 165 is Leu, Ala, Val, Gly, or Ile
  SITE (166)..(166): Xaa at position 166 is Ala, Gly, or Pro
  SITE (168)..(168): Xaa at position 168 is Cys, Ala, Val, Gly, Ser, or Thr
  SITE (174)..(174): Xaa at position 174 is Ile, Ala, Val, Leu, or Gly
  SITE (176)..(176): Xaa at position 176 is Leu, Ala, Val, Gly, or Ile
  SITE (177)..(177): Xaa at position 177 is Trp, Tyr, Phe, Met, His, Ile, Leu Val, Ala, or Gly
  SITE (188)..(188): Xaa at position 188 is Met, Ile, Leu, Val, Ala, or Gly
  SITE (195)..(195): Xaa at position 195 is Val, Ala, Gly, Leu, or Ile
  SITE (198)..(198): Xaa at position 198 is Val, Ala, Gly, Leu, or Ile
  SITE (207)..(207): Xaa at position 207 is Ile, Ala, Val, Leu, or Gly
  SITE (208)..(208): Xaa at position 208 is Val, Ala, Gly, Leu, or Ile
  SITE (210)..(210): Xaa at position 210 is Ala, Gly, or Pro
  SITE (216)..(216): Xaa at position 216 is Ile, Ala, Val, Leu, or Gly
  SITE (219)..(219): Xaa at position 219 is Trp, Tyr, Phe, Met, His, Ile, Leu Val, Ala, or Gly
  SITE (237)..(237): Xaa at position 237 is Val, Ala, Gly, Leu, or Ile
  SITE (240)..(240): Xaa at position 240 is Val, Ala, Gly, Leu, or Ile
  SITE (249)..(249): Xaa at position 249 is Ile, Ala, Val, Leu, or Gly
  SITE (250)..(250): Xaa at position 250 is Ala, Gly, or Pro
  SITE (252)..(252): Xaa at position 252 is Cys, Ala, Val, Gly, Ser, or Thr
  SITE (258)..(258): Xaa at position 258 is Val, Ala, Gly, Leu, or Ile
  SITE (260)..(260): Xaa at position 260 is Val, Ala, Gly, Leu, or Ile
  SITE (272)..(272): Xaa at position 272 is Leu, Ala, Val, Gly, or Ile
  SITE (279)..(279): Xaa at position 279 is Val, Ala, Gly, Leu, or Ile
  SITE (281)..(281): Xaa at position 281 is Cys, Ala, Val, Gly, Ser, or Thr
  SITE (311)..(311): Xaa at position 311 is Leu, Ala, Val, Gly, or Ile
  SITE (312)..(312): Xaa at position 312 is Leu, Ala, Val, Gly, or Ile
  SITE (320)..(320): Xaa at position 320 is Ile, Ala, Val, Leu, or Gly
  SITE (334)..(334): Xaa at position 334 is Leu, Ala, Val, Gly, or Ile
  SITE (341)..(341): Xaa at position 341 is Val, Ala, Gly, Leu, or Ile
  SITE (353)..(353): Xaa at position 353 is Ile, Ala, Val, Leu, or Gly
  SITE (354)..(354): Xaa at position 354 is Leu, Ala, Val, Gly, or Ile
  SITE (356)..(356): Xaa at position 356 is Cys, Ala, Val, Gly, Ser, or Thr
  SITE (357)..(357): Xaa at position 357 is Ala, Gly, or Pro
  SITE (362)..(362): Xaa at position 362 is Leu, Ala, Val, Gly, or Ile
  SITE (365)..(365): Xaa at position 365 is Trp, Tyr, Phe, Met, His, Ile, Leu Val, Ala, or Gly
  SITE (367)..(367): Xaa at position 367 is Tyr, Phe, Met, His, Ile, Leu, Val Ala, or Gly
  SITE (383)..(383): Xaa at position 383 is Val, Ala, Gly, Leu, or Ile
  SITE (396)..(396): Xaa at position 396 is Val, Ala, Gly, Leu, or Ile
  SITE (404)..(404): Xaa at position 404 is Val, Ala, Gly, Leu, or Ile
  SITE (406)..(406): Xaa at position 406 is Val, Ala, Gly, Leu, or Ile
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPXTRVIFHPVFSVXXSXSEDATXKVWDYETGDFERTXKGHTDSXQDISFDHSGKLXXSXSADMTXKXXDFQGFECIRTXHGHDHNXSSXAIMPNGDHXXSXSRDKTXKMXEVQTGYCVKTFTGHREWXRMXRPNQDGTLXXSXSNDQTXRXWVVATKECKAEXREHEHVXEXISWAPESSYSSISEATGSETKKSGKPGPFXXSGSRDKTXKMWDVSTGMCLMTXVGHDNWXRGVLFHSGGKFXXSXXDDKTXRVXDXKNKRCMKTLNAHEHFXTSLDFHKTAPYVXTGSVDQTXKXWECR

SEQ ID NO: 513 - protein, 329 aa, Homo sapiens
  SITE (44)..(44): Xaa at position 44 is Ile, Ala, Val, Leu, or Gly
  SITE (48)..(48): Xaa at position 48 is Leu, Ala, Val, Gly, or Ile
  SITE (126)..(126): Xaa at position 126 is Tyr, Phe, Met, His, Ile, Leu, Val Ala, or Gly
  SITE (130)..(130): Xaa at position 130 is Val, Ala, Gly, Leu, or Ile
  SITE (136)..(136): Xaa at position 136 is Cys, Ala, Val, Gly, Ser, or Thr
  SITE (139)..(139): Xaa at position 139 is Cys, Ala, Val, Gly, Ser, or Thr
  SITE (140)..(140): Xaa at position 140 is Trp, Tyr, Phe, Met, His, Ile, Leu Val, Ala, or Gly
  SITE (141)..(141): Xaa at position 141 is Ala, Gly, or Pro
  SITE (147)..(147): Xaa at position 147 is Ala, Gly, or Pro
  SITE (148)..(148): Xaa at position 148 is Leu, Ala, Val, Gly, or Ile
  SITE (159)..(159): Xaa at position 159 is Leu, Ala, Val, Gly, or Ile
  SITE (162)..(162): Xaa at position 162 is Leu, Ala, Val, Gly, or Ile
  SITE (167)..(167): Xaa at position 167 is Leu, Ala, Val, Gly, or Ile
  SITE (168)..(168): Xaa at position 168 is Val, Ala, Gly, Leu, or Ile
  SITE (171)..(171): Xaa at position 171 is Val, Ala, Gly, Leu, or Ile
  SITE (185)..(185): Xaa at position 185 is Ala, Gly, or Pro
  SITE (186)..(186): Xaa at position 186 is Phe, Tyr, Met, His, Ile, Leu, Val Ala, or Gly
  SITE (189)..(189): Xaa at position 189 is Val, Ala, Gly, Leu, or Ile
  SITE (195)..(195): Xaa at position 195 is Ile, Ala, Val, Leu, or Gly
  SITE (201)..(201): Xaa at position 201 is Tyr, Phe, Met, His, Ile, Leu, Val Ala, or Gly
  SITE (211)..(211): Xaa at position 211 is Met, Ile, Leu, Val, Ala, or Gly
  SITE (219)..(219): Xaa at position 219 is Ala, Gly, or Pro
  SITE (221)..(221): Xaa at position 221 is Cys, Ala, Val, Gly, Ser, or Thr
  SITE (227)..(227): Xaa at position 227 is Ile, Ala, Val, Leu, or Gly
  SITE (235)..(235): Xaa at position 235 is Leu, Ala, Val, Gly, or Ile
  SITE (238)..(238): Xaa at position 238 is Ala, Gly, or Pro
  SITE (239)..(239): Xaa at position 239 is Val, Ala, Gly, Leu, or Ile
  SITE (242)..(242): Xaa at position 242 is Val, Ala, Gly, Leu, or Ile
  SITE (245)..(245): Xaa at position 245 is Val, Ala, Gly, Leu, or Ile
  SITE (247)..(247): Xaa at position 247 is Val, Ala, Gly, Leu, or Ile
  SITE (248)..(248): Xaa at position 248 is Ala, Gly, or Pro
  SITE (249)..(249): Xaa at position 249 is Ile, Ala, Val, Leu, or Gly
  SITE (251)..(251): Xaa at position 251 is Ala, Gly, or Pro
  SITE (256)..(256): Xaa at position 256 is Phe, Tyr, Met, His, Ile, Leu, Val Ala, or Gly
  SITE (258)..(258): Xaa at position 258 is Phe, Tyr, Met, His, Ile, Leu, Val Ala, or Gly
  SITE (264)..(264): Xaa at position 264 is Tyr, Phe, Met, His, Ile, Leu, Val Ala, or Gly
  SITE (265)..(265): Xaa at position 265 is Tyr, Phe, Met, His, Ile, Leu, Val Ala, or Gly
  SITE (274)..(274): Xaa at position 274 is Leu, Ala, Val, Gly, or Ile
  SITE (276)..(276): Xaa at position 276 is His, Phe, Tyr, Lys, Arg, Gly, Ser Thr, Ala, Val, Leu, Ile, Asn, Met, or Gln
  SITE (277)..(277): Xaa at position 277 is Ala, Gly, or Pro
  SITE (278)..(278): Xaa at position 278 is Val, Ala, Gly, Leu, or Ile
  SITE (279)..(279): Xaa at position 279 is Leu, Ala, Val, Gly, or Ile
  SITE (280)..(280): Xaa at position 280 is Ala, Gly, or Pro
  SITE (281)..(281): Xaa at position 281 is Val, Ala, Gly, Leu, or Ile
  SITE (283)..(283): Xaa at position 283 is Tyr, Phe, Met, His, Ile, Leu, Val Ala, or Gly
  SITE (292)..(292): Xaa at position 292 is Trp, Tyr, Phe, Met, His, Ile, Leu Val, Ala, or Gly
  SITE (294)..(294): Xaa at position 294 is Ile, Ala, Val, Leu, or Gly
  SITE (302)..(302): Xaa at position 302 is Trp, Tyr, Phe, Met, His, Ile, Leu Val, Ala, or Gly
  SITE (308)..(308): Xaa at position 308 is Ile, Ala, Val, Leu, or Gly
  SITE (310)..(310): Xaa at position 310 is Met, Ile, Leu, Val, Ala, or Gly
  SITE (311)..(311): Xaa at position 311 is Ala, Gly, or Pro
  SITE (317)..(317): Xaa at position 317 is Ala, Gly, or Pro
  SITE (318)..(318): Xaa at position 318 is Cys, Ala, Val, Gly, Ser, or Thr
  SITE (320)..(320): Xaa at position 320 is Ile, Ala, Val, Leu, or Gly
  SITE (321)..(321): Xaa at position 321 is Ala, Gly, or Pro
  SITE (323)..(323): Xaa at position 323 is Leu, Ala, Val, Gly, or Ile
  SITE (324)..(324): Xaa at position 324 is Ala, Gly, or Pro
MWGLKVLLLPVVSFALYPEEILDTHWELWKKTHRKQYNNKVDEXSRRXIWEKNLKYISIHNLEASLGVHTYELAMNHLGDMTSEEVVQKMTGLKVPLSHSRSNDTLYIPEWEGRAPDSVDYRKKGXVTPXKNQGQXGSXXXFSSVGXXEGQLKKKTGKXLNXSPQNXXDCXSENDGCGGGYMTNXXQYXQKNRGXDSEDAXPYVGQEESCXYNPTGKAXKXRGYREXPEGNEKAXKRXXARXGPXSXXXDXSLTSXQXYSKGVXXDESCNSDNXNXXXXXXGXGIQKGNKHXIXKNSWGENXGNKGYXLXXRNKNNXXGXXNXXSFPKM

SEQ ID NO: 514 - protein, 550 aa, Influenza A virus
  strain A/Duck/Hong Kong/64/1976 H3
  SITE (11)..(11): Xaa at position 11 is Ala, Gly, or Pro
  SITE (13)..(13): Xaa at position 13 is Leu, Ala, Val, Gly, or Ile
  SITE (14)..(14): Xaa at position 14 is Cys, Ala, Val, Gly, Ser, or Thr
  SITE (15)..(15): Xaa at position 15 is Leu, Ala, Val, Gly, or Ile
  SITE (19)..(19): Xaa at position 19 is Ala, Gly, or Pro
  SITE (26)..(26): Xaa at position 26 is Val, Ala, Gly, Leu, or Ile
  SITE (36)..(36): Xaa at position 36 is Val, Ala, Gly, Leu, or Ile
  SITE (42)..(42): Xaa at position 42 is Leu, Ala, Val, Gly, or Ile
  SITE (43)..(43): Xaa at position 43 is Val, Ala, Gly, Leu, or Ile
  SITE (51)..(51): Xaa at position 51 is Ile, Ala, Val, Leu, or Gly
  SITE (52)..(52): Xaa at position 52 is Cys, Ala, Val, Gly, Ser, or Thr
  SITE (58)..(58): Xaa at position 58 is Ile, Ala, Val, Leu, or Gly
  SITE (64)..(64): Xaa at position 64 is Cys, Ala, Val, Gly, Ser, or Thr
  SITE (66)..(66): Xaa at position 66 is Leu, Ala, Val, Gly, or Ile
  SITE (67)..(67): Xaa at position 67 is Ile, Ala, Val, Leu, or Gly
  SITE (70)..(70): Xaa at position 70 is Leu, Ala, Val, Gly, or Ile
  SITE (71)..(71): Xaa at position 71 is Leu, Ala, Val, Gly, or Ile
  SITE (76)..(76): Xaa at position 76 is Cys, Ala, Val, Gly, Ser, or Thr
  SITE (79)..(79): Xaa at position 79 is Phe, Tyr, Met, His, Ile, Leu, Val Ala, or Gly
  SITE (86)..(86): Xaa at position 86 is Leu, Ala, Val, Gly, or Ile
  SITE (87)..(87): Xaa at position 87 is Phe, Tyr, Met, His, Ile, Leu, Val Ala, or Gly
  SITE (88)..(88): Xaa at position 88 is Val, Ala, Gly, Leu, or Ile
  SITE (94)..(94): Xaa at position 94 is Phe, Tyr, Met, His, Ile, Leu, Val Ala, or Gly
  SITE (97)..(97): Xaa at position 97 is Cys, Ala, Val, Gly, Ser, or Thr
  SITE (98)..(98): Xaa at position 98 is Tyr, Phe, Met, His, Ile, Leu, Val Ala, or Gly
  SITE (100)..(100): Xaa at position 100 is Tyr, Phe, Met, His, Ile, Leu, Val Ala, or Gly
  SITE (105)..(105): Xaa at position 105 is Tyr, Phe, Met, His, Ile, Leu, Val Ala, or Gly
  SITE (106)..(106): Xaa at position 106 is Ala, Gly, or Pro
  SITE (108)..(108): Xaa at position 108 is Leu, Ala, Val, Gly, or Ile
  SITE (112)..(112): Xaa at position 112 is Val, Ala, Gly, Leu, or Ile
  SITE (113)..(113): Xaa at position 113 is Ala, Gly, or Pro
  SITE (118)..(118): Xaa at position 118 is Leu, Ala, Val, Gly, or Ile
  SITE (125)..(125): Xaa at position 125 is Phe, Tyr, Met, His, Ile, Leu, Val Ala, or Gly
  SITE (138)..(138): Xaa at position 138 is Ala, Gly, or Pro
  SITE (139)..(139): Xaa at position 139 is Cys, Ala, Val, Gly, Ser, or Thr
  SITE (147)..(147): Xaa at position 147 is Phe, Tyr, Met, His, Ile, Leu, Val Ala, or Gly
  SITE (148)..(148): Xaa at position 148 is Phe, Tyr, Met, His, Ile, Leu, Val Ala, or Gly
  SITE (151)..(151): Xaa at position 151 is Leu, Ala, Val, Gly, or Ile
  SITE (154)..(154): Xaa at position 154 is Leu, Ala, Val, Gly, or Ile
  SITE (164)..(164): Xaa at position 164 is Leu, Ala, Val, Gly, or Ile
  SITE (178)..(178): Xaa at position 178 is Tyr, Phe, Met, His, Ile, Leu, Val Ala, or Gly
  SITE (180)..(180): Xaa at position 180 is Trp, Tyr, Phe, Met, His, Ile, Leu Val, Ala, or Gly
  SITE (182)..(182): Xaa at position 182 is Val, Ala, Gly, Leu, or Ile
  SITE (183)..(183): Xaa at position 183 is His, Phe, Tyr, Lys, Arg, Gly, Ser Thr, Ala, Val, Leu, Ile, Asn, Met, or Gln
  SITE (184)..(184): Xaa at position 184 is His, Phe, Tyr, Lys, Arg, Gly, Ser Thr, Ala, Val, Leu, Ile, Asn, Met, or Gln
  SITE (195)..(195): Xaa at position 195 is Tyr, Phe, Met, His, Ile, Leu, Val Ala, or Gly
  SITE (202)..(202): Xaa at position 202 is Val, Ala, Gly, Leu, or Ile
  SITE (204)..(204): Xaa at position 204 is Val, Ala, Gly, Leu, or Ile
  SITE (230)..(230): Xaa at position 230 is Ile, Ala, Val, Leu, or Gly
  SITE (232)..(232): Xaa at position 232 is Ile, Ala, Val, Leu, or Gly
  SITE (233)..(233): Xaa at position 233 is Tyr, Phe, Met, His, Ile, Leu, Val Ala, or Gly
  SITE (236)..(236): Xaa at position 236 is Ile, Ala, Val, Leu, or Gly
  SITE (237)..(237): Xaa at position 237 is Val, Ala, Gly, Leu, or Ile
  SITE (242)..(242): Xaa at position 242 is Val, Ala, Gly, Leu, or Ile
  SITE (243)..(243): Xaa at position 243 is Leu, Ala, Val, Gly, or Ile
  SITE (245)..(245): Xaa at position 245 is Ile, Ala, Val, Leu, or Gly
  SITE (251)..(251): Xaa at position 251 is Leu, Ala, Val, Gly, or Ile
  SITE (252)..(252): Xaa at position 252 is Ile, Ala, Val, Leu, or Gly
  SITE (253)..(253): Xaa at position 253 is Ala, Gly, or Pro
  SITE (258)..(258): Xaa at position 258 is Phe, Tyr, Met, His, Ile, Leu, Val Ala, or Gly
  SITE (274)..(274): Xaa at position 274 is Ile, Ala, Val, Leu, or Gly
  SITE (281)..(281): Xaa at position 281 is Cys, Ala, Val, Gly, Ser, or Thr
  SITE (282)..(282): Xaa at position 282 is Ile, Ala, Val, Leu, or Gly
  SITE (288)..(288): Xaa at position 288 is Ile, Ala, Val, Leu, or Gly
  SITE (309)..(309): Xaa at position 309 is Val, Ala, Gly, Leu, or Ile
  SITE (316)..(316): Xaa at position 316 is Leu, Ala, Val, Gly, or Ile
  SITE (317)..(317): Xaa at position 317 is Ala, Gly, or Pro
  SITE (334)..(334): Xaa at position 334 is Ala, Gly, or Pro
  SITE (343)..(343): Xaa at position 343 is Trp, Tyr, Phe, Met, His, Ile, Leu Val, Ala, or Gly
  SITE (351)..(351): Xaa at position 351 is Tyr, Phe, Met, His, Ile, Leu, Val Ala, or Gly
  SITE (373)..(373): Xaa at position 373 is Ala, Gly, or Pro
  SITE (425)..(425): Xaa at position 425 is Ala, Gly, or Pro
  SITE (447)..(447): Xaa at position 447 is Leu, Ala, Val, Gly, or Ile
  SITE (455)..(455): Xaa at position 455 is Leu, Ala, Val, Gly, or Ile
  SITE (466)..(466): Xaa at position 466 is Cys, Ala, Val, Gly, Ser, or Thr
  SITE (467)..(467): Xaa at position 467 is Phe, Tyr, Met, His, Ile, Leu, Val Ala, or Gly
  SITE (469)..(469): Xaa at position 469 is Ile, Ala, Val, Leu, or Gly
  SITE (471)..(471): Xaa at position 471 is His, Phe, Tyr, Lys, Arg, Gly, Ser Thr, Ala, Val, Leu, Ile, Asn, Met, or Gln
  SITE (473)..(473): Xaa at position 473 is Cys, Ala, Val, Gly, Ser, or Thr
  SITE (477)..(477): Xaa at position 477 is Cys, Ala, Val, Gly, Ser, or Thr
  SITE (478)..(478): Xaa at position 478 is Ile, Ala, Val, Leu, or Gly
  SITE (481)..(481): Xaa at position 481 is Ile, Ala, Val, Leu, or Gly
  SITE (495)..(495): Xaa at position 495 is Ala, Gly, or Pro
QDLPGTDNSTXTXXXGHHXVPNGTIXKTITDDQIEXTNATEXXQSSSTGKXXNNPHRXLDGRDXTXXDAXXGDPHXDVXQDETWDXXXERSNAXSNXXPXDVPDXXSXRSLXXSSGTXEFITEGXTWTGVTQNGGSNXXKRGPANGXXSRXNWXTKSGSTYPVXNVTMPNNDNFDKLXIXGXXXPSTNQEQTNLXVQASGRXTXSTRRSQQTIIPNIGSRPWVRGQSGRXSXXWTXXKPGDXXVXNSNGNXXXPRGYXKMRTGKSSIMRSDALXDTCVSEXXTPNGSXPNDKPFQNVNKITYGACPKYXKQNTLKXXIGMRNVPEKQTRGLFGXIAGFIENGXEGMIDGWXGFRHQNSEGTGQAADLKSTQAXIDQINGKLNRVIEKTNEKFHQIEKEFSEVEGRIQDLEKYVEDTKIDLWSYNXDVLVALENQHTIDLTDSEMNKXFEKTRRQXRENAEDMGNGXXKXYXKXDNAXXESXRNGTYDHDIYRDEXLNNRFQIKGVELKSGYKDWILWISFAISCFLLCVVLLGFIMWACQRGNIRCNICI

SEQ ID NO: 515 - protein, 550 aa, Influenza A virus
  strain A/Duck/Hong Kong/231/1977 H3
  SITE (11)..(11): Xaa at position 11 is Ala, Gly, or Pro
  SITE (13)..(13): Xaa at position 13 is Leu, Ala, Val, Gly, or Ile
  SITE (14)..(14): Xaa at position 14 is Cys, Ala, Val, Gly, Ser, or Thr
  SITE (15)..(15): Xaa at position 15 is Leu, Ala, Val, Gly, or Ile
  SITE (19)..(19): Xaa at position 19 is Ala, Gly, or Pro
  SITE (26)..(26): Xaa at position 26 is Val, Ala, Gly, Leu, or Ile
  SITE (36)..(36): Xaa at position 36 is Val, Ala, Gly, Leu, or Ile
  SITE (42)..(42): Xaa at position 42 is Leu, Ala, Val, Gly, or Ile
  SITE (43)..(43): Xaa at position 43 is Val, Ala, Gly, Leu, or Ile
  SITE (51)..(51): Xaa at position 51 is Ile, Ala, Val, Leu, or Gly
  SITE (52)..(52): Xaa at position 52 is Cys, Ala, Val, Gly, Ser, or Thr
  SITE (58)..(58): Xaa at position 58 is Ile, Ala, Val, Leu, or Gly
  SITE (64)..(64): Xaa at position 64 is Cys, Ala, Val, Gly, Ser, or Thr
  SITE (66)..(66): Xaa at position 66 is Leu, Ala, Val, Gly, or Ile
  SITE (67)..(67): Xaa at position 67 is Ile, Ala, Val, Leu, or Gly
  SITE (70)..(70): Xaa at position 70 is Leu, Ala, Val, Gly, or Ile
  SITE (71)..(71): Xaa at position 71 is Leu, Ala, Val, Gly, or Ile
  SITE (76)..(76): Xaa at position 76 is Cys, Ala, Val, Gly, Ser, or Thr
  SITE (79)..(79): Xaa at position 79 is Phe, Tyr, Met, His, Ile, Leu, Val Ala, or Gly
  SITE (86)..(86): Xaa at position 86 is Leu, Ala, Val, Gly, or Ile
  SITE (87)..(87): Xaa at position 87 is Phe, Tyr, Met, His, Ile, Leu, Val Ala, or Gly
  SITE (88)..(88): Xaa at position 88 is Val, Ala, Gly, Leu, or Ile
  SITE (94)..(94): Xaa at position 94 is Tyr, Phe, Met, His, Ile, Leu, Val Ala, or Gly
  SITE (97)..(97): Xaa at position 97 is Cys, Ala, Val, Gly, Ser, or Thr
  SITE (98)..(98): Xaa at position 98 is Tyr, Phe, Met, His, Ile, Leu, Val Ala, or Gly
  SITE (100)..(100): Xaa at position 100 is Tyr, Phe, Met, His, Ile, Leu, Val Ala, or Gly
  SITE (105)..(105): Xaa at position 105 is Tyr, Phe, Met, His, Ile, Leu, Val Ala, or Gly
  SITE (106)..(106): Xaa at position 106 is Ala, Gly, or Pro
  SITE (108)..(108): Xaa at position 108 is Leu, Ala, Val, Gly, or Ile
  SITE (112)..(112): Xaa at position 112 is Val, Ala, Gly, Leu, or Ile
  SITE (113)..(113): Xaa at position 113 is Ala, Gly, or Pro
  SITE (118)..(118): Xaa at position 118 is Leu, Ala, Val, Gly, or Ile
  SITE (125)..(125): Xaa at position 125 is Phe, Tyr, Met, His, Ile, Leu, Val Ala, or Gly
  SITE (138)..(138): Xaa at position 138 is Ala, Gly, or Pro
  SITE (139)..(139): Xaa at position 139 is Cys, Ala, Val, Gly, Ser, or Thr
  SITE (147)..(147): Xaa at position 147 is Phe, Tyr, Met, His, Ile, Leu, Val Ala, or Gly
  SITE (148)..(148): Xaa at position 148 is Phe, Tyr, Met, His, Ile, Leu, Val Ala, or Gly
  SITE (151)..(151): Xaa at position 151 is Leu, Ala, Val, Gly, or Ile
  SITE (154)..(154): Xaa at position 154 is Leu, Ala, Val, Gly, or Ile
  SITE (164)..(164): Xaa at position 164 is Leu, Ala, Val, Gly, or Ile
  SITE (178)..(178): Xaa at position 178 is Tyr, Phe, Met, His, Ile, Leu, Val Ala, or Gly
  SITE (180)..(180): Xaa at position 180 is Trp, Tyr, Phe, Met, His, Ile, Leu Val, Ala, or Gly
  SITE (182)..(182): Xaa at position 182 is Ile, Ala, Val, Leu, or Gly
  SITE (183)..(183): Xaa at position 183 is His, Phe, Tyr, Lys, Arg, Gly, Ser Thr, Ala, Val, Leu, Ile, Asn, Met, or Gln
  SITE (184)..(184): Xaa at position 184 is His, Phe, Tyr, Lys, Arg, Gly, Ser Thr, Ala, Val, Leu, Ile, Asn, Met, or Gln
  SITE (195)..(195): Xaa at position 195 is Tyr, Phe, Met, His, Ile, Leu, Val Ala, or Gly
  SITE (202)..(202): Xaa at position 202 is Val, Ala, Gly, Leu, or Ile
  SITE (204)..(204): Xaa at position 204 is Val, Ala, Gly, Leu, or Ile
  SITE (230)..(230): Xaa at position 230 is Ile, Ala, Val, Leu, or Gly
  SITE (232)..(232): Xaa at position 232 is Ile, Ala, Val, Leu, or Gly
  SITE (233)..(233): Xaa at position 233 is Tyr, Phe, Met, His, Ile, Leu, Val Ala, or Gly
  SITE (236)..(236): Xaa at position 236 is Ile, Ala, Val, Leu, or Gly
  SITE (237)..(237): Xaa at position 237 is Val, Ala, Gly, Leu, or Ile
  SITE (242)..(242): Xaa at position 242 is Val, Ala, Gly, Leu, or Ile
  SITE (243)..(243): Xaa at position 243 is Leu, Ala, Val, Gly, or Ile
  SITE (245)..(245): Xaa at position 245 is Ile, Ala, Val, Leu, or Gly
  SITE (251)..(251): Xaa at position 251 is Leu, Ala, Val, Gly, or Ile
  SITE (252)..(252): Xaa at position 252 is Ile, Ala, Val, Leu, or Gly
  SITE (253)..(253): Xaa at position 253 is Ala, Gly, or Pro
  SITE (258)..(258): Xaa at position 258 is Phe, Tyr, Met, His, Ile, Leu, Val Ala, or Gly
  SITE (274)..(274): Xaa at position 274 is Ile, Ala, Val, Leu, or Gly
  SITE (281)..(281): Xaa at position 281 is Cys, Ala, Val, Gly, Ser, or Thr
  SITE (282)..(282): Xaa at position 282 is Ile, Ala, Val, Leu, or Gly
  SITE (288)..(288): Xaa at position 288 is Ile, Ala, Val, Leu, or Gly
  SITE (309)..(309): Xaa at position 309 is Val, Ala, Gly, Leu, or Ile
  SITE (316)..(316): Xaa at position 316 is Leu, Ala, Val, Gly, or Ile
  SITE (317)..(317): Xaa at position 317 is Ala, Gly, or Pro
  SITE (334)..(334): Xaa at position 334 is Ala, Gly, or Pro
  SITE (343)..(343): Xaa at position 343 is Trp, Tyr, Phe, Met, His, Ile, Leu Val, Ala, or Gly
  SITE (351)..(351): Xaa at position 351 is Tyr, Phe, Met, His, Ile, Leu, Val Ala, or Gly
  SITE (373)..(373): Xaa at position 373 is Ala, Gly, or Pro
  SITE (425)..(425): Xaa at position 425 is Ala, Gly, or Pro
  SITE (447)..(447): Xaa at position 447 is Leu, Ala, Val, Gly, or Ile
  SITE (455)..(455): Xaa at position 455 is Leu, Ala, Val, Gly, or Ile
  SITE (466)..(466): Xaa at position 466 is Cys, Ala, Val, Gly, Ser, or Thr
  SITE (467)..(467): Xaa at position 467 is Phe, Tyr, Met, His, Ile, Leu, Val Ala, or Gly
  SITE (469)..(469): Xaa at position 469 is Ile, Ala, Val, Leu, or Gly
  SITE (471)..(471): Xaa at position 471 is His, Phe, Tyr, Lys, Arg, Gly, Ser Thr, Ala, Val, Leu, Ile, Asn, Met, or Gln
  SITE (473)..(473): Xaa at position 473 is Cys, Ala, Val, Gly, Ser, or Thr
  SITE (477)..(477): Xaa at position 477 is Cys, Ala, Val, Gly, Ser, or Thr
  SITE (478)..(478): Xaa at position 478 is Ile, Ala, Val, Leu, or Gly
  SITE (481)..(481): Xaa at position 481 is Ile, Ala, Val, Leu, or Gly
  SITE (495)..(495): Xaa at position 495 is Ala, Gly, or Pro
QDLPGNDDSTXTXXXGHHXVTNGTIXKTITDDQIEXTNATEXXQSSSTGKXXNNPHRXLDGRDXTXXDAXXGDPHXDVXQDETWDXXXERSNAXSNXXPXDVPDXXSXRSLXXSSGTXEFITEGXTWTGVTQNGGSNXXKRGPANGXXSRXNWXTKSGSTYPVXNVTMPNNDNFDKLXIXGXXXPSTSQEQTTLXVQASGRXIXSTRRSQQTIISNIGSRPWVRGQSGRXSXXWTXXKSGDXXVXNSNGNXXXPRGYXKMRTGKSSIMRSDAPXDTCISEXXTPNGSXPNDKPFQNVNKITYGACPKYXKQNTLKXXTGMRNVPEKQTRGLFGXIAGFIENGXEGMIDVWXGFRHQNSEGTGQAADLKSTQAXIDQINGKLNRVIEKTNEKFHQIEKEFSEVEGRIQDLEKYVEDTKIDLWSYNXDVLVALENQHTIDLTDSEMNKXFEKTRRQXRENAEDMGNGXXKXYXKXDNTXXESXRNGTYDHDVYRDEXLNNRFQIKGVELKSGYKDWILWISFAISCFLLCVVLLGFIMWACQRGNIRCNICI

SEQ ID NO: 516 - protein, 550 aa, Influenza A virus
  strain A/Goose/Hong Kong/10/1976 H3
  SITE (11)..(11): Xaa at position 11 is Ala, Gly, or Pro
  SITE (13)..(13): Xaa at position 13 is Leu, Ala, Val, Gly, or Ile
  SITE (14)..(14): Xaa at position 14 is Cys, Ala, Val, Gly, Ser, or Thr
  SITE (15)..(15): Xaa at position 15 is Leu, Ala, Val, Gly, or Ile
  SITE (19)..(19): Xaa at position 19 is Ala, Gly, or Pro
  SITE (26)..(26): Xaa at position 26 is Val, Ala, Gly, Leu, or Ile
  SITE (36)..(36): Xaa at position 36 is Val, Ala, Gly, Leu, or Ile
  SITE (42)..(42): Xaa at position 42 is Leu, Ala, Val, Gly, or Ile
  SITE (43)..(43): Xaa at position 43 is Val, Ala, Gly, Leu, or Ile
  SITE (51)..(51): Xaa at position 51 is Ile, Ala, Val, Leu, or Gly
  SITE (52)..(52): Xaa at position 52 is Cys, Ala, Val, Gly, Ser, or Thr
  SITE (58)..(58): Xaa at position 58 is Ile, Ala, Val, Leu, or Gly
  SITE (64)..(64): Xaa at position 64 is Cys, Ala, Val, Gly, Ser, or Thr
  SITE (66)..(66): Xaa at position 66 is Leu, Ala, Val, Gly, or Ile
  SITE (67)..(67): Xaa at position 67 is Ile, Ala, Val, Leu, or Gly
  SITE (70)..(70): Xaa at position 70 is Leu, Ala, Val, Gly, or Ile
  SITE (71)..(71): Xaa at position 71 is Leu, Ala, Val, Gly, or Ile
  SITE (76)..(76): Xaa at position 76 is Cys, Ala, Val, Gly, Ser, or Thr
  SITE (79)..(79): Xaa at position 79 is Phe, Tyr, Met, His, Ile, Leu, Val Ala, or Gly
  SITE (86)..(86): Xaa at position 86 is Leu, Ala, Val, Gly, or Ile
  SITE (87)..(87): Xaa at position 87 is Phe, Tyr, Met, His, Ile, Leu, Val Ala, or Gly
  SITE (88)..(88): Xaa at position 88 is Val, Ala, Gly, Leu, or Ile
  SITE (94)..(94): Xaa at position 94 is Phe, Tyr, Met, His, Ile, Leu, Val Ala, or Gly
  SITE (97)..(97): Xaa at position 97 is Cys, Ala, Val, Gly, Ser, or Thr
  SITE (98)..(98): Xaa at position 98 is Tyr, Phe, Met, His, Ile, Leu, Val Ala, or Gly
  SITE (100)..(100): Xaa at position 100 is Tyr, Phe, Met, His, Ile, Leu, Val Ala, or Gly
  SITE (105)..(105): Xaa at position 105 is Tyr, Phe, Met, His, Ile, Leu, Val Ala, or Gly
  SITE (106)..(106): Xaa at position 106 is Ala, Gly, or Pro
  SITE (108)..(108): Xaa at position 108 is Leu, Ala, Val, Gly, or Ile
  SITE (112)..(112): Xaa at position 112 is Val, Ala, Gly, Leu, or Ile
  SITE (113)..(113): Xaa at position 113 is Ala, Gly, or Pro
  SITE (118)..(118): Xaa at position 118 is Leu, Ala, Val, Gly, or Ile
  SITE (125)..(125): Xaa at position 125 is Phe, Tyr, Met, His, Ile, Leu, Val Ala, or Gly
  SITE (138)..(138): Xaa at position 138 is Ala, Gly, or Pro
  SITE (139)..(139): Xaa at position 139 is Cys, Ala, Val, Gly, Ser, or Thr
  SITE (147)..(147): Xaa at position 147 is Phe, Tyr, Met, His, Ile, Leu, Val Ala, or Gly
  SITE (148)..(148): Xaa at position 148 is Phe, Tyr, Met, His, Ile, Leu, Val Ala, or Gly
  SITE (151)..(151): Xaa at position 151 is Leu, Ala, Val, Gly, or Ile
  SITE (154)..(154): Xaa at position 154 is Leu, Ala, Val, Gly, or Ile
  SITE (164)..(164): Xaa at position 164 is Leu, Ala, Val, Gly, or Ile
  SITE (178)..(178): Xaa at position 178 is Tyr, Phe, Met, His, Ile, Leu, Val Ala, or Gly
  SITE (180)..(180): Xaa at position 180 is Trp, Tyr, Phe, Met, His, Ile, Leu Val, Ala, or Gly
  SITE (182)..(182): Xaa at position 182 is Val, Ala, Gly, Leu, or Ile
  SITE (183)..(183): Xaa at position 183 is His, Phe, Tyr, Lys, Arg, Gly, Ser Thr, Ala, Val, Leu, Ile, Asn, Met, or Gln
  SITE (184)..(184): Xaa at position 184 is His, Phe, Tyr, Lys, Arg, Gly, Ser Thr, Ala, Val, Leu, Ile, Asn, Met, or Gln
  SITE (195)..(195): Xaa at position 195 is Tyr, Phe, Met, His, Ile, Leu, Val Ala, or Gly
  SITE (202)..(202): Xaa at position 202 is Val, Ala, Gly, Leu, or Ile
  SITE (204)..(204): Xaa at position 204 is Val, Ala, Gly, Leu, or Ile
  SITE (230)..(230): Xaa at position 230 is Ile, Ala, Val, Leu, or Gly
  SITE (232)..(232): Xaa at position 232 is Ile, Ala, Val, Leu, or Gly
  SITE (233)..(233): Xaa at position 233 is Tyr, Phe, Met, His, Ile, Leu, Val Ala, or Gly
  SITE (236)..(236): Xaa at position 236 is Ile, Ala, Val, Leu, or Gly
  SITE (237)..(237): Xaa at position 237 is Val, Ala, Gly, Leu, or Ile
  SITE (242)..(242): Xaa at position 242 is Val, Ala, Gly, Leu, or Ile
  SITE (243)..(243): Xaa at position 243 is Leu, Ala, Val, Gly, or Ile
  SITE (245)..(245): Xaa at position 245 is Ile, Ala, Val, Leu, or Gly
  SITE (251)..(251): Xaa at position 251 is Leu, Ala, Val, Gly, or Ile
  SITE (252)..(252): Xaa at position 252 is Ile, Ala, Val, Leu, or Gly
  SITE (253)..(253): Xaa at position 253 is Ala, Gly, or Pro
  SITE (258)..(258): Xaa at position 258 is Phe, Tyr, Met, His, Ile, Leu, Val Ala, or Gly
  SITE (274)..(274): Xaa at position 274 is Ile, Ala, Val, Leu, or Gly
  SITE (281)..(281): Xaa at position 281 is Cys, Ala, Val, Gly, Ser, or Thr
  SITE (282)..(282): Xaa at position 282 is Ile, Ala, Val, Leu, or Gly
  SITE (288)..(288): Xaa at position 288 is Ile, Ala, Val, Leu, or Gly
  SITE (309)..(309): Xaa at position 309 is Val, Ala, Gly, Leu, or Ile
  SITE (316)..(316): Xaa at position 316 is Leu, Ala, Val, Gly, or Ile
  SITE (317)..(317): Xaa at position 317 is Ala, Gly, or Pro
  SITE (334)..(334): Xaa at position 334 is Ala, Gly, or Pro
  SITE (343)..(343): Xaa at position 343 is Trp, Tyr, Phe, Met, His, Ile, Leu Val, Ala, or Gly
  SITE (351)..(351): Xaa at position 351 is Tyr, Phe, Met, His, Ile, Leu, Val Ala, or Gly
  SITE (373)..(373): Xaa at position 373 is Ala, Gly, or Pro
  SITE (425)..(425): Xaa at position 425 is Ala, Gly, or Pro
  SITE (447)..(447): Xaa at position 447 is Leu, Ala, Val, Gly, or Ile
  SITE (455)..(455): Xaa at position 455 is Leu, Ala, Val, Gly, or Ile
  SITE (466)..(466): Xaa at position 466 is Cys, Ala, Val, Gly, Ser, or Thr
  SITE (467)..(467): Xaa at position 467 is Phe, Tyr, Met, His, Ile, Leu, Val Ala, or Gly
  SITE (469)..(469): Xaa at position 469 is Ile, Ala, Val, Leu, or Gly
  SITE (471)..(471): Xaa at position 471 is His, Phe, Tyr, Lys, Arg, Gly, Ser Thr, Ala, Val, Leu, Ile, Asn, Met, or Gln
  SITE (473)..(473): Xaa at position 473 is Cys, Ala, Val, Gly, Ser, or Thr
  SITE (477)..(477): Xaa at position 477 is Cys, Ala, Val, Gly, Ser, or Thr
  SITE (478)..(478): Xaa at position 478 is Ile, Ala, Val, Leu, or Gly
  SITE (481)..(481): Xaa at position 481 is Ile, Ala, Val, Leu, or Gly
  SITE (495)..(495): Xaa at position 495 is Ala, Gly, or Pro
QDLPGTDNSTXTXXXGHHXVPNGTIXKTITDDQIEXTNATEXXQTSSTGKXXNNPHRXLDGRDXTXXDAXXGDPHXDVXQDETWDXXXERSNAXSNXXPXDVPDXXSXRSLXXSSGTXEFITEGXTWTGVTQNGGSNXXKRGPANGXXSRXNWXTKSGSTYPVXNVTMPNNDNFDKLXIXGXXXPSTNQEQTNLXVQASGRXTXSTRRSQQTIIPNIGSRPWVRGQSGRXSXXWTXXKPGDXXVXNSNGNXXXPRGYXKMRTGKSSIMRSDALXDTCVSEXXTPNGSXPNDKPFQNVNKITYGACPKYXKQNTLKXXIGMRNVPEKQTRGLFGXIAGFIENGXEGMIDGWXGFRHQNSEGTGQAADLKSTQAXIDQINGKLNRVIEKTNGKFHQIEKEFSEVEGRIQDLEKYVEDTKIDLWSYNXDVLVALENQHTIDLTDSEMNKXFEKTRRQXRENAEDMGNGXXKXYXKXDNTXXESXRNGTYDHDVYRDEXLNNRFQIKGVELKSGYKDWILWISFAISCFLLCVVLLGFIMWACQRGNIRCNICI

SEQ ID NO: 517 - protein, 627 aa, Homo sapiens
  SITE (141)..(141): Xaa at position 141 is Ala, Gly, or Pro
  SITE (142)..(142): Xaa at position 142 is His, Phe, Tyr, Lys, Arg, Gly, Ser Thr, Ala, Val, Leu, Ile, Asn, Met, or Gln
  SITE (155)..(155): Xaa at position 155 is Ala, Gly, or Pro
  SITE (165)..(165): Xaa at position 165 is Val, Ala, Gly, Leu, or Ile
  SITE (189)..(189): Xaa at position 189 is Ile, Ala, Val, Leu, or Gly
  SITE (191)..(191): Xaa at position 191 is Leu, Ala, Val, Gly, or Ile
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKXXLFHDGRVQWTPPXIYKSSCSIDXTFFPFDQQNCTMKFGSWTYDKAKXDXVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 518 - protein, 158 aa, Haemophilus influenzae
  strain ATCC 51907 / DSM 11121 / KW20 / Rd
  SITE (11)..(11): Xaa at position 11 is His, Phe, Tyr, Lys, Arg, Gly, Ser Thr, Ala, Val, Leu, Ile, Asn, Met, or Gln
  SITE (19)..(19): Xaa at position 19 is Leu, Ala, Val, Gly, or Ile
  SITE (20)..(20): Xaa at position 20 is Ile, Ala, Val, Leu, or Gly
  SITE (21)..(21): Xaa at position 21 is Ile, Ala, Val, Leu, or Gly
  SITE (26)..(26): Xaa at position 26 is Val, Ala, Gly, Leu, or Ile
  SITE (32)..(32): Xaa at position 32 is Phe, Tyr, Met, His, Ile, Leu, Val Ala, or Gly
  SITE (33)..(33): Xaa at position 33 is Ile, Ala, Val, Leu, or Gly
  SITE (34)..(34): Xaa at position 34 is Ala, Gly, or Pro
  SITE (40)..(40): Xaa at position 40 is Val, Ala, Gly, Leu, or Ile
  SITE (41)..(41): Xaa at position 41 is Ala, Gly, or Pro
  SITE (42)..(42): Xaa at position 42 is Leu, Ala, Val, Gly, or Ile
  SITE (43)..(43): Xaa at position 43 is His, Phe, Tyr, Lys, Arg, Gly, Ser Thr, Ala, Val, Leu, Ile, Asn, Met, or Gln
  SITE (44)..(44): Xaa at position 44 is Ala, Gly, or Pro
  SITE (45)..(45): Xaa at position 45 is Leu, Ala, Val, Gly, or Ile
  SITE (48)..(48): Xaa at position 48 is Ala, Gly, or Pro
  SITE (49)..(49): Xaa at position 49 is Ile, Ala, Val, Leu, or Gly
  SITE (50)..(50): Xaa at position 50 is Leu, Ala, Val, Gly, or Ile
  SITE (52)..(52): Xaa at position 52 is Ala, Gly, or Pro
  SITE (53)..(53): Xaa at position 53 is Ala, Gly, or Pro
  SITE (58)..(58): Xaa at position 58 is Ile, Ala, Val, Leu, or Gly
  SITE (77)..(77): Xaa at position 77 is Leu, Ala, Val, Gly, or Ile
  SITE (78)..(78): Xaa at position 78 is Leu, Ala, Val, Gly, or Ile
  SITE (81)..(81): Xaa at position 81 is Ala, Gly, or Pro
  SITE (85)..(85): Xaa at position 85 is Val, Ala, Gly, Leu, or Ile
  SITE (92)..(92): Xaa at position 92 is Ile, Ala, Val, Leu, or Gly
  SITE (95)..(95): Xaa at position 95 is Val, Ala, Gly, Leu, or Ile
  SITE (97)..(97): Xaa at position 97 is Ile, Ala, Val, Leu, or Gly
  SITE (99)..(99): Xaa at position 99 is Ile, Ala, Val, Leu, or Gly
  SITE (106)..(106): Xaa at position 106 is Met, Ile, Leu, Val, Ala, or Gly
  SITE (110)..(110): Xaa at position 110 is Ile, Ala, Val, Leu, or Gly
  SITE (113)..(113): Xaa at position 113 is Met, Ile, Leu, Val, Ala, or Gly
  SITE (115)..(115): Xaa at position 115 is Ala, Gly, or Pro
  SITE (117)..(117): Xaa at position 117 is Ile, Ala, Val, Leu, or Gly
  SITE (118)..(118): Xaa at position 118 is Ala, Gly, or Pro
  SITE (121)..(121): Xaa at position 121 is Leu, Ala, Val, Gly, or Ile
  SITE (125)..(125): Xaa at position 125 is Ile, Ala, Val, Leu, or Gly
  SITE (128)..(128): Xaa at position 128 is Val, Ala, Gly, Leu, or Ile
  SITE (132)..(132): Xaa at position 132 is Ala, Gly, or Pro
  SITE (147)..(147): Xaa at position 147 is Ile, Ala, Val, Leu, or Gly
  SITE (148)..(148): Xaa at position 148 is Ala, Gly, or Pro
  SITE (149)..(149): Xaa at position 149 is Cys, Ala, Val, Gly, Ser, or Thr
  SITE (151)..(151): Xaa at position 151 is Ala, Gly, or Pro
  SITE (153)..(153): Xaa at position 153 is Ala, Gly, or Pro
  SITE (154)..(154): Xaa at position 154 is Leu, Ala, Val, Gly, or Ile
  SITE (155)..(155): Xaa at position 155 is Leu, Ala, Val, Gly, or Ile
  SITE (156)..(156): Xaa at position 156 is Ile, Ala, Val, Leu, or Gly
MIRIGHGFDVXAFGEDRPXXXGGVEXPYHTGXXXHSDGDXXXXXXTDXXXGXXALGDXGKLFPDTDMQYKNADSRGXXREXFRQXQEKGYKXGNXDXTXIAQAPKXRPHXDAXRXKXXEDXQCDXEQXNVKXTTTEKLGFTGRQEGXXXEXVXXXXRQ

SEQ ID NO: 519 - protein, 313 aa, Homo sapiens
  SITE (11)..(11): Xaa at position 11 is Ile, Ala, Val, Leu, or Gly
  SITE (14)..(14): Xaa at position 14 is Val, Ala, Gly, Leu, or Ile
  SITE (15)..(15): Xaa at position 15 is Ala, Gly, or Pro
  SITE (16)..(16): Xaa at position 16 is Ile, Ala, Val, Leu, or Gly
  SITE (17)..(17): Xaa at position 17 is Phe, Tyr, Met, His, Ile, Leu, Val Ala, or Gly
  SITE (31)..(31): Xaa at position 31 is Val, Ala, Gly, Leu, or Ile
  SITE (41)..(41): Xaa at position 41 is Ile, Ala, Val, Leu, or Gly
  SITE (57)..(57): Xaa at position 57 is Ala, Gly, or Pro
  SITE (69)..(69): Xaa at position 69 is Leu, Ala, Val, Gly, or Ile
  SITE (73)..(73): Xaa at position 73 is Phe, Tyr, Met, His, Ile, Leu, Val Ala, or Gly
  SITE (93)..(93): Xaa at position 93 is Ala, Gly, or Pro
  SITE (96)..(96): Xaa at position 96 is Ile, Ala, Val, Leu, or Gly
  SITE (100)..(100): Xaa at position 100 is Phe, Tyr, Met, His, Ile, Leu, Val Ala, or Gly
  SITE (111)..(111): Xaa at position 111 is Ile, Ala, Val, Leu, or Gly
  SITE (112)..(112): Xaa at position 112 is Ile, Ala, Val, Leu, or Gly
  SITE (113)..(113): Xaa at position 113 is Phe, Tyr, Met, His, Ile, Leu, Val Ala, or Gly
  SITE (122)..(122): Xaa at position 122 is Met, Ile, Leu, Val, Ala, or Gly
  SITE (124)..(124): Xaa at position 124 is Cys, Ala, Val, Gly, Ser, or Thr
  SITE (126)..(126): Xaa at position 126 is Leu, Ala, Val, Gly, or Ile
  SITE (128)..(128): Xaa at position 128 is Leu, Ala, Val, Gly, or Ile
  SITE (136)..(136): Xaa at position 136 is Leu, Ala, Val, Gly, or Ile
  SITE (137)..(137): Xaa at position 137 is Ile, Ala, Val, Leu, or Gly
  SITE (139)..(139): Xaa at position 139 is Met, Ile, Leu, Val, Ala, or Gly
  SITE (140)..(140): Xaa at position 140 is Phe, Tyr, Met, His, Ile, Leu, Val Ala, or Gly
  SITE (143)..(143): Xaa at position 143 is Ile, Ala, Val, Leu, or Gly
  SITE (154)..(154): Xaa at position 154 is Val, Ala, Gly, Leu, or Ile
  SITE (156)..(156): Xaa at position 156 is Leu, Ala, Val, Gly, or Ile
  SITE (170)..(170): Xaa at position 170 is Ile, Ala, Val, Leu, or Gly
  SITE (175)..(175): Xaa at position 175 is Val, Ala, Gly, Leu, or Ile
  SITE (177)..(177): Xaa at position 177 is Ile, Ala, Val, Leu, or Gly
  SITE (179)..(179): Xaa at position 179 is Val, Ala, Gly, Leu, or Ile
  SITE (195)..(195): Xaa at position 195 is Met, Ile, Leu, Val, Ala, or Gly
  SITE (198)..(198): Xaa at position 198 is Met, Ile, Leu, Val, Ala, or Gly
  SITE (202)..(202): Xaa at position 202 is Ala, Gly, or Pro
  SITE (203)..(203): Xaa at position 203 is Leu, Ala, Val, Gly, or Ile
  SITE (205)..(205): Xaa at position 205 is Phe, Tyr, Met, His, Ile, Leu, Val Ala, or Gly
  SITE (206)..(206): Xaa at position 206 is Ile, Ala, Val, Leu, or Gly
  SITE (209)..(209): Xaa at position 209 is Phe, Tyr, Met, His, Ile, Leu, Val Ala, or Gly
  SITE (220)..(220): Xaa at position 220 is Ile, Ala, Val, Leu, or Gly
  SITE (222)..(222): Xaa at position 222 is Val, Ala, Gly, Leu, or Ile
  SITE (225)..(225): Xaa at position 225 is Ile, Ala, Val, Leu, or Gly
  SITE (241)..(241): Xaa at position 241 is Ala, Gly, or Pro
  SITE (247)..(247): Xaa at position 247 is Leu, Ala, Val, Gly, or Ile
  SITE (281)..(281): Xaa at position 281 is Val, Ala, Gly, Leu, or Ile
  SITE (283)..(283): Xaa at position 283 is Val, Ala, Gly, Leu, or Ile
  SITE (294)..(294): Xaa at position 294 is Ala, Gly, or Pro
  SITE (295)..(295): Xaa at position 295 is Phe, Tyr, Met, His, Ile, Leu, Val Ala, or Gly
  SITE (296)..(296): Xaa at position 296 is Ala, Gly, or Pro
  SITE (308)..(308): Xaa at position 308 is Ile, Ala, Val, Leu, or Gly
MTSCHIAEEHXQKXXXXGGTHGNELTGVFLXKHWLENGAEXQRTGLEVKPFITNPRXVKKCTRYIDCDXNRIXDLENLGKKMSEDLPYEVRRXQEXNHLXGPKDSEDSYDXXXDLHNTTSNXGXTXIXEDSRNNFXXQXXHYXKTSLAPLPCYXYXIEHPSLKYATTRSXAKYPXGXEXGPQPQGVLRADILDQXRKXIKHXXDXXHHXNEGKEFPPCAXEXYKXIEKVDYPRDENGEIAXIIHPNXQDQDWKPLHPGDPMFLTLDGKTIPLGGDCTVYPXFXNEAAYYEKKEXXXKTTKLTLNAKSXRCCLH

SEQ ID NO: 520 - protein, 432 aa, Homo sapiens
  SITE (72)..(72): Xaa at position 72 is Ala, Gly, or Pro
  SITE (76)..(76): Xaa at position 76 is Ile, Ala, Val, Leu, or Gly
  SITE (83)..(83): Xaa at position 83 is Met, Ile, Leu, Val, Ala, or Gly
  SITE (93)..(93): Xaa at position 93 is Val, Ala, Gly, Leu, or Ile
  SITE (97)..(97): Xaa at position 97 is Leu, Ala, Val, Gly, or Ile
  SITE (103)..(103): Xaa at position 103 is Met, Ile, Leu, Val, Ala, or Gly
  SITE (105)..(105): Xaa at position 105 is Ile, Ala, Val, Leu, or Gly
  SITE (107)..(107): Xaa at position 107 is Val, Ala, Gly, Leu, or Ile
  SITE (122)..(122): Xaa at position 122 is Val, Ala, Gly, Leu, or Ile
  SITE (123)..(123): Xaa at position 123 is Leu, Ala, Val, Gly, or Ile
  SITE (124)..(124): Xaa at position 124 is Val, Ala, Gly, Leu, or Ile
  SITE (125)..(125): Xaa at position 125 is Ile, Ala, Val, Leu, or Gly
  SITE (128)..(128): Xaa at position 128 is Leu, Ala, Val, Gly, or Ile
  SITE (129)..(129): Xaa at position 129 is Ala, Gly, or Pro
  SITE (133)..(133): Xaa at position 133 is Ala, Gly, or Pro
  SITE (135)..(135): Xaa at position 135 is Val, Ala, Gly, Leu, or Ile
  SITE (136)..(136): Xaa at position 136 is Ala, Gly, or Pro
  SITE (139)..(139): Xaa at position 139 is Cys, Ala, Val, Gly, Ser, or Thr
  SITE (146)..(146): Xaa at position 146 is Ile, Ala, Val, Leu, or Gly
  SITE (149)..(149): Xaa at position 149 is Leu, Ala, Val, Gly, or Ile
  SITE (150)..(150): Xaa at position 150 is Ile, Ala, Val, Leu, or Gly
  SITE (163)..(163): Xaa at position 163 is Leu, Ala, Val, Gly, or Ile
  SITE (166)..(166): Xaa at position 166 is Leu, Ala, Val, Gly, or Ile
  SITE (175)..(175): Xaa at position 175 is Cys, Ala, Val, Gly, Ser, or Thr
  SITE (181)..(181): Xaa at position 181 is Ala, Gly, or Pro
  SITE (192)..(192): Xaa at position 192 is Ala, Gly, or Pro
  SITE (201)..(201): Xaa at position 201 is Leu, Ala, Val, Gly, or Ile
  SITE (208)..(208): Xaa at position 208 is Ile, Ala, Val, Leu, or Gly
  SITE (211)..(211): Xaa at position 211 is Ala, Gly, or Pro
  SITE (214)..(214): Xaa at position 214 is Ala, Gly, or Pro
  SITE (216)..(216): Xaa at position 216 is Leu, Ala, Val, Gly, or Ile
  SITE (217)..(217): Xaa at position 217 is Phe, Tyr, Met, His, Ile, Leu, Val Ala, or Gly
  SITE (218)..(218): Xaa at position 218 is Leu, Ala, Val, Gly, or Ile
  SITE (219)..(219): Xaa at position 219 is Val, Ala, Gly, Leu, or Ile
  SITE (220)..(220): Xaa at position 220 is Met, Ile, Leu, Val, Ala, or Gly
  SITE (221)..(221): Xaa at position 221 is Ala, Gly, or Pro
  SITE (232)..(232): Xaa at position 232 is Ile, Ala, Val, Leu, or Gly
  SITE (235)..(235): Xaa at position 235 is Phe, Tyr, Met, His, Ile, Leu, Val Ala, or Gly
  SITE (236)..(236): Xaa at position 236 is Leu, Ala, Val, Gly, or Ile
  SITE (237)..(237): Xaa at position 237 is Val, Ala, Gly, Leu, or Ile
  SITE (244)..(244): Xaa at position 244 is Leu, Ala, Val, Gly, or Ile
  SITE (261)..(261): Xaa at position 261 is Cys, Ala, Val, Gly, Ser, or Thr
  SITE (263)..(263): Xaa at position 263 is Leu, Ala, Val, Gly, or Ile
  SITE (268)..(268): Xaa at position 268 is Val, Ala, Gly, Leu, or Ile
  SITE (270)..(270): Xaa at position 270 is Val, Ala, Gly, Leu, or Ile
  SITE (276)..(276): Xaa at position 276 is Leu, Ala, Val, Gly, or Ile
  SITE (286)..(286): Xaa at position 286 is Ala, Gly, or Pro
  SITE (295)..(295): Xaa at position 295 is Ile, Ala, Val, Leu, or Gly
  SITE (297)..(297): Xaa at position 297 is Ile, Ala, Val, Leu, or Gly
  SITE (298)..(298): Xaa at position 298 is Ala, Gly, or Pro
  SITE (299)..(299): Xaa at position 299 is Ala, Gly, or Pro
  SITE (301)..(301): Xaa at position 301 is Met, Ile, Leu, Val, Ala, or Gly
  SITE (302)..(302): Xaa at position 302 is Leu, Ala, Val, Gly, or Ile
  SITE (304)..(304): Xaa at position 304 is Leu, Ala, Val, Gly, or Ile
  SITE (305)..(305): Xaa at position 305 is Ala, Gly, or Pro
  SITE (308)..(308): Xaa at position 308 is Cys, Ala, Val, Gly, Ser, or Thr
  SITE (316)..(316): Xaa at position 316 is Ile, Ala, Val, Leu, or Gly
  SITE (332)..(332): Xaa at position 332 is Leu, Ala, Val, Gly, or Ile
  SITE (343)..(343): Xaa at position 343 is Leu, Ala, Val, Gly, or Ile
  SITE (346)..(346): Xaa at position 346 is Ala, Gly, or Pro
  SITE (353)..(353): Xaa at position 353 is Ala, Gly, or Pro
  SITE (354)..(354): Xaa at position 354 is Ala, Gly, or Pro
  SITE (367)..(367): Xaa at position 367 is Ala, Gly, or Pro
  SITE (370)..(370): Xaa at position 370 is Ala, Gly, or Pro
  SITE (374)..(374): Xaa at position 374 is Ala, Gly, or Pro
  SITE (378)..(378): Xaa at position 378 is Ala, Gly, or Pro
  SITE (385)..(385): Xaa at position 385 is Cys, Ala, Val, Gly, Ser, or Thr
  SITE (400)..(400): Xaa at position 400 is Val, Ala, Gly, Leu, or Ile
  SITE (407)..(407): Xaa at position 407 is Ala, Gly, or Pro
MEGLAVRLLRGSRLLRRNFLTCLSSWKIPPHVSKSSQSEALLNITNNGIHFAPLQTFTDEEMMIKSSVKKFXQEQXAPLVSTXDENSKMEKSXIQGXFQQGLXGXEXDPEYGGTGASFLSTXXXXEEXXKVDXSXXVFXEIQNTLXNTXXRKHGTEEQKATYXPQXTTEKVGSFXLSEAGXGSDSFALKTRXDKEGDYYVXNGSKMWXSSXEHXGXXXXXXNVDPTIGYKGXTSXXXDRDTPGXHIGKPENKLGLRASSTXPXTFENXKXPEANIXGQIGHGYKYXIGSLNEGRXGXXXQXXGXXQGXFDYTIPYXKERIQFGKRLFDFQGXQHQVAHVATQXEAXRLLTYNXXRLLEAGKPFIKEXSMXKYYXSEIXGQTTSKXIEWMGGVGYTKDYPXEKYFRDXKIGTIYEGASNIQLNTIAKHIDAEY

SEQ ID NO: 521 - protein, 333 aa, Homo sapiens
  SITE (26)..(26): Xaa at position 26 is Ala, Gly, or Pro
  SITE (27)..(27): Xaa at position 27 is Trp, Tyr, Phe, Met, His, Ile, Leu Val, Ala, or Gly
  SITE (28)..(28): Xaa at position 28 is Val, Ala, Gly, Leu, or Ile
  SITE (29)..(29): Xaa at position 29 is Phe, Tyr, Met, His, Ile, Leu, Val Ala, or Gly
  SITE (30)..(30): Xaa at position 30 is Ala, Gly, or Pro
  SITE (32)..(32): Xaa at position 32 is Leu, Ala, Val, Gly, or Ile
  SITE (33)..(33): Xaa at position 33 is Ala, Gly, or Pro
  SITE (36)..(36): Xaa at position 36 is Val, Ala, Gly, Leu, or Ile
  SITE (37)..(37): Xaa at position 37 is Leu, Ala, Val, Gly, or Ile
  SITE (39)..(39): Xaa at position 39 is Cys, Ala, Val, Gly, Ser, or Thr
  SITE (40)..(40): Xaa at position 40 is Leu, Ala, Val, Gly, or Ile
  SITE (42)..(42): Xaa at position 42 is Phe, Tyr, Met, His, Ile, Leu, Val Ala, or Gly
  SITE (46)..(46): Xaa at position 46 is Leu, Ala, Val, Gly, or Ile
  SITE (47)..(47): Xaa at position 47 is Val, Ala, Gly, Leu, or Ile
MESSGNPESTTFFYYDLQSQPCENQXXXXXTXXTTXXYXXVXLLSXXGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 522 - protein, 1132 aa, Homo sapiens
  SITE (19)..(19): Xaa at position 19 is Val, Ala, Gly, Leu, or Ile
  SITE (21)..(21): Xaa at position 21 is Val, Ala, Gly, Leu, or Ile
  SITE (35)..(35): Xaa at position 35 is Ala, Gly, or Pro
  SITE (39)..(39): Xaa at position 39 is Val, Ala, Gly, Leu, or Ile
  SITE (42)..(42): Xaa at position 42 is Phe, Tyr, Met, His, Ile, Leu, Val Ala, or Gly
  SITE (46)..(46): Xaa at position 46 is Ile, Ala, Val, Leu, or Gly
  SITE (50)..(50): Xaa at position 50 is Val, Ala, Gly, Leu, or Ile
  SITE (59)..(59): Xaa at position 59 is Leu, Ala, Val, Gly, or Ile
  SITE (72)..(72): Xaa at position 72 is Leu, Ala, Val, Gly, or Ile
  SITE (77)..(77): Xaa at position 77 is Val, Ala, Gly, Leu, or Ile
  SITE (82)..(82): Xaa at position 82 is Ile, Ala, Val, Leu, or Gly
  SITE (84)..(84): Xaa at position 84 is Leu, Ala, Val, Gly, or Ile
MEPNDSTSTAVEEPDSLEXLXKTLDSQTRTFIVGXQMNXKEXKEHXAASXSIPSEKQRXIYQGRVLQDDKKXQEYNXGGKVXHXVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 523 - protein, 744 aa, Homo sapiens
  SITE (23)..(23): Xaa at position 23 is Val, Ala, Gly, Leu, or Ile
  SITE (74)..(74): Xaa at position 74 is Ile, Ala, Val, Leu, or Gly
  SITE (121)..(121): Xaa at position 121 is Phe, Tyr, Met, His, Ile, Leu, Val Ala, or Gly
  SITE (514)..(514): Xaa at position 514 is Val, Ala, Gly, Leu, or Ile
  SITE (551)..(551): Xaa at position 551 is Ala, Gly, or Pro
  SITE (554)..(554): Xaa at position 554 is Ala, Gly, or Pro
  SITE (623)..(623): Xaa at position 623 is Leu, Ala, Val, Gly, or Ile
  SITE (627)..(627): Xaa at position 627 is Leu, Ala, Val, Gly, or Ile
  SITE (677)..(677): Xaa at position 677 is Leu, Ala, Val, Gly, or Ile
MAGRSMQAARCPTDELSLTNCAXVNEKDFQSGQHVIVRTSPNHRYTFTLKTHPSVVPGSIAFSLPQRKWAGLSXGQEIEVSLYTFDKAKQCIGTMTIEIDFLQKKSIDSNPYDTDKMAAEXIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPXTRVLDDGELLVQQTKNSDRTPLVSVLLEGPPHSGKTXLAXKIAEESNFPFIKICSPDKMIGFSETAKCQAMKKIFDDAYKSQLSCVVVDDIERLLDYVPIGPRFSNLVXQALXVLLKKAPPQGRKLLIIGTTSRKDVLQEMEMLNAFSTTIHVPNIATGEQLXEALELLGNFKDKERTTIAQQVKGKKVWIGIKKLLMLIEMSLQMDPEYRVRKFLALLREEGASPLDFD

SEQ ID NO: 524 - protein, 2555 aa, Homo sapiens
  SITE (423)..(423): Xaa at position 423 is Cys, Ala, Val, Gly, Ser, or Thr
  SITE (438)..(438): Xaa at position 438 is Cys, Ala, Val, Gly, Ser, or Thr
  SITE (449)..(449): Xaa at position 449 is Cys, Ala, Val, Gly, Ser, or Thr
  SITE (456)..(456): Xaa at position 456 is Cys, Ala, Val, Gly, Ser, or Thr
  SITE (461)..(461): Xaa at position 461 is Cys, Ala, Val, Gly, Ser, or Thr
  SITE (487)..(487): Xaa at position 487 is Cys, Ala, Val, Gly, Ser, or Thr
  SITE (525)..(525): Xaa at position 525 is Cys, Ala, Val, Gly, Ser, or Thr
  SITE (942)..(942): Xaa at position 942 is Cys, Ala, Val, Gly, Ser, or Thr
  SITE (1056)..(1056): Xaa at position 1056 is Cys, Ala, Val, Gly, Ser, or Thr
  SITE (1180)..(1180): Xaa at position 1180 is Cys, Ala, Val, Gly, Ser, or Thr
  SITE (1454)..(1454): Xaa at position 1454 is Cys, Ala, Val, Gly, Ser, or Thr
  SITE (1467)..(1467): Xaa at position 1467 is Cys, Ala, Val, Gly, Ser, or Thr
  SITE (1496)..(1496): Xaa at position 1496 is Cys, Ala, Val, Gly, Ser, or Thr
  SITE (1509)..(1509): Xaa at position 1509 is Cys, Ala, Val, Gly, Ser, or Thr
  SITE (1515)..(1515): Xaa at position 1515 is Leu, Ala, Val, Gly, or Ile
  SITE (1536)..(1536): Xaa at position 1536 is Cys, Ala, Val, Gly, Ser, or Thr
  SITE (1574)..(1574): Xaa at position 1574 is Leu, Ala, Val, Gly, or Ile
  SITE (1575)..(1575): Xaa at position 1575 is Val, Ala, Gly, Leu, or Ile
  SITE (1576)..(1576): Xaa at position 1576 is Val, Ala, Gly, Leu, or Ile
  SITE (1577)..(1577): Xaa at position 1577 is Val, Ala, Gly, Leu, or Ile
  SITE (1578)..(1578): Xaa at position 1578 is Val, Ala, Gly, Leu, or Ile
  SITE (1585)..(1585): Xaa at position 1585 is Leu, Ala, Val, Gly, or Ile
  SITE (1592)..(1592): Xaa at position 1592 is Phe, Tyr, Met, His, Ile, Leu Val, Ala, or Gly
  SITE (1596)..(1596): Xaa at position 1596 is Leu, Ala, Val, Gly, or Ile
  SITE (1600)..(1600): Xaa at position 1600 is Leu, Ala, Val, Gly, or Ile
  SITE (1616)..(1616): Xaa at position 1616 is Ile, Ala, Val, Leu, or Gly
  SITE (1676)..(1676): Xaa at position 1676 is Val, Ala, Gly, Leu, or Ile
  SITE (1678)..(1678): Xaa at position 1678 is Leu, Ala, Val, Gly, or Ile
  SITE (1680)..(1680): Xaa at position 1680 is Ile, Ala, Val, Leu, or Gly
  SITE (1685)..(1685): Xaa at position 1685 is Cys, Ala, Val, Gly, Ser, or Thr
  SITE (1696)..(1696): Xaa at position 1696 is Ala, Gly, or Pro
  SITE (1699)..(1699): Xaa at position 1699 is Val, Ala, Gly, Leu, or Ile
  SITE (1700)..(1700): Xaa at position 1700 is Ala, Gly, or Pro
  SITE (1703)..(1703): Xaa at position 1703 is Leu, Ala, Val, Gly, or Ile
  SITE (1705)..(1705): Xaa at position 1705 is Ala, Gly, or Pro
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPXEHAGKCINTLGSFEXQCLQGYTGPRXEIDVNEXVSNPXQNDATCLDQIGEFQCICMPGYEGVHXEVNTDECASSPCLHNGRCLDKINEFQCECPTGFTGHLXQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFXEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNXQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNXSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPEXQEDAGNKVCSLQXNNHACGWDGGDCSLNFNDPWKNCTQSLQXWKYFSDGHCDSQXNSAGCXFDGFDCQRAEGQCNPLYDQYXKDHFSDGHCDQGCNSAECEWDGLDCAEHVPERLAAGTXXXXXLMPPEQXRNSSFHXLREXSRVXHTNVVFKRDAHGQQMXFPYYGREEELRKHPIKRAAEGWAAPDALLGQVKASLLPGGSEGGRRRRELDPMDVRGSIXYXEXDNRQXVQASSQCFQSXTDXXAFXGXLASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 525 - protein, 165 aa, Homo sapiens
  SITE (15)..(15): Xaa at position 15 is Leu, Ala, Val, Gly, or Ile
  SITE (16)..(16): Xaa at position 16 is Phe, Tyr, Met, His, Ile, Leu, Val Ala, or Gly
  SITE (21)..(21): Xaa at position 21 is Met, Ile, Leu, Val, Ala, or Gly
  SITE (23)..(23): Xaa at position 23 is Ala, Gly, or Pro
  SITE (45)..(45): Xaa at position 45 is Val, Ala, Gly, Leu, or Ile
  SITE (48)..(48): Xaa at position 48 is Ala, Gly, or Pro
  SITE (49)..(49): Xaa at position 49 is Met, Ile, Leu, Val, Ala, or Gly
  SITE (79)..(79): Xaa at position 79 is Leu, Ala, Val, Gly, or Ile
MLMPKKNRIAIYELXXKEGVXVXKKDVHMPKHPELADKNVPNLHXMKXXQSLKSRGYVKEQFAWRHFYWYLTNEGIQYXRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 526 - protein, 1319 aa, Homo sapiens
  SITE (451)..(451): Xaa at position 451 is Gly, Ala, or Pro
  SITE (463)..(463): Xaa at position 463 is Tyr, Phe, Met, His, Ile, Leu, Val Ala, or Gly
  SITE (499)..(499): Xaa at position 499 is Leu, Ala, Val, Gly, or Ile
  SITE (529)..(529): Xaa at position 529 is Leu, Ala, Val, Gly, or Ile
  SITE (563)..(563): Xaa at position 563 is Leu, Ala, Val, Gly, or Ile
  SITE (785)..(785): Xaa at position 785 is Tyr, Phe, Met, His, Ile, Leu, Val Ala, or Gly
  SITE (858)..(858): Xaa at position 858 is Phe, Tyr, Met, His, Ile, Leu, Val Ala, or Gly
  SITE (948)..(948): Xaa at position 948 is Phe, Tyr, Met, His, Ile, Leu, Val Ala, or Gly
  SITE (964)..(964): Xaa at position 964 is Met, Ile, Leu, Val, Ala, or Gly
  SITE (979)..(979): Xaa at position 979 is Ile, Ala, Val, Leu, or Gly
  SITE (988)..(988): Xaa at position 988 is Leu, Ala, Val, Gly, or Ile
  SITE (990)..(990): Xaa at position 990 is Ala, Gly, or Pro
  SITE (992)..(992): Xaa at position 992 is Leu, Ala, Val, Gly, or Ile
  SITE (996)..(996): Xaa at position 996 is Phe, Tyr, Met, His, Ile, Leu, Val Ala, or Gly
  SITE (1008)..(1008): Xaa at position 1008 is Ala, Gly, or Pro
  SITE (1011)..(1011): Xaa at position 1011 is Trp, Tyr, Phe, Met, His, Ile Leu, Val, Ala, or Gly
  SITE (1012)..(1012): Xaa at position 1012 is Phe, Tyr, Met, His, Ile, Leu Val, Ala, or Gly
  SITE (1015)..(1015): Xaa at position 1015 is Ile, Ala, Val, Leu, or Gly
  SITE (1019)..(1019): Xaa at position 1019 is Met, Ile, Leu, Val, Ala, or Gly
  SITE (1027)..(1027): Xaa at position 1027 is Phe, Tyr, Met, His, Ile, Leu Val, Ala, or Gly
  SITE (1054)..(1054): Xaa at position 1054 is Phe, Tyr, Met, His, Ile, Leu Val, Ala, or Gly
  SITE (1056)..(1056): Xaa at position 1056 is Phe, Tyr, Met, His, Ile, Leu Val, Ala, or Gly
  SITE (1057)..(1057): Xaa at position 1057 is Ile, Ala, Val, Leu, or Gly
  SITE (1060)..(1060): Xaa at position 1060 is Val, Ala, Gly, Leu, or Ile
  SITE (1061)..(1061): Xaa at position 1061 is Ala, Gly, or Pro
  SITE (1063)..(1063): Xaa at position 1063 is Met, Ile, Leu, Val, Ala, or Gly
  SITE (1064)..(1064): Xaa at position 1064 is Ala, Gly, or Pro
  SITE (1065)..(1065): Xaa at position 1065 is Val, Ala, Gly, Leu, or Ile
  SITE (1071)..(1071): Xaa at position 1071 is Leu, Ala, Val, Gly, or Ile
  SITE (1075)..(1075): Xaa at position 1075 is Phe, Tyr, Met, His, Ile, Leu Val, Ala, or Gly
  SITE (1080)..(1080): Xaa at position 1080 is Tyr, Phe, Met, His, Ile, Leu Val, Ala, or Gly
  SITE (1083)..(1083): Xaa at position 1083 is Met, Ile, Leu, Val, Ala, or Gly
  SITE (1084)..(1084): Xaa at position 1084 is Leu, Ala, Val, Gly, or Ile
  SITE (1093)..(1093): Xaa at position 1093 is Met, Ile, Leu, Val, Ala, or Gly
  SITE (1104)..(1104): Xaa at position 1104 is Leu, Ala, Val, Gly, or Ile
  SITE (1119)..(1119): Xaa at position 1119 is Phe, Tyr, Met, His, Ile, Leu Val, Ala, or Gly
  SITE (1121)..(1121): Xaa at position 1121 is Ile, Ala, Val, Leu, or Gly
  SITE (1143)..(1143): Xaa at position 1143 is Val, Ala, Gly, Leu, or Ile
  SITE (1151)..(1151): Xaa at position 1151 is Tyr, Phe, Met, His, Ile, Leu Val, Ala, or Gly
  SITE (1155)..(1155): Xaa at position 1155 is Val, Ala, Gly, Leu, or Ile
  SITE (1168)..(1168): Xaa at position 1168 is Met, Ile, Leu, Val, Ala, or Gly
  SITE (1171)..(1171): Xaa at position 1171 is Phe, Tyr, Met, His, Ile, Leu Val, Ala, or Gly
  SITE (1175)..(1175): Xaa at position 1175 is Phe, Tyr, Met, His, Ile, Leu Val, Ala, or Gly
  SITE (1178)..(1178): Xaa at position 1178 is Leu, Ala, Val, Gly, or Ile
  SITE (1179)..(1179): Xaa at position 1179 is Ile, Ala, Val, Leu, or Gly
  SITE (1184)..(1184): Xaa at position 1184 is Ile, Ala, Val, Leu, or Gly
  SITE (1187)..(1187): Xaa at position 1187 is Phe, Tyr, Met, His, Ile, Leu Val, Ala, or Gly
  SITE (1192)..(1192): Xaa at position 1192 is Leu, Ala, Val, Gly, or Ile
  SITE (1196)..(1196): Xaa at position 1196 is Met, Ile, Leu, Val, Ala, or Gly
  SITE (1197)..(1197): Xaa at position 1197 is Cys, Ala, Val, Gly, Ser, or Thr
  SITE (1207)..(1207): Xaa at position 1207 is Trp, Tyr, Phe, Met, His, Ile Leu, Val, Ala, or Gly
  SITE (1223)..(1223): Xaa at position 1223 is Val, Ala, Gly, Leu, or Ile
  SITE (1224)..(1224): Xaa at position 1224 is Ile, Ala, Val, Leu, or Gly
  SITE (1227)..(1227): Xaa at position 1227 is Phe, Tyr, Met, His, Ile, Leu Val, Ala, or Gly
  SITE (1228)..(1228): Xaa at position 1228 is Trp, Tyr, Phe, Met, His, Ile Leu, Val, Ala, or Gly
  SITE (1230)..(1230): Xaa at position 1230 is Ala, Gly, or Pro
  SITE (1231)..(1231): Xaa at position 1231 is Val, Ala, Gly, Leu, or Ile
  SITE (1242)..(1242): Xaa at position 1242 is Leu, Ala, Val, Gly, or Ile
  SITE (1243)..(1243): Xaa at position 1243 is Leu, Ala, Val, Gly, or Ile
  SITE (1246)..(1246): Xaa at position 1246 is Val, Ala, Gly, Leu, or Ile
  SITE (1257)..(1257): Xaa at position 1257 is Phe, Tyr, Met, His, Ile, Leu Val, Ala, or Gly
  SITE (1260)..(1260): Xaa at position 1260 is Leu, Ala, Val, Gly, or Ile
  SITE (1269)..(1269): Xaa at position 1269 is Phe, Tyr, Met, His, Ile, Leu Val, Ala, or Gly
  SITE (1271)..(1271): Xaa at position 1271 is Val, Ala, Gly, Leu, or Ile
  SITE (1290)..(1290): Xaa at position 1290 is Leu, Ala, Val, Gly, or Ile
  SITE (1292)..(1292): Xaa at position 1292 is Leu, Ala, Val, Gly, or Ile
  SITE (1301)..(1301): Xaa at position 1301 is Leu, Ala, Val, Gly, or Ile
  SITE (1305)..(1305): Xaa at position 1305 is Leu, Ala, Val, Gly, or Ile
  SITE (1309)..(1309): Xaa at position 1309 is Ile, Ala, Val, Leu, or Gly
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHXILRRSISLGGAXPNISCLSSLKHNCSKGGPSQLLIKFASGNEGKVDNXSRDSNRDCTNELSNSCKTRDDFLGQVDVPXYPLPTENPRLERPYTFKDFVLHPRSHKSRVKGYXRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYXVDHNSRTTTWTKPTVQATVETSQLTSSQSSAGPQSQASTSDSGQQVTQPSEIEQGFLPKGWEVRHAPNGRPFXIDHNTKTTTWEDPRLKIPAHLRGKTSLDTSNDLGPLPPGWEERTHTDGRIFYINHNIKRTQWEDPRLENVAITGPAVPYSRDYKRKYEFXRRKLKKQNDIPNKFEXKLRRATVLEDSYRRXMGVKRADFXKXRXWIEXDGEKGLDYGGVXREXXFLXSKEXFNPYYGLXEYSATDNYTLQINPNSGLCNEDHLSYXKXXGRXXGXXXYHGKLXDGFXIRPFXKMXXHKPITLHDXESVDSEYYNSXRWILENDPTELDLRXIXDEELFGQTHQHELKNGGSEIVXTNKNKKEXIYLXIQWRFVNRIQKQXAAXKEGXFEXXPQDLXKIXDENEXELLXXGLGDVDVNDXREHTKYKNGYSANHQXXQWXXKXXLMMDSEKRIRXXQFXTGTSRVPMNGXAEXYGSNGPQSXTXEQWGTPEKLPRAHTCFNRXDXPPYESFEEXWDKXQMAXENTQGFDGVD

SEQ ID NO: 527 - protein, 286 aa, Homo sapiens
  SITE (32)..(32): Xaa at position 32 is Leu, Ala, Val, Gly, or Ile
  SITE (48)..(48): Xaa at position 48 is Ile, Ala, Val, Leu, or Gly
  SITE (64)..(64): Xaa at position 64 is Leu, Ala, Val, Gly, or Ile
  SITE (66)..(66): Xaa at position 66 is Val, Ala, Gly, Leu, or Ile
  SITE (85)..(85): Xaa at position 85 is Leu, Ala, Val, Gly, or Ile
  SITE (89)..(89): Xaa at position 89 is Val, Ala, Gly, Leu, or Ile
  SITE (100)..(100): Xaa at position 100 is Val, Ala, Gly, Leu, or Ile
  SITE (104)..(104): Xaa at position 104 is Val, Ala, Gly, Leu, or Ile
  SITE (116)..(116): Xaa at position 116 is Leu, Ala, Val, Gly, or Ile
  SITE (119)..(119): Xaa at position 119 is Tyr, Phe, Met, His, Ile, Leu, Val Ala, or Gly
  SITE (194)..(194): Xaa at position 194 is Leu, Ala, Val, Gly, or Ile
  SITE (211)..(211): Xaa at position 211 is Val, Ala, Gly, Leu, or Ile
  SITE (213)..(213): Xaa at position 213 is Ala, Gly, or Pro
  SITE (230)..(230): Xaa at position 230 is Leu, Ala, Val, Gly, or Ile
  SITE (248)..(248): Xaa at position 248 is Leu, Ala, Val, Gly, or Ile
  SITE (255)..(255): Xaa at position 255 is Leu, Ala, Val, Gly, or Ile
  SITE (272)..(272): Xaa at position 272 is Ala, Gly, or Pro
MERRLGVRAWVKENRGSFQPPVCNKLMHQEQXKVMFIGGPNTRKDYHXEEGEEVFYQLEGDMVXRXLEQGKHRDVVIRQGEIFLXPARXPHSPQRFANTXGLVXERRRLETELDGXRYXVGDTMDVLFEKWFYCKDLGTQLAPIIQEFFSSEQYRTGKPIPDQLLKEPPFPLSTRSIMEPMSLDAWLDSHHREXQAGTPLSLFGDTYETQXIXYGQGSSEGLRQNVDVWXWQLEGSSVVTMGGRRLSXAPDDSLXVLAGTSYAWERTQGSVXLSVTQDPACKKPLG

SEQ ID NO: 528 - protein, 277 aa, Homo sapiens
  SITE (9)..(9): Xaa at position 9 is Ala, Gly, or Pro
  SITE (25)..(25): Xaa at position 25 is Leu, Ala, Val, Gly, or Ile
  SITE (39)..(39): Xaa at position 39 is Leu, Ala, Val, Gly, or Ile
  SITE (60)..(60): Xaa at position 60 is Leu, Ala, Val, Gly, or Ile
  SITE (119)..(119): Xaa at position 119 is Val, Ala, Gly, Leu, or Ile
  SITE (120)..(120): Xaa at position 120 is Tyr, Phe, Met, His, Ile, Leu, Val Ala, or Gly
  SITE (129)..(129): Xaa at position 129 is Ala, Gly, or Pro
  SITE (131)..(131): Xaa at position 131 is Val, Ala, Gly, Leu, or Ile
  SITE (133)..(133): Xaa at position 133 is Leu, Ala, Val, Gly, or Ile
  SITE (134)..(134): Xaa at position 134 is Ile, Ala, Val, Leu, or Gly
  SITE (152)..(152): Xaa at position 152 is His, Phe, Tyr, Lys, Arg, Gly, Ser Thr, Ala, Val, Leu, Ile, Asn, Met, or Gln
  SITE (154)..(154): Xaa at position 154 is Val, Ala, Gly, Leu, or Ile
  SITE (156)..(156): Xaa at position 156 is Val, Ala, Gly, Leu, or Ile
  SITE (165)..(165): Xaa at position 165 is Ala, Gly, or Pro
  SITE (167)..(167): Xaa at position 167 is Tyr, Phe, Met, His, Ile, Leu, Val Ala, or Gly
  SITE (169)..(169): Xaa at position 169 is Leu, Ala, Val, Gly, or Ile
  SITE (173)..(173): Xaa at position 173 is Val, Ala, Gly, Leu, or Ile
  SITE (174)..(174): Xaa at position 174 is Met, Ile, Leu, Val, Ala, or Gly
  SITE (217)..(217): Xaa at position 217 is Val, Ala, Gly, Leu, or Ile
  SITE (220)..(220): Xaa at position 220 is Met, Ile, Leu, Val, Ala, or Gly
  SITE (224)..(224): Xaa at position 224 is Ile, Ala, Val, Leu, or Gly
MSDQQLDCXLDLMRRLPPQQIEKNXSDLIDLVPSLCEDXLSSVDQPLKIARDKVVGKDYXLCDYNRDGDSYRSPWSNKYDPPLEDGAMPSARLRKLEVEANNAFDQYRDLYFEGGVSSXXLWDLDHGFXGXIXXKKAGDGSKKIKGCWDSIXVXEXQEKSSGRTXHXKXTSTXXLWLQTNKSGSGTMNLGGSLTRQMEKDETVSDCSPHIANIGRLXEDXENKXRSTLNEIYFGKTKDIVNGLRSIDAIPDNQKFKQLQRELSQVLTQRQIYIQPDN

SEQ ID NO: 529 - protein, 281 aa, Homo sapiens
  SITE (147)..(147): Xaa at position 147 is Ala, Gly, or Pro
  SITE (149)..(149): Xaa at position 149 is Leu, Ala, Val, Gly, or Ile
  SITE (160)..(160): Xaa at position 160 is Leu, Ala, Val, Gly, or Ile
  SITE (181)..(181): Xaa at position 181 is Leu, Ala, Val, Gly, or Ile
  SITE (183)..(183): Xaa at position 183 is Ile, Ala, Val, Leu, or Gly
  SITE (189)..(189): Xaa at position 189 is Tyr, Phe, Met, His, Ile, Leu, Val Ala, or Gly
  SITE (191)..(191): Xaa at position 191 is Val, Ala, Gly, Leu, or Ile
  SITE (195)..(195): Xaa at position 195 is Val, Ala, Gly, Leu, or Ile
  SITE (197)..(197): Xaa at position 197 is Phe, Tyr, Met, His, Ile, Leu, Val Ala, or Gly
  SITE (207)..(207): Xaa at position 207 is Leu, Ala, Val, Gly, or Ile
  SITE (209)..(209): Xaa at position 209 is His, Phe, Tyr, Lys, Arg, Gly, Ser Thr, Ala, Val, Leu, Ile, Asn, Met, or Gln
  SITE (211)..(211): Xaa at position 211 is Val, Ala, Gly, Leu, or Ile
  SITE (257)..(257): Xaa at position 257 is Leu, Ala, Val, Gly, or Ile
  SITE (259)..(259): Xaa at position 259 is Val, Ala, Gly, Leu, or Ile
  SITE (276)..(276): Xaa at position 276 is Phe, Tyr, Met, His, Ile, Leu, Val Ala, or Gly
  SITE (278)..(278): Xaa at position 278 is Leu, Ala, Val, Gly, or Ile
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVXHXTGKSNSRSMPXEWEDTYGIVLLSGVKYKKGGXVXNETGLXFXYSKXYXRGQSCNNLPXSXKXYMRNSKYPQDLVMMEGKMMSYCTTGQMWARSSYLGAVFNLTSADHXYXNVSELSLVNFEESQTFXGXYKL

SEQ ID NO: 530 - protein, 93 aa, Homo sapiens
  SITE (59)..(59): Xaa at position 59 is Ile, Ala, Val, Leu, or Gly
  SITE (61)..(61): Xaa at position 61 is Ala, Gly, or Pro
  SITE (72)..(72): Xaa at position 72 is Ile, Ala, Val, Leu, or Gly
  SITE (79)..(79): Xaa at position 79 is Ile, Ala, Val, Leu, or Gly
MNAKVVVVLVLVLTALCLSDGKPVSLSYRCPCRFFESHVARANVKHLKILNTPNCALQXVXRLKNNNRQVCXDPKLKWXQEYLEKALNKRFKM

SEQ ID NO: 531 - protein, 497 aa, Homo sapiens
  SITE (80)..(80): Xaa at position 80 is Val, Ala, Gly, Leu, or Ile
  SITE (82)..(82): Xaa at position 82 is Val, Ala, Gly, Leu, or Ile
  SITE (84)..(84): Xaa at position 84 is Val, Ala, Gly, Leu, or Ile
  SITE (86)..(86): Xaa at position 86 is Ile, Ala, Val, Leu, or Gly
  SITE (101)..(101): Xaa at position 101 is Tyr, Phe, Met, His, Ile, Leu, Val Ala, or Gly
  SITE (103)..(103): Xaa at position 103 is Val, Ala, Gly, Leu, or Ile
  SITE (105)..(105): Xaa at position 105 is Ile, Ala, Val, Leu, or Gly
  SITE (111)..(111): Xaa at position 111 is Trp, Tyr, Phe, Met, His, Ile, Leu Val, Ala, or Gly
  SITE (116)..(116): Xaa at position 116 is Leu, Ala, Val, Gly, or Ile
  SITE (128)..(128): Xaa at position 128 is Leu, Ala, Val, Gly, or Ile
  SITE (163)..(163): Xaa at position 163 is Leu, Ala, Val, Gly, or Ile
  SITE (165)..(165): Xaa at position 165 is Ile, Ala, Val, Leu, or Gly
  SITE (171)..(171): Xaa at position 171 is Val, Ala, Gly, Leu, or Ile
  SITE (179)..(179): Xaa at position 179 is Ile, Ala, Val, Leu, or Gly
  SITE (181)..(181): Xaa at position 181 is Leu, Ala, Val, Gly, or Ile
  SITE (183)..(183): Xaa at position 183 is Cys, Ala, Val, Gly, Ser, or Thr
  SITE (187)..(187): Xaa at position 187 is Leu, Ala, Val, Gly, or Ile
  SITE (190)..(190): Xaa at position 190 is Phe, Tyr, Met, His, Ile, Leu, Val Ala, or Gly
  SITE (197)..(197): Xaa at position 197 is Cys, Ala, Val, Gly, Ser, or Thr
  SITE (199)..(199): Xaa at position 199 is Met, Ile, Leu, Val, Ala, or Gly
  SITE (201)..(201): Xaa at position 201 is Leu, Ala, Val, Gly, or Ile
  SITE (211)..(211): Xaa at position 211 is Leu, Ala, Val, Gly, or Ile
  SITE (213)..(213): Xaa at position 213 is Phe, Tyr, Met, His, Ile, Leu, Val Ala, or Gly
  SITE (255)..(255): Xaa at position 255 is Cys, Ala, Val, Gly, Ser, or Thr
  SITE (256)..(256): Xaa at position 256 is Val, Ala, Gly, Leu, or Ile
  SITE (258)..(258): Xaa at position 258 is Val, Ala, Gly, Leu, or Ile
  SITE (260)..(260): Xaa at position 260 is Phe, Tyr, Met, His, Ile, Leu, Val Ala, or Gly
  SITE (262)..(262): Xaa at position 262 is Leu, Ala, Val, Gly, or Ile
  SITE (273)..(273): Xaa at position 273 is Val, Ala, Gly, Leu, or Ile
  SITE (280)..(280): Xaa at position 280 is Ile, Ala, Val, Leu, or Gly
  SITE (281)..(281): Xaa at position 281 is Val, Ala, Gly, Leu, or Ile
  SITE (288)..(288): Xaa at position 288 is Phe, Tyr, Met, His, Ile, Leu, Val Ala, or Gly
  SITE (309)..(309): Xaa at position 309 is Leu, Ala, Val, Gly, or Ile
  SITE (328)..(328): Xaa at position 328 is Ala, Gly, or Pro
  SITE (329)..(329): Xaa at position 329 is Leu, Ala, Val, Gly, or Ile
  SITE (333)..(333): Xaa at position 333 is Leu, Ala, Val, Gly, or Ile
  SITE (336)..(336): Xaa at position 336 is Cys, Ala, Val, Gly, Ser, or Thr
  SITE (350)..(350): Xaa at position 350 is Val, Ala, Gly, Leu, or Ile
  SITE (353)..(353): Xaa at position 353 is Met, Ile, Leu, Val, Ala, or Gly
  SITE (370)..(370): Xaa at position 370 is Ala, Gly, or Pro
  SITE (470)..(470): Xaa at position 470 is Ala, Gly, or Pro
MKFLLTTAFLILISLWVEEAYSKEKSSKKGKGKKKQYLCPSQQSAEDLARVPANSTSNILNRLLVSYDPRIRPNFKGIPXDXVXNXFINSFGSIQETTMDXRXNXFLRQKXNDPRXKLPSDFRGSDAXTVDPTMYKCLWKPDLFFANEKSANFHDVTQENILXFXFRDGDXLVSMRLSXTXSXPLDXTLXPMDTQRXKXQXESFGYTTDDXRXIWQSGDPVQLEKIALPQFDIKKEDIEYGNCTKYYKGTGYYTXXEXIXTXRRQVGFYMMGXYAPTLLXXVLSWLSXWINPDASAARVPLGIFSVLSXASECTTLAAELPKVSYVKXXDVWXIAXLLFGFASLVEYAVXQVXLNNPKRVEAEKARIAKXEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAXKRIDLYARALFPFCFLFFNVIYWSIYL

SEQ ID NO: 532 - protein, 509 aa, Homo sapiens
  SITE (114)..(114): Xaa at position 114 is Val, Ala, Gly, Leu, or Ile
  SITE (116)..(116): Xaa at position 116 is Ala, Gly, or Pro
  SITE (123)..(123): Xaa at position 123 is Leu, Ala, Val, Gly, or Ile
  SITE (135)..(135): Xaa at position 135 is Leu, Ala, Val, Gly, or Ile
  SITE (139)..(139): Xaa at position 139 is Leu, Ala, Val, Gly, or Ile
  SITE (154)..(154): Xaa at position 154 is Phe, Tyr, Met, His, Ile, Leu, Val Ala, or Gly
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMXWXQAARRKXADQYPHLHNAEXSKTXGKLWRLLNESEKRPXVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 533 - protein, 419 aa, Homo sapiens
  SITE (108)..(108): Xaa at position 108 is Trp, Tyr, Phe, Met, His, Ile, Leu Val, Ala, or Gly
  SITE (139)..(139): Xaa at position 139 is Ala, Gly, or Pro
  SITE (168)..(168): Xaa at position 168 is Leu, Ala, Val, Gly, or Ile
  SITE (206)..(206): Xaa at position 206 is Ala, Gly, or Pro
  SITE (207)..(207): Xaa at position 207 is Val, Ala, Gly, Leu, or Ile
  SITE (208)..(208): Xaa at position 208 is Ile, Ala, Val, Leu, or Gly
  SITE (217)..(217): Xaa at position 217 is Leu, Ala, Val, Gly, or Ile
  SITE (221)..(221): Xaa at position 221 is Val, Ala, Gly, Leu, or Ile
  SITE (234)..(234): Xaa at position 234 is Ile, Ala, Val, Leu, or Gly
  SITE (236)..(236): Xaa at position 236 is Ala, Gly, or Pro
  SITE (238)..(238): Xaa at position 238 is Leu, Ala, Val, Gly, or Ile
  SITE (252)..(252): Xaa at position 252 is Leu, Ala, Val, Gly, or Ile
  SITE (257)..(257): Xaa at position 257 is Ile, Ala, Val, Leu, or Gly
  SITE (274)..(274): Xaa at position 274 is Leu, Ala, Val, Gly, or Ile
  SITE (289)..(289): Xaa at position 289 is Met, Ile, Leu, Val, Ala, or Gly
  SITE (301)..(301): Xaa at position 301 is Val, Ala, Gly, Leu, or Ile
  SITE (303)..(303): Xaa at position 303 is Val, Ala, Gly, Leu, or Ile
  SITE (305)..(305): Xaa at position 305 is Leu, Ala, Val, Gly, or Ile
  SITE (318)..(318): Xaa at position 318 is Ala, Gly, or Pro
  SITE (322)..(322): Xaa at position 322 is Tyr, Phe, Met, His, Ile, Leu, Val Ala, or Gly
  SITE (351)..(351): Xaa at position 351 is Phe, Tyr, Met, His, Ile, Leu, Val Ala, or Gly
  SITE (368)..(368): Xaa at position 368 is Ala, Gly, or Pro
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIXWLIAYIRGDLDHVGDQEWIPCVENLSGFVSXFLFSIETETTIGYGFRVITEKCPEGIILXLVQAILGSIVNAFMVGCMFVKISQPKKRAETLMFSNNXXXSMRDEKLCXMFRXGDLRNSHIVEASXRXKXIKSRQTKEGEFIPXNQTDXNVGFDTGDDRLFLVSPXIISHEINQKSPFWEXSQAQLHQEEFEXVXIXEGMVEATGMTCQXRSSXMDTEVLWGHRFTPVLTLEKGFYEVDYNTXHDTYETNTPSCCAKELXEMKREGRLLQYLPSPPLLGGCAEAGLDAEAEQNEEDEPKGLGGSREARGSV

SEQ ID NO: 534 - protein, 541 aa, Homo sapiens
  SITE (33)..(33): Xaa at position 33 is Ala, Gly, or Pro
  SITE (41)..(41): Xaa at position 41 is Ala, Gly, or Pro
  SITE (48)..(48): Xaa at position 48 is Met, Ile, Leu, Val, Ala, or Gly
  SITE (75)..(75): Xaa at position 75 is Ala, Gly, or Pro
  SITE (77)..(77): Xaa at position 77 is Ile, Ala, Val, Leu, or Gly
  SITE (87)..(87): Xaa at position 87 is Ile, Ala, Val, Leu, or Gly
  SITE (91)..(91): Xaa at position 91 is Met, Ile, Leu, Val, Ala, or Gly
  SITE (109)..(109): Xaa at position 109 is Val, Ala, Gly, Leu, or Ile
  SITE (110)..(110): Xaa at position 110 is Val, Ala, Gly, Leu, or Ile
  SITE (113)..(113): Xaa at position 113 is Ala, Gly, or Pro
  SITE (116)..(116): Xaa at position 116 is Leu, Ala, Val, Gly, or Ile
  SITE (123)..(123): Xaa at position 123 is Leu, Ala, Val, Gly, or Ile
  SITE (133)..(133): Xaa at position 133 is Ile, Ala, Val, Leu, or Gly
  SITE (140)..(140): Xaa at position 140 is Ala, Gly, or Pro
  SITE (144)..(144): Xaa at position 144 is Ala, Gly, or Pro
  SITE (169)..(169): Xaa at position 169 is Ala, Gly, or Pro
  SITE (173)..(173): Xaa at position 173 is Leu, Ala, Val, Gly, or Ile
  SITE (186)..(186): Xaa at position 186 is Ala, Gly, or Pro
  SITE (189)..(189): Xaa at position 189 is Ala, Gly, or Pro
  SITE (192)..(192): Xaa at position 192 is Ala, Gly, or Pro
  SITE (204)..(204): Xaa at position 204 is Val, Ala, Gly, Leu, or Ile
  SITE (229)..(229): Xaa at position 229 is Ile, Ala, Val, Leu, or Gly
  SITE (239)..(239): Xaa at position 239 is Met, Ile, Leu, Val, Ala, or Gly
  SITE (246)..(246): Xaa at position 246 is Ala, Gly, or Pro
  SITE (248)..(248): Xaa at position 248 is Ile, Ala, Val, Leu, or Gly
  SITE (249)..(249): Xaa at position 249 is Ala, Gly, or Pro
  SITE (250)..(250): Xaa at position 250 is Ile, Ala, Val, Leu, or Gly
  SITE (251)..(251): Xaa at position 251 is Leu, Ala, Val, Gly, or Ile
  SITE (255)..(255): Xaa at position 255 is Phe, Tyr, Met, His, Ile, Leu, Val Ala, or Gly
  SITE (289)..(289): Xaa at position 289 is Ile, Ala, Val, Leu, or Gly
  SITE (292)..(292): Xaa at position 292 is Ile, Ala, Val, Leu, or Gly
  SITE (297)..(297): Xaa at position 297 is Ala, Gly, or Pro
  SITE (299)..(299): Xaa at position 299 is Leu, Ala, Val, Gly, or Ile
  SITE (300)..(300): Xaa at position 300 is Ala, Gly, or Pro
  SITE (301)..(301): Xaa at position 301 is Ile, Ala, Val, Leu, or Gly
  SITE (302)..(302): Xaa at position 302 is Cys, Ala, Val, Gly, Ser, or Thr
  SITE (310)..(310): Xaa at position 310 is Ala, Gly, or Pro
  SITE (314)..(314): Xaa at position 314 is Leu, Ala, Val, Gly, or Ile
  SITE (319)..(319): Xaa at position 319 is Leu, Ala, Val, Gly, or Ile
  SITE (321)..(321): Xaa at position 321 is Ala, Gly, or Pro
  SITE (330)..(330): Xaa at position 330 is Ile, Ala, Val, Leu, or Gly
  SITE (333)..(333): Xaa at position 333 is Ile, Ala, Val, Leu, or Gly
  SITE (356)..(356): Xaa at position 356 is Ala, Gly, or Pro
  SITE (359)..(359): Xaa at position 359 is Val, Ala, Gly, Leu, or Ile
  SITE (373)..(373): Xaa at position 373 is Val, Ala, Gly, Leu, or Ile
  SITE (374)..(374): Xaa at position 374 is Ile, Ala, Val, Leu, or Gly
  SITE (385)..(385): Xaa at position 385 is Ile, Ala, Val, Leu, or Gly
  SITE (386)..(386): Xaa at position 386 is Phe, Tyr, Met, His, Ile, Leu, Val Ala, or Gly
  SITE (387)..(387): Xaa at position 387 is Ile, Ala, Val, Leu, or Gly
  SITE (402)..(402): Xaa at position 402 is Leu, Ala, Val, Gly, or Ile
  SITE (405)..(405): Xaa at position 405 is Ala, Gly, or Pro
  SITE (408)..(408): Xaa at position 408 is Val, Ala, Gly, Leu, or Ile
  SITE (409)..(409): Xaa at position 409 is Ile, Ala, Val, Leu, or Gly
  SITE (412)..(412): Xaa at position 412 is Leu, Ala, Val, Gly, or Ile
  SITE (419)..(419): Xaa at position 419 is Val, Ala, Gly, Leu, or Ile
  SITE (424)..(424): Xaa at position 424 is Ala, Gly, or Pro
  SITE (425)..(425): Xaa at position 425 is Ala, Gly, or Pro
  SITE (427)..(427): Xaa at position 427 is Ile, Ala, Val, Leu, or Gly
  SITE (430)..(430): Xaa at position 430 is Ala, Gly, or Pro
  SITE (433)..(433): Xaa at position 433 is Val, Ala, Gly, Leu, or Ile
  SITE (437)..(437): Xaa at position 437 is Ala, Gly, or Pro
  SITE (451)..(451): Xaa at position 451 is Phe, Tyr, Met, His, Ile, Leu, Val Ala, or Gly
  SITE (452)..(452): Xaa at position 452 is Ala, Gly, or Pro
  SITE (454)..(454): Xaa at position 454 is Ala, Gly, or Pro
  SITE (461)..(461): Xaa at position 461 is Ala, Gly, or Pro
  SITE (477)..(477): Xaa at position 477 is Val, Ala, Gly, Leu, or Ile
  SITE (510)..(510): Xaa at position 510 is Leu, Ala, Val, Gly, or Ile
  SITE (520)..(520): Xaa at position 520 is Ala, Gly, or Pro
  SITE (527)..(527): Xaa at position 527 is Ile, Ala, Val, Leu, or Gly
MASMGTLAFDEYGRPFLIIKDQDRKSRLMGLEXLKSHIMAXKAVANTXRTSLGPNGLDKMMVDKDGDVTVTNDGXTXLSMMDVDHQXAKLXVELSKSQDDEIGDGTTGXXVLXGAXLEEAEQXLDRGIHPIRXADGYEQXARVXIEHLDKISDSVLVDIKDTEPLIQTXKTTXGSKVVNSCHRQMXEIXVNXVLTVADMERRDXDFELIKVEGKVGGRLEDTKLIKGVXVDKDFSHPQXPKKVEDXKXXXXTCPXEPPKPKTKHKLDVTSVEDYKALQKYEKEKFEEMXQQXKETGXNXXXXQWGFDDEXNHLXLQNNXPXVRWVGGPEXELXAIATGGRIVPRFSELTAEKLGFXGLXQEISFGTTKDKMLXXEQCKNSRAVTXXXRGGNKMIIEEAKRSXHDXLCXXRNXIRDNRVXYGGGXXEXSCXLAXSQEXDKCPTLEQYAMRAXXDXLEVIPMXLSENSGMNPIQTMTEXRARQVKEMNPALGIDCLHKGTNDMKQQHVIETXIGKKQQISLXTQMVRMXLKIDDIRKPGESEE

SEQ ID NO: 535 - protein, 510 aa, Homo sapiens
  SITE (64)..(64): Xaa at position 64 is Val, Ala, Gly, Leu, or Ile
  SITE (80)..(80): Xaa at position 80 is Ile, Ala, Val, Leu, or Gly
  SITE (82)..(82): Xaa at position 82 is Val, Ala, Gly, Leu, or Ile
  SITE (83)..(83): Xaa at position 83 is Ala, Gly, or Pro
  SITE (93)..(93): Xaa at position 93 is Val, Ala, Gly, Leu, or Ile
  SITE (94)..(94): Xaa at position 94 is Trp, Tyr, Phe, Met, His, Ile, Leu Val, Ala, or Gly
  SITE (99)..(99): Xaa at position 99 is Ala, Gly, or Pro
  SITE (106)..(106): Xaa at position 106 is Val, Ala, Gly, Leu, or Ile
  SITE (108)..(108): Xaa at position 108 is Val, Ala, Gly, Leu, or Ile
  SITE (110)..(110): Xaa at position 110 is Phe, Tyr, Met, His, Ile, Leu, Val Ala, or Gly
  SITE (112)..(112): Xaa at position 112 is Val, Ala, Gly, Leu, or Ile
  SITE (120)..(120): Xaa at position 120 is Ala, Gly, or Pro
  SITE (123)..(123): Xaa at position 123 is Leu, Ala, Val, Gly, or Ile
  SITE (124)..(124): Xaa at position 124 is Ala, Gly, or Pro
  SITE (126)..(126): Xaa at position 126 is Trp, Tyr, Phe, Met, His, Ile, Leu Val, Ala, or Gly
  SITE (127)..(127): Xaa at position 127 is Tyr, Phe, Met, His, Ile, Leu, Val Ala, or Gly
  SITE (128)..(128): Xaa at position 128 is Ala, Gly, or Pro
  SITE (137)..(137): Xaa at position 137 is Val, Ala, Gly, Leu, or Ile
  SITE (138)..(138): Xaa at position 138 is Phe, Tyr, Met, His, Ile, Leu, Val Ala, or Gly
  SITE (147)..(147): Xaa at position 147 is Val, Ala, Gly, Leu, or Ile
  SITE (150)..(150): Xaa at position 150 is Phe, Tyr, Met, His, Ile, Leu, Val Ala, or Gly
  SITE (151)..(151): Xaa at position 151 is Phe, Tyr, Met, His, Ile, Leu, Val Ala, or Gly
  SITE (165)..(165): Xaa at position 165 is Ile, Ala, Val, Leu, or Gly
  SITE (167)..(167): Xaa at position 167 is Ile, Ala, Val, Leu, or Gly
  SITE (168)..(168): Xaa at position 168 is Ile, Ala, Val, Leu, or Gly
  SITE (174)..(174): Xaa at position 174 is Ile, Ala, Val, Leu, or Gly
  SITE (194)..(194): Xaa at position 194 is Phe, Tyr, Met, His, Ile, Leu, Val Ala, or Gly
  SITE (201)..(201): Xaa at position 201 is Val, Ala, Gly, Leu, or Ile
  SITE (203)..(203): Xaa at position 203 is Ala, Gly, or Pro
  SITE (205)..(205): Xaa at position 205 is Ile, Ala, Val, Leu, or Gly
  SITE (212)..(212): Xaa at position 212 is Leu, Ala, Val, Gly, or Ile
  SITE (214)..(214): Xaa at position 214 is Val, Ala, Gly, Leu, or Ile
  SITE (216)..(216): Xaa at position 216 is Ile, Ala, Val, Leu, or Gly
  SITE (231)..(231): Xaa at position 231 is Ala, Gly, or Pro
  SITE (244)..(244): Xaa at position 244 is Phe, Tyr, Met, His, Ile, Leu, Val Ala, or Gly
  SITE (246)..(246): Xaa at position 246 is Ile, Ala, Val, Leu, or Gly
  SITE (248)..(248): Xaa at position 248 is Ala, Gly, or Pro
  SITE (257)..(257): Xaa at position 257 is His, Phe, Tyr, Lys, Arg, Gly, Ser Thr, Ala, Val, Leu, Ile, Asn, Met, or Gln
  SITE (259)..(259): Xaa at position 259 is Val, Ala, Gly, Leu, or Ile
  SITE (262)..(262): Xaa at position 262 is Phe, Tyr, Met, His, Ile, Leu, Val Ala, or Gly
  SITE (265)..(265): Xaa at position 265 is Phe, Tyr, Met, His, Ile, Leu, Val Ala, or Gly
MAGSRQRGLRARVRPLFCALLLSLGRFVRGDGVGGDPAVALPHRRFEYKYSFKGPHLVQSDGTXPFWAHAGNAIPSSDQXRXXPSLKSQRGSXXTKTKXAFENWEXEXTXRXTGRGRIGXDGXXIXXXENQGLEGPXXGSADLWNGXGIXXDSFDNDGKKNNPAXVXXGNNGQXHYDHQNDGASQALASCQRDXRNKPYPXRXKXTYYQNTXTXMXNNGFTPDKNDYEFCXKVENMIIPAQGHXGXSXATGGLADDXDXLSXLTXQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 536 - protein, 539 aa, Homo sapiens
  SITE (33)..(33): Xaa at position 33 is Leu, Ala, Val, Gly, or Ile
  SITE (42)..(42): Xaa at position 42 is Leu, Ala, Val, Gly, or Ile
  SITE (55)..(55): Xaa at position 55 is Tyr, Phe, Met, His, Ile, Leu, Val Ala, or Gly
  SITE (70)..(70): Xaa at position 70 is Cys, Ala, Val, Gly, Ser, or Thr
  SITE (77)..(77): Xaa at position 77 is Ile, Ala, Val, Leu, or Gly
  SITE (78)..(78): Xaa at position 78 is Ala, Gly, or Pro
  SITE (80)..(80): Xaa at position 80 is Val, Ala, Gly, Leu, or Ile
  SITE (92)..(92): Xaa at position 92 is Val, Ala, Gly, Leu, or Ile
  SITE (95)..(95): Xaa at position 95 is Ala, Gly, or Pro
  SITE (98)..(98): Xaa at position 98 is Ala, Gly, or Pro
  SITE (102)..(102): Xaa at position 102 is Trp, Tyr, Phe, Met, His, Ile, Leu Val, Ala, or Gly
  SITE (114)..(114): Xaa at position 114 is Val, Ala, Gly, Leu, or Ile
  SITE (117)..(117): Xaa at position 117 is Ile, Ala, Val, Leu, or Gly
  SITE (121)..(121): Xaa at position 121 is Leu, Ala, Val, Gly, or Ile
  SITE (125)..(125): Xaa at position 125 is Ile, Ala, Val, Leu, or Gly
  SITE (128)..(128): Xaa at position 128 is Leu, Ala, Val, Gly, or Ile
  SITE (131)..(131): Xaa at position 131 is Leu, Ala, Val, Gly, or Ile
  SITE (132)..(132): Xaa at position 132 is Val, Ala, Gly, Leu, or Ile
  SITE (134)..(134): Xaa at position 134 is Leu, Ala, Val, Gly, or Ile
  SITE (136)..(136): Xaa at position 136 is Met, Ile, Leu, Val, Ala, or Gly
  SITE (147)..(147): Xaa at position 147 is Val, Ala, Gly, Leu, or Ile
  SITE (150)..(150): Xaa at position 150 is Tyr, Phe, Met, His, Ile, Leu, Val Ala, or Gly
  SITE (151)..(151): Xaa at position 151 is Val, Ala, Gly, Leu, or Ile
  SITE (153)..(153): Xaa at position 153 is Ile, Ala, Val, Leu, or Gly
  SITE (154)..(154): Xaa at position 154 is Cys, Ala, Val, Gly, Ser, or Thr
  SITE (157)..(157): Xaa at position 157 is Ala, Gly, or Pro
  SITE (179)..(179): Xaa at position 179 is Ile, Ala, Val, Leu, or Gly
  SITE (187)..(187): Xaa at position 187 is Leu, Ala, Val, Gly, or Ile
  SITE (188)..(188): Xaa at position 188 is Val, Ala, Gly, Leu, or Ile
  SITE (190)..(190): Xaa at position 190 is Ile, Ala, Val, Leu, or Gly
  SITE (191)..(191): Xaa at position 191 is Ile, Ala, Val, Leu, or Gly
  SITE (198)..(198): Xaa at position 198 is Val, Ala, Gly, Leu, or Ile
  SITE (199)..(199): Xaa at position 199 is Ala, Gly, or Pro
  SITE (200)..(200): Xaa at position 200 is Val, Ala, Gly, Leu, or Ile
  SITE (201)..(201): Xaa at position 201 is Tyr, Phe, Met, His, Ile, Leu, Val Ala, or Gly
  SITE (206)..(206): Xaa at position 206 is Ala, Gly, or Pro
  SITE (207)..(207): Xaa at position 207 is Ile, Ala, Val, Leu, or Gly
  SITE (208)..(208): Xaa at position 208 is Ala, Gly, or Pro
  SITE (209)..(209): Xaa at position 209 is Met, Ile, Leu, Val, Ala, or Gly
  SITE (210)..(210): Xaa at position 210 is Ile, Ala, Val, Leu, or Gly
  SITE (211)..(211): Xaa at position 211 is Cys, Ala, Val, Gly, Ser, or Thr
  SITE (214)..(214): Xaa at position 214 is Val, Ala, Gly, Leu, or Ile
  SITE (215)..(215): Xaa at position 215 is Cys, Ala, Val, Gly, Ser, or Thr
  SITE (216)..(216): Xaa at position 216 is Leu, Ala, Val, Gly, or Ile
  SITE (217)..(217): Xaa at position 217 is Trp, Tyr, Phe, Met, His, Ile, Leu Val, Ala, or Gly
  SITE (225)..(225): Xaa at position 225 is Leu, Ala, Val, Gly, or Ile
  SITE (226)..(226): Xaa at position 226 is Ile, Ala, Val, Leu, or Gly
  SITE (228)..(228): Xaa at position 228 is Val, Ala, Gly, Leu, or Ile
  SITE (229)..(229): Xaa at position 229 is Ala, Gly, or Pro
  SITE (230)..(230): Xaa at position 230 is Val, Ala, Gly, Leu, or Ile
  SITE (234)..(234): Xaa at position 234 is Ile, Ala, Val, Leu, or Gly
  SITE (238)..(238): Xaa at position 238 is Leu, Ala, Val, Gly, or Ile
  SITE (246)..(246): Xaa at position 246 is Ala, Gly, or Pro
  SITE (247)..(247): Xaa at position 247 is Ile, Ala, Val, Leu, or Gly
  SITE (250)..(250): Xaa at position 250 is Leu, Ala, Val, Gly, or Ile
  SITE (252)..(252): Xaa at position 252 is Cys, Ala, Val, Gly, Ser, or Thr
  SITE (257)..(257): Xaa at position 257 is Ile, Ala, Val, Leu, or Gly
  SITE (260)..(260): Xaa at position 260 is Ala, Gly, or Pro
  SITE (261)..(261): Xaa at position 261 is Met, Ile, Leu, Val, Ala, or Gly
  SITE (262)..(262): Xaa at position 262 is Ala, Gly, or Pro
  SITE (267)..(267): Xaa at position 267 is Val, Ala, Gly, Leu, or Ile
  SITE (269)..(269): Xaa at position 269 is Leu, Ala, Val, Gly, or Ile
  SITE (270)..(270): Xaa at position 270 is Leu, Ala, Val, Gly, or Ile
  SITE (286)..(286): Xaa at position 286 is Val, Ala, Gly, Leu, or Ile
  SITE (294)..(294): Xaa at position 294 is Leu, Ala, Val, Gly, or Ile
  SITE (302)..(302): Xaa at position 302 is Ala, Gly, or Pro
  SITE (303)..(303): Xaa at position 303 is Ile, Ala, Val, Leu, or Gly
  SITE (304)..(304): Xaa at position 304 is Ile, Ala, Val, Leu, or Gly
  SITE (305)..(305): Xaa at position 305 is Ala, Gly, or Pro
  SITE (314)..(314): Xaa at position 314 is Val, Ala, Gly, Leu, or Ile
  SITE (318)..(318): Xaa at position 318 is Ala, Gly, or Pro
  SITE (321)..(321): Xaa at position 321 is Ala, Gly, or Pro
  SITE (326)..(326): Xaa at position 326 is Ala, Gly, or Pro
  SITE (333)..(333): Xaa at position 333 is Ala, Gly, or Pro
  SITE (336)..(336): Xaa at position 336 is Leu, Ala, Val, Gly, or Ile
  SITE (337)..(337): Xaa at position 337 is Phe, Tyr, Met, His, Ile, Leu, Val Ala, or Gly
  SITE (338)..(338): Xaa at position 338 is Ile, Ala, Val, Leu, or Gly
  SITE (346)..(346): Xaa at position 346 is Val, Ala, Gly, Leu, or Ile
  SITE (350)..(350): Xaa at position 350 is Leu, Ala, Val, Gly, or Ile
  SITE (369)..(369): Xaa at position 369 is Tyr, Phe, Met, His, Ile, Leu, Val Ala, or Gly
  SITE (372)..(372): Xaa at position 372 is Leu, Ala, Val, Gly, or Ile
  SITE (381)..(381): Xaa at position 381 is Phe, Tyr, Met, His, Ile, Leu, Val Ala, or Gly
  SITE (384)..(384): Xaa at position 384 is Ala, Gly, or Pro
  SITE (385)..(385): Xaa at position 385 is Val, Ala, Gly, Leu, or Ile
  SITE (388)..(388): Xaa at position 388 is Ala, Gly, or Pro
  SITE (408)..(408): Xaa at position 408 is Tyr, Phe, Met, His, Ile, Leu, Val Ala, or Gly
  SITE (409)..(409): Xaa at position 409 is Val, Ala, Gly, Leu, or Ile
  SITE (413)..(413): Xaa at position 413 is Ile, Ala, Val, Leu, or Gly
  SITE (414)..(414): Xaa at position 414 is Val, Ala, Gly, Leu, or Ile
  SITE (424)..(424): Xaa at position 424 is Ala, Gly, or Pro
  SITE (430)..(430): Xaa at position 430 is Ala, Gly, or Pro
  SITE (432)..(432): Xaa at position 432 is Ile, Ala, Val, Leu, or Gly
  SITE (433)..(433): Xaa at position 433 is Leu, Ala, Val, Gly, or Ile
  SITE (435)..(435): Xaa at position 435 is Val, Ala, Gly, Leu, or Ile
  SITE (436)..(436): Xaa at position 436 is Phe, Tyr, Met, His, Ile, Leu, Val Ala, or Gly
  SITE (438)..(438): Xaa at position 438 is Phe, Tyr, Met, His, Ile, Leu, Val Ala, or Gly
  SITE (444)..(444): Xaa at position 444 is Val, Ala, Gly, Leu, or Ile
  SITE (455)..(455): Xaa at position 455 is Leu, Ala, Val, Gly, or Ile
  SITE (459)..(459): Xaa at position 459 is Ile, Ala, Val, Leu, or Gly
  SITE (460)..(460): Xaa at position 460 is Phe, Tyr, Met, His, Ile, Leu, Val Ala, or Gly
  SITE (470)..(470): Xaa at position 470 is Trp, Tyr, Phe, Met, His, Ile, Leu Val, Ala, or Gly
  SITE (516)..(516): Xaa at position 516 is Tyr, Phe, Met, His, Ile, Leu, Val Ala, or Gly
MWRLPRALCVHAAKTSKLSGPWSRPAAFMSTLXINQPQYAWXKELGLREENEGVXNGSWGGRGEVITTYXPANNEPXXRXRQASVADYEETXKKXREXWKIXADIPAPKRGEIXRQXGDAXREKXQVXGSXXSXEXGKILVEGVGEXQEXXDXXDYXVGLSRMIGGPILPSERSGHALXEQWNPVGXXGXXTAFNFPXXXXGWNNXXXXXXGNXXXXKGAPTTSXXSXXXTKIXAKVXEDNKLPGXXCSXTXGGADXGTXXXKDERXNXXSFTGSTQVGKQVGLMXQERFGRSXLELGGNNXXXXFEDADLSLXVPSXLFXAVGTXGQRCTTXRRXXXHESIHDEXVNRXKKAYAQIRVGNPWDPNVLXGPXHTKQAVSMXLGXXEEXKKEGGTVVYGGKVMDRPGNXXEPTXXTGLGHDASIXHTETFXPXXYXXKXKNEEEXFAWNNEVKQGXSSSXXTKDLGRIFRXLGPKGSDCGIVNVNIPTSGAEIGGAFGGEKHTGGGRESGSDAWKQXMRRSTCTINYSKDLPLAQGIKFQ

SEQ ID NO: 537 - protein, 968 aa, Homo sapiens
  SITE (10)..(10): Xaa at position 10 is Ile, Ala, Val, Leu, or Gly
  SITE (14)..(14): Xaa at position 14 is Phe, Tyr, Met, His, Ile, Leu, Val Ala, or Gly
  SITE (17)..(17): Xaa at position 17 is Phe, Tyr, Met, His, Ile, Leu, Val Ala, or Gly
  SITE (18)..(18): Xaa at position 18 is Phe, Tyr, Met, His, Ile, Leu, Val Ala, or Gly
  SITE (42)..(42): Xaa at position 42 is Ala, Gly, or Pro
  SITE (44)..(44): Xaa at position 44 is Ala, Gly, or Pro
  SITE (46)..(46): Xaa at position 46 is Met, Ile, Leu, Val, Ala, or Gly
  SITE (49)..(49): Xaa at position 49 is Phe, Tyr, Met, His, Ile, Leu, Val Ala, or Gly
  SITE (69)..(69): Xaa at position 69 is Ala, Gly, or Pro
  SITE (70)..(70): Xaa at position 70 is Ala, Gly, or Pro
  SITE (75)..(75): Xaa at position 75 is Cys, Ala, Val, Gly, Ser, or Thr
  SITE (76)..(76): Xaa at position 76 is Ile, Ala, Val, Leu, or Gly
  SITE (97)..(97): Xaa at position 97 is Phe, Tyr, Met, His, Ile, Leu, Val Ala, or Gly
  SITE (101)..(101): Xaa at position 101 is Leu, Ala, Val, Gly, or Ile
  SITE (104)..(104): Xaa at position 104 is Trp, Tyr, Phe, Met, His, Ile, Leu Val, Ala, or Gly
  SITE (115)..(115): Xaa at position 115 is Cys, Ala, Val, Gly, Ser, or Thr
  SITE (117)..(117): Xaa at position 117 is Met, Ile, Leu, Val, Ala, or Gly
  SITE (118)..(118): Xaa at position 118 is Ala, Gly, or Pro
  SITE (121)..(121): Xaa at position 121 is Leu, Ala, Val, Gly, or Ile
  SITE (122)..(122): Xaa at position 122 is Leu, Ala, Val, Gly, or Ile
  SITE (134)..(134): Xaa at position 134 is Tyr, Phe, Met, His, Ile, Leu, Val Ala, or Gly
  SITE (135)..(135): Xaa at position 135 is Val, Ala, Gly, Leu, or Ile
  SITE (138)..(138): Xaa at position 138 is Phe, Tyr, Met, His, Ile, Leu, Val Ala, or Gly
  SITE (152)..(152): Xaa at position 152 is Cys, Ala, Val, Gly, Ser, or Thr
  SITE (156)..(156): Xaa at position 156 is Trp, Tyr, Phe, Met, His, Ile, Leu Val, Ala, or Gly
  SITE (184)..(184): Xaa at position 184 is Cys, Ala, Val, Gly, Ser, or Thr
  SITE (187)..(187): Xaa at position 187 is Cys, Ala, Val, Gly, Ser, or Thr
  SITE (190)..(190): Xaa at position 190 is Ile, Ala, Val, Leu, or Gly
  SITE (191)..(191): Xaa at position 191 is His, Phe, Tyr, Lys, Arg, Gly, Ser Thr, Ala, Val, Leu, Ile, Asn, Met, or Gln
  SITE (200)..(200): Xaa at position 200 is Ala, Gly, or Pro
  SITE (212)..(212): Xaa at position 212 is Leu, Ala, Val, Gly, or Ile
  SITE (215)..(215): Xaa at position 215 is Trp, Tyr, Phe, Met, His, Ile, Leu Val, Ala, or Gly
  SITE (217)..(217): Xaa at position 217 is Leu, Ala, Val, Gly, or Ile
  SITE (219)..(219): Xaa at position 219 is Phe, Tyr, Met, His, Ile, Leu, Val Ala, or Gly
  SITE (220)..(220): Xaa at position 220 is Ile, Ala, Val, Leu, or Gly
  SITE (238)..(238): Xaa at position 238 is Ile, Ala, Val, Leu, or Gly
  SITE (242)..(242): Xaa at position 242 is Met, Ile, Leu, Val, Ala, or Gly
  SITE (244)..(244): Xaa at position 244 is Leu, Ala, Val, Gly, or Ile
  SITE (247)..(247): Xaa at position 247 is Leu, Ala, Val, Gly, or Ile
  SITE (248)..(248): Xaa at position 248 is Val, Ala, Gly, Leu, or Ile
  SITE (258)..(258): Xaa at position 258 is Tyr, Phe, Met, His, Ile, Leu, Val Ala, or Gly
  SITE (263)..(263): Xaa at position 263 is Phe, Tyr, Met, His, Ile, Leu, Val Ala, or Gly
  SITE (266)..(266): Xaa at position 266 is Tyr, Phe, Met, His, Ile, Leu, Val Ala, or Gly
  SITE (270)..(270): Xaa at position 270 is Ile, Ala, Val, Leu, or Gly
  SITE (288)..(288): Xaa at position 288 is Ala, Gly, or Pro
  SITE (294)..(294): Xaa at position 294 is Ala, Gly, or Pro
  SITE (295)..(295): Xaa at position 295 is Tyr, Phe, Met, His, Ile, Leu, Val Ala, or Gly
  SITE (297)..(297): Xaa at position 297 is Val, Ala, Gly, Leu, or Ile
  SITE (298)..(298): Xaa at position 298 is Leu, Ala, Val, Gly, or Ile
  SITE (299)..(299): Xaa at position 299 is Ala, Gly, or Pro
  SITE (301)..(301): Xaa at position 301 is His, Phe, Tyr, Lys, Arg, Gly, Ser Thr, Ala, Val, Leu, Ile, Asn, Met, or Gln
  SITE (302)..(302): Xaa at position 302 is Ala, Gly, or Pro
  SITE (305)..(305): Xaa at position 305 is Ile, Ala, Val, Leu, or Gly
  SITE (307)..(307): Xaa at position 307 is Val, Ala, Gly, Leu, or Ile
  SITE (308)..(308): Xaa at position 308 is Ala, Gly, or Pro
  SITE (309)..(309): Xaa at position 309 is Leu, Ala, Val, Gly, or Ile
  SITE (324)..(324): Xaa at position 324 is Leu, Ala, Val, Gly, or Ile
  SITE (327)..(327): Xaa at position 327 is Ile, Ala, Val, Leu, or Gly
  SITE (328)..(328): Xaa at position 328 is Leu, Ala, Val, Gly, or Ile
  SITE (331)..(331): Xaa at position 331 is Ala, Gly, or Pro
  SITE (332)..(332): Xaa at position 332 is Val, Ala, Gly, Leu, or Ile
  SITE (335)..(335): Xaa at position 335 is Ala, Gly, or Pro
  SITE (339)..(339): Xaa at position 339 is Leu, Ala, Val, Gly, or Ile
  SITE (346)..(346): Xaa at position 346 is Phe, Tyr, Met, His, Ile, Leu, Val Ala, or Gly
  SITE (347)..(347): Xaa at position 347 is Ala, Gly, or Pro
  SITE (349)..(349): Xaa at position 349 is Leu, Ala, Val, Gly, or Ile
  SITE (350)..(350): Xaa at position 350 is Val, Ala, Gly, Leu, or Ile
  SITE (353)..(353): Xaa at position 353 is Val, Ala, Gly, Leu, or Ile
  SITE (357)..(357): Xaa at position 357 is Leu, Ala, Val, Gly, or Ile
  SITE (361)..(361): Xaa at position 361 is Phe, Tyr, Met, His, Ile, Leu, Val Ala, or Gly
  SITE (375)..(375): Xaa at position 375 is Ile, Ala, Val, Leu, or Gly
MDSTLTASEXRQRXIDXXKRNEHTYVHSSATIPLDDPTLLFXNXGXNQXKPIFLNTIDPSHPMAKLSRXXNTQKXXRAGGKHNDLDDVGKDVYHHTXFEMXGSXSFGDYFKELAXKXXLEXXTQEFGIPIERLXXTYXGGDEAAGLEADLEXKQIXQNLGLDDTKILPGNMKDNFWEMGDTGPXGPXSEXXYDRIGGRDXAHLVNQDDPNVXEIXNXVXXQYNREADGILKPLPKKSXDTGXGXERXXSVLQNKMSNXDTDLXVPXFEAXQKGTGARPYTGKVGAEDXDGIDMXXRXXXDXXRTXTXXXADGGRPDNTGRGYVXRRXXRRXXRYXHEKXNASRGFXXTXXDVXVQSXGDAXPELKKDPDMVKDIXNEEEVQFLKTLSRGRRILDRKIQSLGDSKTIPGDTAWLLYDTYGFPVDLTGLIAEEKGLVVDMDGFEEERKLAQLKSQGKGAGGEDLIMLDIYAIEELRARGLEVTDDSPKYNYHLDSSGSYVFENTVATVMALRREKMFVEEVSTGQECGVVLDKTCFYAEQGGQIYDEGYLVKVDDSSEDKTEFTVKNAQVRGGYVLHIGTIYGDLKVGDQVWLFIDEPRRRPIMSNHTATHILNFALRSVLGEADQKGSLVAPDRLRFDFTAKGAMSTQQIKKAEEIANEMIEAAKAVYTQDCPLAAAKAIQGLRAVFDETYPDPVRVVSIGVPVSELLDDPSGPAGSLTSVEFCGGTHLRNSSHAGAFVIVTEEAIAKGIRRIVAVTGAEAQKALRKAESLKKCLSVMEAKVKAQTAPNKDVQREIADLGEALATAVIPQWQKDELRETLKSLKKVMDDLDRASKADVQKRVLEKTKQFIDSNPNQPLVILEMESGASAKALNEALKLFKMHSPQTSAMLFTVDNEAGKITCLCQVPQNAANRGLKASEWVQQVSGLMDGKGGGKDVSAQATGKNVGCLQEALQLATSFAQLRLGDVKN

SEQ ID NO: 538 - protein, 370 aa, Homo sapiens
  SITE (44)..(44): Xaa at position 44 is Ala, Gly, or Pro
MASSTTRGPRVSDLFSGLPPAVTTPANQSAEASAGNGSVAGADXPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVIVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 539 - protein, 757 aa, Homo sapiens
  SITE (287)..(287): Xaa at position 287 is Cys, Ala, Val, Gly, Ser, or Thr
  SITE (292)..(292): Xaa at position 292 is Cys, Ala, Val, Gly, Ser, or Thr
  SITE (328)..(328): Xaa at position 328 is Cys, Ala, Val, Gly, Ser, or Thr
  SITE (351)..(351): Xaa at position 351 is Cys, Ala, Val, Gly, Ser, or Thr
  SITE (387)..(387): Xaa at position 387 is Cys, Ala, Val, Gly, Ser, or Thr
  SITE (410)..(410): Xaa at position 410 is Cys, Ala, Val, Gly, Ser, or Thr
  SITE (448)..(448): Xaa at position 448 is Cys, Ala, Val, Gly, Ser, or Thr
  SITE (484)..(484): Xaa at position 484 is Cys, Ala, Val, Gly, Ser, or Thr
  SITE (504)..(504): Xaa at position 504 is Cys, Ala, Val, Gly, Ser, or Thr
  SITE (531)..(531): Xaa at position 531 is Phe, Tyr, Met, His, Ile, Leu, Val Ala, or Gly
  SITE (539)..(539): Xaa at position 539 is Leu, Ala, Val, Gly, or Ile
  SITE (570)..(570): Xaa at position 570 is Leu, Ala, Val, Gly, or Ile
  SITE (571)..(571): Xaa at position 571 is Ala, Gly, or Pro
  SITE (572)..(572): Xaa at position 572 is Val, Ala, Gly, Leu, or Ile
  SITE (577)..(577): Xaa at position 577 is Phe, Tyr, Met, His, Ile, Leu, Val Ala, or Gly
  SITE (582)..(582): Xaa at position 582 is Phe, Tyr, Met, His, Ile, Leu, Val Ala, or Gly
  SITE (587)..(587): Xaa at position 587 is His, Phe, Tyr, Lys, Arg, Gly, Ser Thr, Ala, Val, Leu, Ile, Asn, Met, or Gln
  SITE (588)..(588): Xaa at position 588 is Val, Ala, Gly, Leu, or Ile
  SITE (596)..(596): Xaa at position 596 is Tyr, Phe, Met, His, Ile, Leu, Val Ala, or Gly
  SITE (597)..(597): Xaa at position 597 is Ala, Gly, or Pro
  SITE (600)..(600): Xaa at position 600 is Ile, Ala, Val, Leu, or Gly
  SITE (601)..(601): Xaa at position 601 is Phe, Tyr, Met, His, Ile, Leu, Val Ala, or Gly
  SITE (609)..(609): Xaa at position 609 is Phe, Tyr, Met, His, Ile, Leu, Val Ala, or Gly
  SITE (610)..(610): Xaa at position 610 is Tyr, Phe, Met, His, Ile, Leu, Val Ala, or Gly
  SITE (611)..(611): Xaa at position 611 is Val, Ala, Gly, Leu, or Ile
  SITE (613)..(613): Xaa at position 613 is Met, Ile, Leu, Val, Ala, or Gly
  SITE (629)..(629): Xaa at position 629 is Ala, Gly, or Pro
  SITE (631)..(631): Xaa at position 631 is Ala, Gly, or Pro
  SITE (635)..(635): Xaa at position 635 is Ile, Ala, Val, Leu, or Gly
  SITE (637)..(637): Xaa at position 637 is Leu, Ala, Val, Gly, or Ile
  SITE (639)..(639): Xaa at position 639 is Ala, Gly, or Pro
  SITE (640)..(640): Xaa at position 640 is Val, Ala, Gly, Leu, or Ile
  SITE (650)..(650): Xaa at position 650 is Leu, Ala, Val, Gly, or Ile
  SITE (653)..(653): Xaa at position 653 is Ala, Gly, or Pro
  SITE (654)..(654): Xaa at position 654 is Leu, Ala, Val, Gly, or Ile
  SITE (655)..(655): Xaa at position 655 is Trp, Tyr, Phe, Met, His, Ile, Leu Val, Ala, or Gly
  SITE (664)..(664): Xaa at position 664 is Val, Ala, Gly, Leu, or Ile
  SITE (684)..(684): Xaa at position 684 is Trp, Tyr, Phe, Met, His, Ile, Leu Val, Ala, or Gly
  SITE (686)..(686): Xaa at position 686 is Leu, Ala, Val, Gly, or Ile
  SITE (688)..(688): Xaa at position 688 is His, Phe, Tyr, Lys, Arg, Gly, Ser Thr, Ala, Val, Leu, Ile, Asn, Met, or Gln
  SITE (694)..(694): Xaa at position 694 is Tyr, Phe, Met, His, Ile, Leu, Val Ala, or Gly
  SITE (695)..(695): Xaa at position 695 is Ile, Ala, Val, Leu, or Gly
  SITE (697)..(697): Xaa at position 697 is Val, Ala, Gly, Leu, or Ile
  SITE (717)..(717): Xaa at position 717 is Met, Ile, Leu, Val, Ala, or Gly
  SITE (722)..(722): Xaa at position 722 is Leu, Ala, Val, Gly, or Ile
  SITE (724)..(724): Xaa at position 724 is Val, Ala, Gly, Leu, or Ile
  SITE (725)..(725): Xaa at position 725 is Phe, Tyr, Met, His, Ile, Leu, Val Ala, or Gly
  SITE (726)..(726): Xaa at position 726 is Cys, Ala, Val, Gly, Ser, or Thr
  SITE (732)..(732): Xaa at position 732 is Ile, Ala, Val, Leu, or Gly
  SITE (734)..(734): Xaa at position 734 is Trp, Tyr, Phe, Met, His, Ile, Leu Val, Ala, or Gly
  SITE (735)..(735): Xaa at position 735 is Ala, Gly, or Pro
  SITE (737)..(737): Xaa at position 737 is Leu, Ala, Val, Gly, or Ile
  SITE (741)..(741): Xaa at position 741 is Cys, Ala, Val, Gly, Ser, or Thr
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQXRKDNXVTVPNSGQEDVDRDGIGDACDPDADGDGVPNEKDNXPLVRNPDQRNTDEDKWGDACDNXRSQKNDDQKDTDQDGRGDACDDDIDGDRIRNQADNXPRVPNSDQKDSDGDGIGDACDNXPQKSNPDQADVDHDFVGDACDSDQDQDGDGHQDSRDNXPTVPNSAQEDSDHDGQGDACDDDDDNDGVPDSRDNXRLVPNPGQEDADRDGVGDVXQDDFDADKVVDKIDVCPENAEVTLTDXRAFQTVVXDPEGDAQIDPNWVVLNQGREIVQTMNSDPGXXXGYTAXNGVDXEGTFXXNTVTDDDXXGFXXGYQDSSSXXXVXWKQMEQTYWQANPFRXVXEPGXQXKXXKSSTGPGEQXRNXXXHTGDTESQXRLLWKDPRNVGWKDKKSYRXFXQXRPQVGXXRXRFYEGPELVADSNVVLDTTXRGGRXGXXXFSQENXIXXNXRYRXNDTIPEDYETHQLRQA

SEQ ID NO: 540 - protein, 467 aa, Homo sapiens
  SITE (89)..(89): Xaa at position 89 is Val, Ala, Gly, Leu, or Ile
  SITE (92)..(92): Xaa at position 92 is Cys, Ala, Val, Gly, Ser, or Thr
  SITE (93)..(93): Xaa at position 93 is Met, Ile, Leu, Val, Ala, or Gly
  SITE (96)..(96): Xaa at position 96 is Val, Ala, Gly, Leu, or Ile
  SITE (136)..(136): Xaa at position 136 is Ala, Gly, or Pro
  SITE (213)..(213): Xaa at position 213 is Ile, Ala, Val, Leu, or Gly
  SITE (226)..(226): Xaa at position 226 is Leu, Ala, Val, Gly, or Ile
  SITE (231)..(231): Xaa at position 231 is Ala, Gly, or Pro
  SITE (234)..(234): Xaa at position 234 is Ala, Gly, or Pro
  SITE (235)..(235): Xaa at position 235 is Leu, Ala, Val, Gly, or Ile
  SITE (246)..(246): Xaa at position 246 is Ala, Gly, or Pro
  SITE (261)..(261): Xaa at position 261 is Val, Ala, Gly, Leu, or Ile
  SITE (285)..(285): Xaa at position 285 is Ala, Gly, or Pro
  SITE (379)..(379): Xaa at position 379 is Val, Ala, Gly, Leu, or Ile
  SITE (381)..(381): Xaa at position 381 is Leu, Ala, Val, Gly, or Ile
  SITE (386)..(386): Xaa at position 386 is Phe, Tyr, Met, His, Ile, Leu, Val Ala, or Gly
  SITE (389)..(389): Xaa at position 389 is Tyr, Phe, Met, His, Ile, Leu, Val Ala, or Gly
  SITE (391)..(391): Xaa at position 391 is Val, Ala, Gly, Leu, or Ile
  SITE (392)..(392): Xaa at position 392 is Leu, Ala, Val, Gly, or Ile
  SITE (393)..(393): Xaa at position 393 is Val, Ala, Gly, Leu, or Ile
  SITE (396)..(396): Xaa at position 396 is Ala, Gly, or Pro
  SITE (410)..(410): Xaa at position 410 is Cys, Ala, Val, Gly, Ser, or Thr
  SITE (414)..(414): Xaa at position 414 is Ile, Ala, Val, Leu, or Gly
  SITE (439)..(439): Xaa at position 439 is Ile, Ala, Val, Leu, or Gly
  SITE (457)..(457): Xaa at position 457 is Met, Ile, Leu, Val, Ala, or Gly
MTELPAPLSYFQNAQMSEDNHLSNTVRSQNDNRERQEHNDRRSLGHPEPLSNGRPQGNSRQVVEQDEEEDEELTLKYGAKHVIMLFVPXTLXXVVXVATIKSVSFYTRKDGQLIYTPFTEDTETVGQRALHSILNXAIMISVIVVMTILLVVLYKYRCYKVIHAWLIISSLLLLFFFSFIYLGEVFKTYNVAVDYITVALLIWNFGVVGMISXHWKGPLRLQQAYXIMISXLMXXVFIKYLPEWTXWLILAVISVYDLVAXLCPKGPLRMLVETAQERNETLFPXLIYSSTMVWLVNMAEGDPEAQRRVSKNSKYNAESTERESQDTVAENDDGGFSEEWEAQRDSHLGPHRSTPESRAAVQELSSSILAGEDPEERGXKXGLGDXIFXSXXXGKXSATASGDWNTTIAXFVAXLIGLCLTLLLLAIFKKALPALPISXTFGLVFYFATDYLVQPFXDQLAFHQFYI

SEQ ID NO: 541 - protein, 147 aa, Homo sapiens
  SITE (23)..(23): Xaa at position 23 is Phe, Tyr, Met, His, Ile, Leu, Val Ala, or Gly
  SITE (24)..(24): Xaa at position 24 is Ala, Gly, or Pro
  SITE (36)..(36): Xaa at position 36 is Val, Ala, Gly, Leu, or Ile
  SITE (37)..(37): Xaa at position 37 is Leu, Ala, Val, Gly, or Ile
  SITE (38)..(38): Xaa at position 38 is Val, Ala, Gly, Leu, or Ile
  SITE (39)..(39): Xaa at position 39 is Cys, Ala, Val, Gly, Ser, or Thr
  SITE (58)..(58): Xaa at position 58 is Leu, Ala, Val, Gly, or Ile
  SITE (65)..(65): Xaa at position 65 is Val, Ala, Gly, Leu, or Ile
  SITE (69)..(69): Xaa at position 69 is Val, Ala, Gly, Leu, or Ile
  SITE (94)..(94): Xaa at position 94 is His, Phe, Tyr, Lys, Arg, Gly, Ser Thr, Ala, Val, Leu, Ile, Asn, Met, or Gln
  SITE (99)..(99): Xaa at position 99 is Val, Ala, Gly, Leu, or Ile
  SITE (139)..(139): Xaa at position 139 is Ala, Gly, or Pro
  SITE (142)..(142): Xaa at position 142 is Leu, Ala, Val, Gly, or Ile
MSFRFGQHLIKPSVVFLKTELSXXLVNRKPVVPGHXXXXPLRPVERFHDLRPDEVADXFQTTQRXGTVXEKHFHGTSLTFSMQDGPEAGQTVKXVHVHXLPRKAGDFHRNDSIYEELQKHDKEDFPASWRSEEEMAAEXAAXRVYFQ

SEQ ID NO: 542 - protein, 448 aa, Homo sapiens
  SITE (95)..(95): Xaa at position 95 is Val, Ala, Gly, Leu, or Ile
  SITE (98)..(98): Xaa at position 98 is Cys, Ala, Val, Gly, Ser, or Thr
  SITE (99)..(99): Xaa at position 99 is Met, Ile, Leu, Val, Ala, or Gly
  SITE (102)..(102): Xaa at position 102 is Val, Ala, Gly, Leu, or Ile
  SITE (219)..(219): Xaa at position 219 is Ile, Ala, Val, Leu, or Gly
  SITE (232)..(232): Xaa at position 232 is Leu, Ala, Val, Gly, or Ile
  SITE (237)..(237): Xaa at position 237 is Ala, Gly, or Pro
  SITE (240)..(240): Xaa at position 240 is Ala, Gly, or Pro
  SITE (241)..(241): Xaa at position 241 is Leu, Ala, Val, Gly, or Ile
  SITE (252)..(252): Xaa at position 252 is Ala, Gly, or Pro
  SITE (267)..(267): Xaa at position 267 is Val, Ala, Gly, Leu, or Ile
  SITE (291)..(291): Xaa at position 291 is Ala, Gly, or Pro
  SITE (362)..(362): Xaa at position 362 is Leu, Ala, Val, Gly, or Ile
  SITE (367)..(367): Xaa at position 367 is Phe, Tyr, Met, His, Ile, Leu, Val Ala, or Gly
  SITE (370)..(370): Xaa at position 370 is Tyr, Phe, Met, His, Ile, Leu, Val Ala, or Gly
  SITE (373)..(373): Xaa at position 373 is Leu, Ala, Val, Gly, or Ile
  SITE (374)..(374): Xaa at position 374 is Val, Ala, Gly, Leu, or Ile
  SITE (377)..(377): Xaa at position 377 is Ala, Gly, or Pro
  SITE (391)..(391): Xaa at position 391 is Cys, Ala, Val, Gly, Ser, or Thr
  SITE (395)..(395): Xaa at position 395 is Ile, Ala, Val, Leu, or Gly
  SITE (420)..(420): Xaa at position 420 is Ile, Ala, Val, Leu, or Gly
MLTFMASDSEEEVCDERTSLMSAESPTPRSCQEGRQGPEDGENTAQWRSQENEEDGEEDPDRYVCSGVPGRPPGLEEELTLKYGAKHVIMLFVPXTLXXIVXVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCXHWKGPLVLQQAYXIMISXLMXXVFIKYLPEWSXWVILGAISVYDLVAXLCPKGPLRMLVETAQERNEPIFPXLIYSSAMVWTVGMAKLDPSSQGALQLPYDPEMEEDSYDSFGEPSYPEVFEPPLTGYPGEELEEEEERGVKXGLGDXIFXSVXXGKXAATGSGDWNTTLAXFVAXLIGLCLTLLLLAVFKKALPALPISXTFGLIFYFSTDNLVRPFMDTLASHQLYI

SEQ ID NO: 543 - protein, 423 aa, Homo sapiens
  SITE (66)..(66): Xaa at position 66 is Val, Ala, Gly, Leu, or Ile
  SITE (72)..(72): Xaa at position 72 is Trp, Tyr, Phe, Met, His, Ile, Leu Val, Ala, or Gly
  SITE (78)..(78): Xaa at position 78 is Val, Ala, Gly, Leu, or Ile
  SITE (79)..(79): Xaa at position 79 is Ile, Ala, Val, Leu, or Gly
  SITE (80)..(80): Xaa at position 80 is Val, Ala, Gly, Leu, or Ile
  SITE (83)..(83): Xaa at position 83 is Ala, Gly, or Pro
  SITE (86)..(86): Xaa at position 86 is Ala, Gly, or Pro
  SITE (87)..(87): Xaa at position 87 is Cys, Ala, Val, Gly, Ser, or Thr
  SITE (88)..(88): Xaa at position 88 is Val, Ala, Gly, Leu, or Ile
  SITE (95)..(95): Xaa at position 95 is Val, Ala, Gly, Leu, or Ile
  SITE (97)..(97): Xaa at position 97 is Ala, Gly, or Pro
  SITE (107)..(107): Xaa at position 107 is Tyr, Phe, Met, His, Ile, Leu, Val Ala, or Gly
  SITE (115)..(115): Xaa at position 115 is Phe, Tyr, Met, His, Ile, Leu, Val Ala, or Gly
  SITE (123)..(123): Xaa at position 123 is Ala, Gly, or Pro
  SITE (127)..(127): Xaa at position 127 is Ile, Ala, Val, Leu, or Gly
  SITE (130)..(130): Xaa at position 130 is Met, Ile, Leu, Val, Ala, or Gly
  SITE (131)..(131): Xaa at position 131 is Cys, Ala, Val, Gly, Ser, or Thr
  SITE (134)..(134): Xaa at position 134 is Leu, Ala, Val, Gly, or Ile
  SITE (163)..(163): Xaa at position 163 is Leu, Ala, Val, Gly, or Ile
  SITE (164)..(164): Xaa at position 164 is Tyr, Phe, Met, His, Ile, Leu, Val Ala, or Gly
  SITE (166)..(166): Xaa at position 166 is Ala, Gly, or Pro
  SITE (167)..(167): Xaa at position 167 is Met, Ile, Leu, Val, Ala, or Gly
  SITE (171)..(171): Xaa at position 171 is Ile, Ala, Val, Leu, or Gly
  SITE (172)..(172): Xaa at position 172 is Leu, Ala, Val, Gly, or Ile
  SITE (173)..(173): Xaa at position 173 is Ile, Ala, Val, Leu, or Gly
  SITE (174)..(174): Xaa at position 174 is Val, Ala, Gly, Leu, or Ile
  SITE (179)..(179): Xaa at position 179 is Ile, Ala, Val, Leu, or Gly
  SITE (180)..(180): Xaa at position 180 is Ile, Ala, Val, Leu, or Gly
  SITE (182)..(182): Xaa at position 182 is Ala, Gly, or Pro
  SITE (184)..(184): Xaa at position 184 is Met, Ile, Leu, Val, Ala, or Gly
  SITE (185)..(185): Xaa at position 185 is Ala, Gly, or Pro
  SITE (186)..(186): Xaa at position 186 is Trp, Tyr, Phe, Met, His, Ile, Leu Val, Ala, or Gly
  SITE (195)..(195): Xaa at position 195 is Ala, Gly, or Pro
  SITE (196)..(196): Xaa at position 196 is Tyr, Phe, Met, His, Ile, Leu, Val Ala, or Gly
  SITE (200)..(200): Xaa at position 200 is Ile, Ala, Val, Leu, or Gly
  SITE (203)..(203): Xaa at position 203 is Tyr, Phe, Met, His, Ile, Leu, Val Ala, or Gly
  SITE (218)..(218): Xaa at position 218 is Met, Ile, Leu, Val, Ala, or Gly
  SITE (222)..(222): Xaa at position 222 is Leu, Ala, Val, Gly, or Ile
  SITE (229)..(229): Xaa at position 229 is Ile, Ala, Val, Leu, or Gly
  SITE (245)..(245): Xaa at position 245 is Val, Ala, Gly, Leu, or Ile
  SITE (252)..(252): Xaa at position 252 is Cys, Ala, Val, Gly, Ser, or Thr
  SITE (253)..(253): Xaa at position 253 is Phe, Tyr, Met, His, Ile, Leu, Val Ala, or Gly
  SITE (255)..(255): Xaa at position 255 is Ala, Gly, or Pro
  SITE (256)..(256): Xaa at position 256 is Ala, Gly, or Pro
  SITE (259)..(259): Xaa at position 259 is Ile, Ala, Val, Leu, or Gly
  SITE (261)..(261): Xaa at position 261 is Ala, Gly, or Pro
  SITE (265)..(265): Xaa at position 265 is Ile, Ala, Val, Leu, or Gly
  SITE (266)..(266): Xaa at position 266 is Phe, Tyr, Met, His, Ile, Leu, Val Ala, or Gly
  SITE (267)..(267): Xaa at position 267 is Ala, Gly, or Pro
  SITE (272)..(272): Xaa at position 272 is Val, Ala, Gly, Leu, or Ile
  SITE (281)..(281): Xaa at position 281 is Met, Ile, Leu, Val, Ala, or Gly
  SITE (294)..(294): Xaa at position 294 is Ile, Ala, Val, Leu, or Gly
  SITE (304)..(304): Xaa at position 304 is Ile, Ala, Val, Leu, or Gly
  SITE (308)..(308): Xaa at position 308 is Phe, Tyr, Met, His, Ile, Leu, Val Ala, or Gly
  SITE (310)..(310): Xaa at position 310 is Ile, Ala, Val, Leu, or Gly
  SITE (311)..(311): Xaa at position 311 is Ile, Ala, Val, Leu, or Gly
  SITE (316)..(316): Xaa at position 316 is Val, Ala, Gly, Leu, or Ile
  SITE (317)..(317): Xaa at position 317 is Leu, Ala, Val, Gly, or Ile
  SITE (330)..(330): Xaa at position 330 is Phe, Tyr, Met, His, Ile, Leu, Val Ala, or Gly
  SITE (353)..(353): Xaa at position 353 is Met, Ile, Leu, Val, Ala, or Gly
  SITE (360)..(360): Xaa at position 360 is Met, Ile, Leu, Val, Ala, or Gly
  SITE (362)..(362): Xaa at position 362 is Val, Ala, Gly, Leu, or Ile
  SITE (363)..(363): Xaa at position 363 is Leu, Ala, Val, Gly, or Ile
  SITE (364)..(364): Xaa at position 364 is Met, Ile, Leu, Val, Ala, or Gly
  SITE (365)..(365): Xaa at position 365 is Leu, Ala, Val, Gly, or Ile
  SITE (370)..(370): Xaa at position 370 is Val, Ala, Gly, Leu, or Ile
  SITE (371)..(371): Xaa at position 371 is Met, Ile, Leu, Val, Ala, or Gly
  SITE (372)..(372): Xaa at position 372 is Val, Ala, Gly, Leu, or Ile
  SITE (379)..(379): Xaa at position 379 is Ile, Ala, Val, Leu, or Gly
  SITE (383)..(383): Xaa at position 383 is Phe, Tyr, Met, His, Ile, Leu, Val Ala, or Gly
  SITE (393)..(393): Xaa at position 393 is Val, Ala, Gly, Leu, or Ile
  SITE (395)..(395): Xaa at position 395 is Ile, Ala, Val, Leu, or Gly
  SITE (398)..(398): Xaa at position 398 is Ala, Gly, or Pro
  SITE (401)..(401): Xaa at position 401 is Leu, Ala, Val, Gly, or Ile
  SITE (405)..(405): Xaa at position 405 is Phe, Tyr, Met, His, Ile, Leu, Val Ala, or Gly
  SITE (406)..(406): Xaa at position 406 is His, Phe, Tyr, Lys, Arg, Gly, Ser Thr, Ala, Val, Leu, Ile, Asn, Met, or Gln
  SITE (408)..(408): Xaa at position 408 is Trp, Tyr, Phe, Met, His, Ile, Leu Val, Ala, or Gly
  SITE (410)..(410): Xaa at position 410 is Cys, Ala, Val, Gly, Ser, or Thr
  SITE (412)..(412): Xaa at position 412 is Val, Ala, Gly, Leu, or Ile
MLRVRCLRGGSRGAEAVHYIGSRLGRTLTGWVQRTFQSTQAATASSRNSCAADDKATEPLPKDCPXSSYNEXDPLEEXXXGRXENXXXPPFTIEXKXNTYEKYWPFXQKQGGHYXPKDHLKKXVAEXEEXXNIXKTEGVTVRRPDPIDWSLKYKTPDFESTGXXSXXPRDXXXXVGNEXXEXPXXXRSRFFEYRXXRSIXKDXFHRGAKWTTAPKPTXADEXYNQDYPXHSVEDRHKLAAQGKFXTTEFEPXXDXXDFXRXGRDXXXQRSQXTNYLGIEWXRRHLAPDYRVHIXSFKDPNPMHXDATXNXXGPGIXXSNPDRPCHQIDLXKKAGWTIITPPTPIIPDDHPLWXSSKWLSXNXXXXDEKRXXXDANEVPXQKMXEKLGITTIKXNXRNXNSXGGGXXCXTXDXRRRGTLQSYLD

SEQ ID NO: 544 - protein, 418 aa, Homo sapiens
  SITE (102)..(102): Xaa at position 102 is Leu, Ala, Val, Gly, or Ile
  SITE (107)..(107): Xaa at position 107 is Val, Ala, Gly, Leu, or Ile
  SITE (109)..(109): Xaa at position 109 is Ala, Gly, or Pro
  SITE (203)..(203): Xaa at position 203 is Ala, Gly, or Pro
  SITE (226)..(226): Xaa at position 226 is Val, Ala, Gly, Leu, or Ile
  SITE (271)..(271): Xaa at position 271 is Met, Ile, Leu, Val, Ala, or Gly
  SITE (324)..(324): Xaa at position 324 is Leu, Ala, Val, Gly, or Ile
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQXRDEEXHXGLGELLRSLSNSTARNVTWKLGSRLYGPSSVSFADDFVRSSKQHYNCEHSKINFRDKRSALQSINEWAAQTTDGKLPEVTKDVERTDGALLVNXMFFKPHWDEKFHHKMVDNRGFMXTRSYTVGVMMMHRTGLYNYYDDEKEKLQIVEMPLAHKLSSLIILXPHHVEPLERLEKLLTKEQLKIWMGKMQKKAVAISLPKGVVEVTHDLQKHLAGXGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 545 - protein, 870 aa, Homo sapiens
  SITE (13)..(13): Xaa at position 13 is Val, Ala, Gly, Leu, or Ile
  SITE (16)..(16): Xaa at position 16 is Leu, Ala, Val, Gly, or Ile
  SITE (20)..(20): Xaa at position 20 is Phe, Tyr, Met, His, Ile, Leu, Val Ala, or Gly
  SITE (29)..(29): Xaa at position 29 is Leu, Ala, Val, Gly, or Ile
  SITE (34)..(34): Xaa at position 34 is Ile, Ala, Val, Leu, or Gly
  SITE (35)..(35): Xaa at position 35 is Ala, Gly, or Pro
  SITE (36)..(36): Xaa at position 36 is Val, Ala, Gly, Leu, or Ile
  SITE (37)..(37): Xaa at position 37 is Val, Ala, Gly, Leu, or Ile
  SITE (42)..(42): Xaa at position 42 is Ala, Gly, or Pro
  SITE (47)..(47): Xaa at position 47 is Val, Ala, Gly, Leu, or Ile
  SITE (48)..(48): Xaa at position 48 is Leu, Ala, Val, Gly, or Ile
  SITE (51)..(51): Xaa at position 51 is Phe, Tyr, Met, His, Ile, Leu, Val Ala, or Gly
  SITE (52)..(52): Xaa at position 52 is Val, Ala, Gly, Leu, or Ile
  SITE (56)..(56): Xaa at position 56 is Phe, Tyr, Met, His, Ile, Leu, Val Ala, or Gly
  SITE (57)..(57): Xaa at position 57 is Leu, Ala, Val, Gly, or Ile
  SITE (69)..(69): Xaa at position 69 is Leu, Ala, Val, Gly, or Ile
  SITE (71)..(71): Xaa at position 71 is Leu, Ala, Val, Gly, or Ile
  SITE (73)..(73): Xaa at position 73 is Leu, Ala, Val, Gly, or Ile
  SITE (74)..(74): Xaa at position 74 is Ile, Ala, Val, Leu, or Gly
  SITE (81)..(81): Xaa at position 81 is Ala, Gly, or Pro
  SITE (83)..(83): Xaa at position 83 is Phe, Tyr, Met, His, Ile, Leu, Val Ala, or Gly
  SITE (91)..(91): Xaa at position 91 is Phe, Tyr, Met, His, Ile, Leu, Val Ala, or Gly
  SITE (97)..(97): Xaa at position 97 is Val, Ala, Gly, Leu, or Ile
  SITE (120)..(120): Xaa at position 120 is Ile, Ala, Val, Leu, or Gly
  SITE (122)..(122): Xaa at position 122 is Leu, Ala, Val, Gly, or Ile
  SITE (124)..(124): Xaa at position 124 is Val, Ala, Gly, Leu, or Ile
  SITE (129)..(129): Xaa at position 129 is Val, Ala, Gly, Leu, or Ile
  SITE (132)..(132): Xaa at position 132 is Leu, Ala, Val, Gly, or Ile
  SITE (134)..(134): Xaa at position 134 is Leu, Ala, Val, Gly, or Ile
  SITE (135)..(135): Xaa at position 135 is Ile, Ala, Val, Leu, or Gly
  SITE (137)..(137): Xaa at position 137 is Leu, Ala, Val, Gly, or Ile
  SITE (140)..(140): Xaa at position 140 is Ile, Ala, Val, Leu, or Gly
  SITE (152)..(152): Xaa at position 152 is Ile, Ala, Val, Leu, or Gly
  SITE (156)..(156): Xaa at position 156 is Ile, Ala, Val, Leu, or Gly
  SITE (160)..(160): Xaa at position 160 is Ile, Ala, Val, Leu, or Gly
  SITE (164)..(164): Xaa at position 164 is Ile, Ala, Val, Leu, or Gly
  SITE (171)..(171): Xaa at position 171 is Ile, Ala, Val, Leu, or Gly
  SITE (172)..(172): Xaa at position 172 is Leu, Ala, Val, Gly, or Ile
  SITE (173)..(173): Xaa at position 173 is Ala, Gly, or Pro
  SITE (174)..(174): Xaa at position 174 is Val, Ala, Gly, Leu, or Ile
  SITE (177)..(177): Xaa at position 177 is Ala, Gly, or Pro
  SITE (186)..(186): Xaa at position 186 is Ala, Gly, or Pro
  SITE (190)..(190): Xaa at position 190 is Ala, Gly, or Pro
  SITE (193)..(193): Xaa at position 193 is Val, Ala, Gly, Leu, or Ile
  SITE (201)..(201): Xaa at position 201 is Ile, Ala, Val, Leu, or Gly
  SITE (203)..(203): Xaa at position 203 is Val, Ala, Gly, Leu, or Ile
  SITE (204)..(204): Xaa at position 204 is Ile, Ala, Val, Leu, or Gly
  SITE (207)..(207): Xaa at position 207 is Leu, Ala, Val, Gly, or Ile
  SITE (216)..(216): Xaa at position 216 is Ala, Gly, or Pro
  SITE (232)..(232): Xaa at position 232 is Ile, Ala, Val, Leu, or Gly
  SITE (234)..(234): Xaa at position 234 is Val, Ala, Gly, Leu, or Ile
  SITE (259)..(259): Xaa at position 259 is Phe, Tyr, Met, His, Ile, Leu, Val Ala, or Gly
  SITE (265)..(265): Xaa at position 265 is Tyr, Phe, Met, His, Ile, Leu, Val Ala, or Gly
  SITE (269)..(269): Xaa at position 269 is Ala, Gly, or Pro
  SITE (277)..(277): Xaa at position 277 is Leu, Ala, Val, Gly, or Ile
  SITE (281)..(281): Xaa at position 281 is Leu, Ala, Val, Gly, or Ile
  SITE (285)..(285): Xaa at position 285 is Leu, Ala, Val, Gly, or Ile
  SITE (289)..(289): Xaa at position 289 is Ile, Ala, Val, Leu, or Gly
  SITE (293)..(293): Xaa at position 293 is Leu, Ala, Val, Gly, or Ile
  SITE (300)..(300): Xaa at position 300 is Leu, Ala, Val, Gly, or Ile
  SITE (304)..(304): Xaa at position 304 is Leu, Ala, Val, Gly, or Ile
  SITE (305)..(305): Xaa at position 305 is Leu, Ala, Val, Gly, or Ile
  SITE (336)..(336): Xaa at position 336 is Phe, Tyr, Met, His, Ile, Leu, Val Ala, or Gly
  SITE (340)..(340): Xaa at position 340 is Phe, Tyr, Met, His, Ile, Leu, Val Ala, or Gly
  SITE (370)..(370): Xaa at position 370 is Phe, Tyr, Met, His, Ile, Leu, Val Ala, or Gly
  SITE (374)..(374): Xaa at position 374 is Leu, Ala, Val, Gly, or Ile
  SITE (384)..(384): Xaa at position 384 is Leu, Ala, Val, Gly, or Ile
  SITE (388)..(388): Xaa at position 388 is Ile, Ala, Val, Leu, or Gly
  SITE (392)..(392): Xaa at position 392 is Ile, Ala, Val, Leu, or Gly
  SITE (408)..(408): Xaa at position 408 is Ala, Gly, or Pro
  SITE (409)..(409): Xaa at position 409 is Phe, Tyr, Met, His, Ile, Leu, Val Ala, or Gly
  SITE (413)..(413): Xaa at position 413 is Val, Ala, Gly, Leu, or Ile
  SITE (417)..(417): Xaa at position 417 is Val, Ala, Gly, Leu, or Ile
  SITE (424)..(424): Xaa at position 424 is Cys, Ala, Val, Gly, Ser, or Thr
  SITE (427)..(427): Xaa at position 427 is Cys, Ala, Val, Gly, Ser, or Thr
  SITE (428)..(428): Xaa at position 428 is Val, Ala, Gly, Leu, or Ile
  SITE (431)..(431): Xaa at position 431 is Val, Ala, Gly, Leu, or Ile
  SITE (435)..(435): Xaa at position 435 is Leu, Ala, Val, Gly, or Ile
  SITE (439)..(439): Xaa at position 439 is Val, Ala, Gly, Leu, or Ile
  SITE (442)..(442): Xaa at position 442 is Cys, Ala, Val, Gly, Ser, or Thr
  SITE (452)..(452): Xaa at position 452 is Leu, Ala, Val, Gly, or Ile
  SITE (459)..(459): Xaa at position 459 is Ile, Ala, Val, Leu, or Gly
  SITE (460)..(460): Xaa at position 460 is Val, Ala, Gly, Leu, or Ile
  SITE (475)..(475): Xaa at position 475 is Ile, Ala, Val, Leu, or Gly
  SITE (479)..(479): Xaa at position 479 is Ile, Ala, Val, Leu, or Gly
  SITE (526)..(526): Xaa at position 526 is Leu, Ala, Val, Gly, or Ile
  SITE (528)..(528): Xaa at position 528 is Ile, Ala, Val, Leu, or Gly
  SITE (541)..(541): Xaa at position 541 is Tyr, Phe, Met, His, Ile, Leu, Val Ala, or Gly
  SITE (543)..(543): Xaa at position 543 is Phe, Tyr, Met, His, Ile, Leu, Val Ala, or Gly
  SITE (545)..(545): Xaa at position 545 is Leu, Ala, Val, Gly, or Ile
  SITE (550)..(550): Xaa at position 550 is Leu, Ala, Val, Gly, or Ile
  SITE (552)..(552): Xaa at position 552 is Trp, Tyr, Phe, Met, His, Ile, Leu Val, Ala, or Gly
  SITE (572)..(572): Xaa at position 572 is Ile, Ala, Val, Leu, or Gly
  SITE (586)..(586): Xaa at position 586 is Phe, Tyr, Met, His, Ile, Leu, Val Ala, or Gly
  SITE (587)..(587): Xaa at position 587 is Ala, Gly, or Pro
  SITE (588)..(588): Xaa at position 588 is Ile, Ala, Val, Leu, or Gly
  SITE (589)..(589): Xaa at position 589 is Phe, Tyr, Met, His, Ile, Leu, Val Ala, or Gly
  SITE (603)..(603): Xaa at position 603 is Ile, Ala, Val, Leu, or Gly
  SITE (605)..(605): Xaa at position 605 is Leu, Ala, Val, Gly, or Ile
  SITE (607)..(607): Xaa at position 607 is Cys, Ala, Val, Gly, Ser, or Thr
  SITE (613)..(613): Xaa at position 613 is Val, Ala, Gly, Leu, or Ile
  SITE (616)..(616): Xaa at position 616 is Trp, Tyr, Phe, Met, His, Ile, Leu Val, Ala, or Gly
  SITE (620)..(620): Xaa at position 620 is Phe, Tyr, Met, His, Ile, Leu, Val Ala, or Gly
  SITE (625)..(625): Xaa at position 625 is Val, Ala, Gly, Leu, or Ile
  SITE (664)..(664): Xaa at position 664 is Val, Ala, Gly, Leu, or Ile
  SITE (675)..(675): Xaa at position 675 is Met, Ile, Leu, Val, Ala, or Gly
  SITE (679)..(679): Xaa at position 679 is Ile, Ala, Val, Leu, or Gly
  SITE (683)..(683): Xaa at position 683 is Met, Ile, Leu, Val, Ala, or Gly
  SITE (691)..(691): Xaa at position 691 is Ile, Ala, Val, Leu, or Gly
  SITE (695)..(695): Xaa at position 695 is Leu, Ala, Val, Gly, or Ile
  SITE (699)..(699): Xaa at position 699 is Leu, Ala, Val, Gly, or Ile
  SITE (729)..(729): Xaa at position 729 is Leu, Ala, Val, Gly, or Ile
  SITE (732)..(732): Xaa at position 732 is Ala, Gly, or Pro
MGNRGMEELIPLXNKXQDAXSSIGQSCHXDLPQXXXXGGQSXGKSSXXENXXGRDXXPRGSGIVTRRPXIXQXXFSKTEHXEXLHCKSKKXTDFDEXRQEIEAETDRVTGTNKGISPVPXNXRXYSPHXLNXTXXDXPGXTKVPVGDQPPDXEYQXKDMXLQFXSRESSLXXXXTPXNMDLANSDXLKLXKEXDPQGLRTXGXXTKXDLMDEGTDXRDVLENKLLPLRRGYXGXVNRSQKDIEGKKDIRAALAAERKFXLSHPAXRHMXDRMGTPHXQKTXNQQXTNHXRESXPALRSKXQSQXXSLEKEVEEYKNFRPDDPTRKTKALLQMVQQXGVDXEKRIEGSGDQVDTLELSGGARINRIFHERXPFEXVKMEFDEKDXRREXSYAXKNIHGVRTGLFTPDLXXEAIXKKQXVKLKEPXLKXXDLXIQEXINTXRQXTSKLSSYPRXREETERXXTTYIREREGRTKDQXLLLXDIEQSYINTNHEDFIGFANAQQRSTQLNKKRAIPNQGEILVIRRGWXTXNNISLMKGGSKEXWXVXTAESXSXYKDEEEKEKKYMLPLDNLKXRDVEKGFMSNKHVXXXXNTEQRNVYKDLRQXEXAXDSQEDXDSXKASXLRAGXYPEKDQAENEDGAQENTFSMDPQLERQVETIRNLVDSYXAIINKSIRDLXPKTXMHLXINNTKAFXHHEXLAYXYSSADQSSLMEESADQAQRRDDMLRMYHAXKEXLNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 546 - protein, 306 aa, Homo sapiens
  SITE (36)..(36): Xaa at position 36 is Val, Ala, Gly, Leu, or Ile
  SITE (88)..(88): Xaa at position 88 is Val, Ala, Gly, Leu, or Ile
  SITE (95)..(95): Xaa at position 95 is Val, Ala, Gly, Leu, or Ile
  SITE (99)..(99): Xaa at position 99 is Leu, Ala, Val, Gly, or Ile
  SITE (105)..(105): Xaa at position 105 is Leu, Ala, Val, Gly, or Ile
  SITE (120)..(120): Xaa at position 120 is Phe, Tyr, Met, His, Ile, Leu, Val Ala, or Gly
  SITE (123)..(123): Xaa at position 123 is Ala, Gly, or Pro
  SITE (124)..(124): Xaa at position 124 is Val, Ala, Gly, Leu, or Ile
  SITE (143)..(143): Xaa at position 143 is His, Phe, Tyr, Lys, Arg, Gly, Ser Thr, Ala, Val, Leu, Ile, Asn, Met, or Gln
  SITE (147)..(147): Xaa at position 147 is Phe, Tyr, Met, His, Ile, Leu, Val Ala, or Gly
  SITE (160)..(160): Xaa at position 160 is Cys, Ala, Val, Gly, Ser, or Thr
  SITE (163)..(163): Xaa at position 163 is Ile, Ala, Val, Leu, or Gly
  SITE (181)..(181): Xaa at position 181 is Val, Ala, Gly, Leu, or Ile
  SITE (183)..(183): Xaa at position 183 is Ala, Gly, or Pro
  SITE (195)..(195): Xaa at position 195 is Tyr, Phe, Met, His, Ile, Leu, Val Ala, or Gly
  SITE (201)..(201): Xaa at position 201 is Phe, Tyr, Met, His, Ile, Leu, Val Ala, or Gly
  SITE (202)..(202): Xaa at position 202 is Leu, Ala, Val, Gly, or Ile
  SITE (203)..(203): Xaa at position 203 is Ala, Gly, or Pro
  SITE (205)..(205): Xaa at position 205 is Ile, Ala, Val, Leu, or Gly
  SITE (215)..(215): Xaa at position 215 is Tyr, Phe, Met, His, Ile, Leu, Val Ala, or Gly
  SITE (222)..(222): Xaa at position 222 is Leu, Ala, Val, Gly, or Ile
  SITE (228)..(228): Xaa at position 228 is Val, Ala, Gly, Leu, or Ile
  SITE (230)..(230): Xaa at position 230 is Phe, Tyr, Met, His, Ile, Leu, Val Ala, or Gly
  SITE (258)..(258): Xaa at position 258 is Leu, Ala, Val, Gly, or Ile
  SITE (263)..(263): Xaa at position 263 is Leu, Ala, Val, Gly, or Ile
  SITE (269)..(269): Xaa at position 269 is Leu, Ala, Val, Gly, or Ile
  SITE (283)..(283): Xaa at position 283 is Leu, Ala, Val, Gly, or Ile
MASPGCLWLLAVALLPWTCASRALQHLDPPAPLPLXIWHGMGDSCCNPLSMGAIKKMVEKKIPGIYVLSLEIGKTLMEDVENSFFLNXNSQVTTXCQAXAKDPKXQQGYNAMGFSQGGQXLRXXAQRCPSPPMINLISVGGQXQGVXGLPRCPGESSHIXDFXRKTLNAGAYSKVVQERLXQXEYWHDPIKEDVXRNHSIXXXDXNQERGINESXKKNLMAXKKFVMXKXLNDSIVDPVDSEWFGFYRSGQAKETIPXQETSXYTQDRXGLKEMDNAGQLVFXATEGDHLQLSEEWFYAHIIPFLG

SEQ ID NO: 547 - protein, 1020 aa, Homo sapiens
  SITE (42)..(42): Xaa at position 42 is His, Phe, Tyr, Lys, Arg, Gly, Ser Thr, Ala, Val, Leu, Ile, Asn, Met, or Gln
  SITE (44)..(44): Xaa at position 44 is Leu, Ala, Val, Gly, or Ile
  SITE (49)..(49): Xaa at position 49 is Leu, Ala, Val, Gly, or Ile
  SITE (66)..(66): Xaa at position 66 is Ala, Gly, or Pro
  SITE (102)..(102): Xaa at position 102 is Leu, Ala, Val, Gly, or Ile
  SITE (106)..(106): Xaa at position 106 is Ala, Gly, or Pro
  SITE (109)..(109): Xaa at position 109 is Cys, Ala, Val, Gly, Ser, or Thr
  SITE (133)..(133): Xaa at position 133 is Val, Ala, Gly, Leu, or Ile
  SITE (138)..(138): Xaa at position 138 is Val, Ala, Gly, Leu, or Ile
  SITE (169)..(169): Xaa at position 169 is Val, Ala, Gly, Leu, or Ile
  SITE (170)..(170): Xaa at position 170 is Ile, Ala, Val, Leu, or Gly
  SITE (183)..(183): Xaa at position 183 is Val, Ala, Gly, Leu, or Ile
  SITE (184)..(184): Xaa at position 184 is Val, Ala, Gly, Leu, or Ile
  SITE (188)..(188): Xaa at position 188 is Leu, Ala, Val, Gly, or Ile
  SITE (189)..(189): Xaa at position 189 is Val, Ala, Gly, Leu, or Ile
  SITE (199)..(199): Xaa at position 199 is Ala, Gly, or Pro
  SITE (201)..(201): Xaa at position 201 is Leu, Ala, Val, Gly, or Ile
  SITE (203)..(203): Xaa at position 203 is Ile, Ala, Val, Leu, or Gly
  SITE (209)..(209): Xaa at position 209 is Cys, Ala, Val, Gly, Ser, or Thr
  SITE (211)..(211): Xaa at position 211 is Val, Ala, Gly, Leu, or Ile
  SITE (241)..(241): Xaa at position 241 is Cys, Ala, Val, Gly, Ser, or Thr
  SITE (242)..(242): Xaa at position 242 is Phe, Tyr, Met, His, Ile, Leu, Val Ala, or Gly
  SITE (247)..(247): Xaa at position 247 is Cys, Ala, Val, Gly, Ser, or Thr
  SITE (252)..(252): Xaa at position 252 is Ala, Gly, or Pro
  SITE (255)..(255): Xaa at position 255 is Ile, Ala, Val, Leu, or Gly
  SITE (256)..(256): Xaa at position 256 is Val, Ala, Gly, Leu, or Ile
  SITE (272)..(272): Xaa at position 272 is Ala, Gly, or Pro
  SITE (286)..(286): Xaa at position 286 is Ile, Ala, Val, Leu, or Gly
  SITE (297)..(297): Xaa at position 297 is Ala, Gly, or Pro
  SITE (318)..(318): Xaa at position 318 is Ala, Gly, or Pro
  SITE (320)..(320): Xaa at position 320 is Ile, Ala, Val, Leu, or Gly
  SITE (321)..(321): Xaa at position 321 is Phe, Tyr, Met, His, Ile, Leu, Val Ala, or Gly
  SITE (325)..(325): Xaa at position 325 is Ile, Ala, Val, Leu, or Gly
  SITE (334)..(334): Xaa at position 334 is Leu, Ala, Val, Gly, or Ile
  SITE (340)..(340): Xaa at position 340 is Val, Ala, Gly, Leu, or Ile
  SITE (346)..(346): Xaa at position 346 is Ala, Gly, or Pro
  SITE (354)..(354): Xaa at position 354 is Cys, Ala, Val, Gly, Ser, or Thr
  SITE (362)..(362): Xaa at position 362 is Val, Ala, Gly, Leu, or Ile
  SITE (372)..(372): Xaa at position 372 is Cys, Ala, Val, Gly, Ser, or Thr
  SITE (379)..(379): Xaa at position 379 is Leu, Ala, Val, Gly, or Ile
  SITE (384)..(384): Xaa at position 384 is Met, Ile, Leu, Val, Ala, or Gly
  SITE (387)..(387): Xaa at position 387 is Ala, Gly, or Pro
  SITE (389)..(389): Xaa at position 389 is Met, Ile, Leu, Val, Ala, or Gly
  SITE (416)..(416): Xaa at position 416 is Trp, Tyr, Phe, Met, His, Ile, Leu Val, Ala, or Gly
  SITE (418)..(418): Xaa at position 418 is Ala, Gly, or Pro
  SITE (419)..(419): Xaa at position 419 is Leu, Ala, Val, Gly, or Ile
  SITE (422)..(422): Xaa at position 422 is Ile, Ala, Val, Leu, or Gly
  SITE (423)..(423): Xaa at position 423 is Ala, Gly, or Pro
  SITE (425)..(425): Xaa at position 425 is Leu, Ala, Val, Gly, or Ile
  SITE (426)..(426): Xaa at position 426 is Cys, Ala, Val, Gly, Ser, or Thr
  SITE (429)..(429): Xaa at position 429 is Ala, Gly, or Pro
  SITE (440)..(440): Xaa at position 440 is Val, Ala, Gly, Leu, or Ile
  SITE (453)..(453): Xaa at position 453 is Ala, Gly, or Pro
  SITE (454)..(454): Xaa at position 454 is Leu, Ala, Val, Gly, or Ile
  SITE (465)..(465): Xaa at position 465 is Val, Ala, Gly, Leu, or Ile
  SITE (488)..(488): Xaa at position 488 is Leu, Ala, Val, Gly, or Ile
  SITE (490)..(490): Xaa at position 490 is Ile, Ala, Val, Leu, or Gly
  SITE (491)..(491): Xaa at position 491 is His, Phe, Tyr, Lys, Arg, Gly, Ser Thr, Ala, Val, Leu, Ile, Asn, Met, or Gln
  SITE (500)..(500): Xaa at position 500 is His, Phe, Tyr, Lys, Arg, Gly, Ser Thr, Ala, Val, Leu, Ile, Asn, Met, or Gln
  SITE (501)..(501): Xaa at position 501 is Val, Ala, Gly, Leu, or Ile
  SITE (502)..(502): Xaa at position 502 is Leu, Ala, Val, Gly, or Ile
  SITE (503)..(503): Xaa at position 503 is Val, Ala, Gly, Leu, or Ile
  SITE (504)..(504): Xaa at position 504 is Met, Ile, Leu, Val, Ala, or Gly
  SITE (511)..(511): Xaa at position 511 is Ile, Ala, Val, Leu, or Gly
  SITE (519)..(519): Xaa at position 519 is Leu, Ala, Val, Gly, or Ile
  SITE (539)..(539): Xaa at position 539 is Tyr, Phe, Met, His, Ile, Leu, Val Ala, or Gly
  SITE (542)..(542): Xaa at position 542 is Leu, Ala, Val, Gly, or Ile
  SITE (552)..(552): Xaa at position 552 is Phe, Tyr, Met, His, Ile, Leu, Val Ala, or Gly
  SITE (553)..(553): Xaa at position 553 is Cys, Ala, Val, Gly, Ser, or Thr
  SITE (557)..(557): Xaa at position 557 is Leu, Ala, Val, Gly, or Ile
  SITE (580)..(580): Xaa at position 580 is Leu, Ala, Val, Gly, or Ile
  SITE (581)..(581): Xaa at position 581 is Cys, Ala, Val, Gly, Ser, or Thr
  SITE (582)..(582): Xaa at position 582 is Phe, Tyr, Met, His, Ile, Leu, Val Ala, or Gly
  SITE (583)..(583): Xaa at position 583 is Val, Ala, Gly, Leu, or Ile
  SITE (585)..(585): Xaa at position 585 is Leu, Ala, Val, Gly, or Ile
  SITE (588)..(588): Xaa at position 588 is Met, Ile, Leu, Val, Ala, or Gly
  SITE (594)..(594): Xaa at position 594 is Ala, Gly, or Pro
  SITE (596)..(596): Xaa at position 596 is Val, Ala, Gly, Leu, or Ile
  SITE (599)..(599): Xaa at position 599 is Ala, Gly, or Pro
  SITE (600)..(600): Xaa at position 600 is Val, Ala, Gly, Leu, or Ile
  SITE (603)..(603): Xaa at position 603 is Cys, Ala, Val, Gly, Ser, or Thr
  SITE (606)..(606): Xaa at position 606 is Ala, Gly, or Pro
  SITE (608)..(608): Xaa at position 608 is Ile, Ala, Val, Leu, or Gly
  SITE (611)..(611): Xaa at position 611 is Ile, Ala, Val, Leu, or Gly
  SITE (612)..(612): Xaa at position 612 is Met, Ile, Leu, Val, Ala, or Gly
  SITE (621)..(621): Xaa at position 621 is Ala, Gly, or Pro
  SITE (623)..(623): Xaa at position 623 is Ala, Gly, or Pro
  SITE (625)..(625): Xaa at position 625 is Ala, Gly, or Pro
  SITE (630)..(630): Xaa at position 630 is Ile, Ala, Val, Leu, or Gly
  SITE (631)..(631): Xaa at position 631 is Ile, Ala, Val, Leu, or Gly
  SITE (642)..(642): Xaa at position 642 is Ala, Gly, or Pro
  SITE (643)..(643): Xaa at position 643 is Ala, Gly, or Pro
  SITE (657)..(657): Xaa at position 657 is Ala, Gly, or Pro
  SITE (659)..(659): Xaa at position 659 is Ala, Gly, or Pro
  SITE (685)..(685): Xaa at position 685 is Ile, Ala, Val, Leu, or Gly
  SITE (686)..(686): Xaa at position 686 is Val, Ala, Gly, Leu, or Ile
  SITE (687)..(687): Xaa at position 687 is Phe, Tyr, Met, His, Ile, Leu, Val Ala, or Gly
  SITE (688)..(688): Xaa at position 688 is Ala, Gly, or Pro
  SITE (698)..(698): Xaa at position 698 is Ile, Ala, Val, Leu, or Gly
  SITE (699)..(699): Xaa at position 699 is Val, Ala, Gly, Leu, or Ile
  SITE (702)..(702): Xaa at position 702 is Cys, Ala, Val, Gly, Ser, or Thr
  SITE (709)..(709): Xaa at position 709 is Val, Ala, Gly, Leu, or Ile
  SITE (716)..(716): Xaa at position 716 is Val, Ala, Gly, Leu, or Ile
  SITE (721)..(721): Xaa at position 721 is Ala, Gly, or Pro
  SITE (722)..(722): Xaa at position 722 is Leu, Ala, Val, Gly, or Ile
  SITE (725)..(725): Xaa at position 725 is Ala, Gly, or Pro
  SITE (727)..(727): Xaa at position 727 is Ile, Ala, Val, Leu, or Gly
  SITE (729)..(729): Xaa at position 729 is Ile, Ala, Val, Leu, or Gly
  SITE (730)..(730): Xaa at position 730 is Ala, Gly, or Pro
  SITE (731)..(731): Xaa at position 731 is Met, Ile, Leu, Val, Ala, or Gly
  SITE (746)..(746): Xaa at position 746 is Ile, Ala, Val, Leu, or Gly
  SITE (747)..(747): Xaa at position 747 is Leu, Ala, Val, Gly, or Ile
  SITE (752)..(752): Xaa at position 752 is Phe, Tyr, Met, His, Ile, Leu, Val Ala, or Gly
  SITE (759)..(759): Xaa at position 759 is Val, Ala, Gly, Leu, or Ile
  SITE (764)..(764): Xaa at position 764 is Leu, Ala, Val, Gly, or Ile
  SITE (765)..(765): Xaa at position 765 is Ile, Ala, Val, Leu, or Gly
  SITE (775)..(775): Xaa at position 775 is Tyr, Phe, Met, His, Ile, Leu, Val Ala, or Gly
  SITE (777)..(777): Xaa at position 777 is Leu, Ala, Val, Gly, or Ile
  SITE (790)..(790): Xaa at position 790 is Phe, Tyr, Met, His, Ile, Leu, Val Ala, or Gly
  SITE (799)..(799): Xaa at position 799 is Leu, Ala, Val, Gly, or Ile
  SITE (807)..(807): Xaa at position 807 is Ile, Ala, Val, Leu, or Gly
  SITE (816)..(816): Xaa at position 816 is Ala, Gly, or Pro
  SITE (819)..(819): Xaa at position 819 is Leu, Ala, Val, Gly, or Ile
  SITE (841)..(841): Xaa at position 841 is Leu, Ala, Val, Gly, or Ile
  SITE (842)..(842): Xaa at position 842 is Val, Ala, Gly, Leu, or Ile
  SITE (846)..(846): Xaa at position 846 is Leu, Ala, Val, Gly, or Ile
  SITE (850)..(850): Xaa at position 850 is Ala, Gly, or Pro
  SITE (854)..(854): Xaa at position 854 is Ile, Ala, Val, Leu, or Gly
  SITE (866)..(866): Xaa at position 866 is Tyr, Phe, Met, His, Ile, Leu, Val Ala, or Gly
  SITE (869)..(869): Xaa at position 869 is Ile, Ala, Val, Leu, or Gly
  SITE (870)..(870): Xaa at position 870 is Leu, Ala, Val, Gly, or Ile
  SITE (875)..(875): Xaa at position 875 is Phe, Tyr, Met, His, Ile, Leu, Val Ala, or Gly
  SITE (880)..(880): Xaa at position 880 is Leu, Ala, Val, Gly, or Ile
  SITE (887)..(887): Xaa at position 887 is Trp, Tyr, Phe, Met, His, Ile, Leu Val, Ala, or Gly
  SITE (915)..(915): Xaa at position 915 is Cys, Ala, Val, Gly, Ser, or Thr
  SITE (918)..(918): Xaa at position 918 is Ala, Gly, or Pro
  SITE (919)..(919): Xaa at position 919 is Phe, Tyr, Met, His, Ile, Leu, Val Ala, or Gly
  SITE (920)..(920): Xaa at position 920 is Phe, Tyr, Met, His, Ile, Leu, Val Ala, or Gly
  SITE (921)..(921): Xaa at position 921 is Ala, Gly, or Pro
  SITE (923)..(923): Xaa at position 923 is Ile, Ala, Val, Leu, or Gly
  SITE (924)..(924): Xaa at position 924 is Val, Ala, Gly, Leu, or Ile
  SITE (925)..(925): Xaa at position 925 is Val, Ala, Gly, Leu, or Ile
  SITE (926)..(926): Xaa at position 926 is Val, Ala, Gly, Leu, or Ile
  SITE (931)..(931): Xaa at position 931 is Leu, Ala, Val, Gly, or Ile
  SITE (933)..(933): Xaa at position 933 is Ile, Ala, Val, Leu, or Gly
  SITE (934)..(934): Xaa at position 934 is Cys, Ala, Val, Gly, Ser, or Thr
  SITE (951)..(951): Xaa at position 951 is Leu, Ala, Val, Gly, or Ile
  SITE (955)..(955): Xaa at position 955 is Leu, Ala, Val, Gly, or Ile
  SITE (962)..(962): Xaa at position 962 is Ala, Gly, or Pro
  SITE (975)..(975): Xaa at position 975 is Leu, Ala, Val, Gly, or Ile
  SITE (977)..(977): Xaa at position 977 is Met, Ile, Leu, Val, Ala, or Gly
  SITE (988)..(988): Xaa at position 988 is Ala, Gly, or Pro
  SITE (995)..(995): Xaa at position 995 is Ile, Ala, Val, Leu, or Gly
  SITE (1006)..(1006): Xaa at position 1006 is Leu, Ala, Val, Gly, or Ile
  SITE (1020)..(1020): Xaa at position 1020 is Tyr, Phe, Met, His, Ile, Leu Val, Ala, or Gly
MGRGAGREYSPAATTAENGGGKKKQKEKELDELKKEVAMDDXKXSLDEXGRKYQVDLSKGLTNQRXQDVLARDGPNALTPPPTTPEWVKFCRQLFGGFSILXWIGXILXFLAYGIQAAMEDEPSNDNLYLGVXLAAVXIVTGCFSYYQEAKSSKIMDSFKNMVPQQALXXREGEKMQINAEEXXVGDXXEVKGGDRVPXDXRXISSHGXKXDNSSLTGESEPQTRSPEFTHENPLETRNIXXFSTNXVEGTXRGXXIATGDRTVMGRIATLXSGLEVGRTPIAMEXEHFIQLITGVXVFLGVSFFVLSLILGYSWLEXVXXLIGXIVANVPEGXLATVTXCLTLTXKRMARKNXLVKNLEAXETLGSTSTIXSDKTGTXTQNRXTVXHXWFDNQIHEADTTEDQSGATFDKRSPTXTXXSRXXGXXNRXVFKAGQENISXSKRDTAGDASESXXLKCIELSCGSXRKMRDRNPKVAEIPFNSTNKYQXSXXEREDSPQSXXXXXKGAPERXLDRCSTIXVQGKEIPLDKEMQDAFQNAXMEXGGLGERVLGXXQLNXPSGKFPRGFKFDTDELNFPTEKXXXXGXMSXIDPPRXAXPDXXGKXRSXGXKVXXVTGDHPITXKXIXKGVGXXSEGNETVEDIXXRLNIPMSQVNPREXKXCVVHGSDLKDMTSEQLDEILKNHTEXXXXRTSPQQKLIXXEGXQRQGAIXAVTGDGXNDSPXXKKXDXGXXXGISGSDVSKQAADMXXLDDNXASIVTGXEEGRXXFDNLKKSIAXTXTSNIPEITPFLLXIIANIPLPXGTVTILCXDLGTDMVPXISXAYEAAESDIMKRQPRNSQTDKXXNERXISMXYGQXGMIQALGGFFTXFVXXAENGXLPSRXLGIRLDXDDRTMNDLEDSYGQEWTYEQRKVVEFTXHTXXXXSXXXXQWADXIXXKTRRNSVFQQGMKNKIXIFGXLEETALXAFLSYCPGMGVAXRXYPLKVTWWFCXFPYSLLXFIYDEVRKLIXRRYPGGWVEKETYX

SEQ ID NO: 548 - protein, 207 aa, Homo sapiens
  SITE (9)..(9): Xaa at position 9 is Leu, Ala, Val, Gly, or Ile
  SITE (11)..(11): Xaa at position 11 is Val, Ala, Gly, Leu, or Ile
  SITE (12)..(12): Xaa at position 12 is Ile, Ala, Val, Leu, or Gly
  SITE (13)..(13): Xaa at position 13 is Ile, Ala, Val, Leu, or Gly
  SITE (14)..(14): Xaa at position 14 is Leu, Ala, Val, Gly, or Ile
  SITE (19)..(19): Xaa at position 19 is Val, Ala, Gly, Leu, or Ile
  SITE (24)..(24): Xaa at position 24 is Leu, Ala, Val, Gly, or Ile
  SITE (25)..(25): Xaa at position 25 is Met, Ile, Leu, Val, Ala, or Gly
  SITE (28)..(28): Xaa at position 28 is Tyr, Phe, Met, His, Ile, Leu, Val Ala, or Gly
  SITE (52)..(52): Xaa at position 52 is Val, Ala, Gly, Leu, or Ile
  SITE (57)..(57): Xaa at position 57 is Val, Ala, Gly, Leu, or Ile
  SITE (59)..(59): Xaa at position 59 is Met, Ile, Leu, Val, Ala, or Gly
  SITE (61)..(61): Xaa at position 61 is Ile, Ala, Val, Leu, or Gly
  SITE (65)..(65): Xaa at position 65 is Ala, Gly, or Pro
  SITE (78)..(78): Xaa at position 78 is Tyr, Phe, Met, His, Ile, Leu, Val Ala, or Gly
  SITE (83)..(83): Xaa at position 83 is Cys, Ala, Val, Gly, Ser, or Thr
  SITE (84)..(84): Xaa at position 84 is Cys, Ala, Val, Gly, Ser, or Thr
  SITE (85)..(85): Xaa at position 85 is Val, Ala, Gly, Leu, or Ile
  SITE (86)..(86): Xaa at position 86 is Leu, Ala, Val, Gly, or Ile
  SITE (87)..(87): Xaa at position 87 is Val, Ala, Gly, Leu, or Ile
  SITE (88)..(88): Xaa at position 88 is Phe, Tyr, Met, His, Ile, Leu, Val Ala, or Gly
  SITE (90)..(90): Xaa at position 90 is Val, Ala, Gly, Leu, or Ile
  SITE (99)..(99): Xaa at position 99 is Leu, Ala, Val, Gly, or Ile
  SITE (106)..(106): Xaa at position 106 is Phe, Tyr, Met, His, Ile, Leu, Val Ala, or Gly
  SITE (120)..(120): Xaa at position 120 is Phe, Tyr, Met, His, Ile, Leu, Val Ala, or Gly
  SITE (121)..(121): Xaa at position 121 is Val, Ala, Gly, Leu, or Ile
  SITE (122)..(122): Xaa at position 122 is Val, Ala, Gly, Leu, or Ile
  SITE (123)..(123): Xaa at position 123 is Leu, Ala, Val, Gly, or Ile
  SITE (134)..(134): Xaa at position 134 is Val, Ala, Gly, Leu, or Ile
  SITE (139)..(139): Xaa at position 139 is Ala, Gly, or Pro
  SITE (143)..(143): Xaa at position 143 is Cys, Ala, Val, Gly, Ser, or Thr
  SITE (156)..(156): Xaa at position 156 is Ala, Gly, or Pro
  SITE (162)..(162): Xaa at position 162 is Val, Ala, Gly, Leu, or Ile
  SITE (165)..(165): Xaa at position 165 is Ala, Gly, or Pro
  SITE (166)..(166): Xaa at position 166 is Phe, Tyr, Met, His, Ile, Leu, Val Ala, or Gly
  SITE (169)..(169): Xaa at position 169 is Ile, Ala, Val, Leu, or Gly
  SITE (170)..(170): Xaa at position 170 is Ala, Gly, or Pro
  SITE (173)..(173): Xaa at position 173 is Ala, Gly, or Pro
MTSRKKVLXKXXXXGDSGXGKTSXXNQXVNKKFSNQYKATIGADFLTKEVMXDDRLXTXQXWDTXGQERFQSLGVAFXRGADXXXXXXDXTAPNTFKTXDSWRDEXLIQASPRDPENFPXXXXGNKIDLENRQXATKRXQAWXYSKNNIPYFETSXKEAINXEQXXQTXXRNXLKQETEVELYNEFPEPIKLDKNDRAKASAESCSC

SEQ ID NO: 549 - protein, 221 aa, Homo sapiens
  SITE (13)..(13): Xaa at position 13 is Leu, Ala, Val, Gly, or Ile
  SITE (27)..(27): Xaa at position 27 is Tyr, Phe, Met, His, Ile, Leu, Val Ala, or Gly
  SITE (96)..(96): Xaa at position 96 is Leu, Ala, Val, Gly, or Ile
MSDGDYDYLIKFXALGDSGVGKTSVLXQYTDGKFNSKFITTVGIDFREKRVVYRASGPDGATGRGQRIHLQLWDTAGQERFRSLTTAFFRDAMGFXLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 550 - protein, 1647 aa, Homo sapiens
  SITE (1462)..(1462): Xaa at position 1462 is Met, Ile, Leu, Val, Ala, or Gly
  SITE (1465)..(1465): Xaa at position 1465 is Ile, Ala, Val, Leu, or Gly
  SITE (1466)..(1466): Xaa at position 1466 is Val, Ala, Gly, Leu, or Ile
  SITE (1469)..(1469): Xaa at position 1469 is Val, Ala, Gly, Leu, or Ile
  SITE (1501)..(1501): Xaa at position 1501 is Ile, Ala, Val, Leu, or Gly
  SITE (1507)..(1507): Xaa at position 1507 is Phe, Tyr, Met, His, Ile, Leu Val, Ala, or Gly
  SITE (1510)..(1510): Xaa at position 1510 is Ile, Ala, Val, Leu, or Gly
  SITE (1514)..(1514): Xaa at position 1514 is Ile, Ala, Val, Leu, or Gly
  SITE (1525)..(1525): Xaa at position 1525 is Leu, Ala, Val, Gly, or Ile
  SITE (1529)..(1529): Xaa at position 1529 is Val, Ala, Gly, Leu, or Ile
  SITE (1533)..(1533): Xaa at position 1533 is Cys, Ala, Val, Gly, Ser, or Thr
  SITE (1536)..(1536): Xaa at position 1536 is Ala, Gly, or Pro
  SITE (1553)..(1553): Xaa at position 1553 is Leu, Ala, Val, Gly, or Ile
  SITE (1557)..(1557): Xaa at position 1557 is Phe, Tyr, Met, His, Ile, Leu Val, Ala, or Gly
  SITE (1560)..(1560): Xaa at position 1560 is Val, Ala, Gly, Leu, or Ile
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKXKKXXDAXIKYKDSSSGRQLSEVFIQLPSRKELPEYYELXRKPVDXKKXKERXRNHKYRSLNDXEKDXMLLXQNXQTFNLEGSLIYEDSIVXQSVXTSXRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 551 - protein, 392 aa, Homo sapiens
  SITE (16)..(16): Xaa at position 16 is Ala, Gly, or Pro
  SITE (32)..(32): Xaa at position 32 is Val, Ala, Gly, Leu, or Ile
  SITE (34)..(34): Xaa at position 34 is Ala, Gly, or Pro
  SITE (53)..(53): Xaa at position 53 is Leu, Ala, Val, Gly, or Ile
  SITE (64)..(64): Xaa at position 64 is Val, Ala, Gly, Leu, or Ile
  SITE (73)..(73): Xaa at position 73 is Val, Ala, Gly, Leu, or Ile
  SITE (107)..(107): Xaa at position 107 is Ala, Gly, or Pro
  SITE (110)..(110): Xaa at position 110 is Val, Ala, Gly, Leu, or Ile
  SITE (113)..(113): Xaa at position 113 is Val, Ala, Gly, Leu, or Ile
  SITE (120)..(120): Xaa at position 120 is Ala, Gly, or Pro
  SITE (127)..(127): Xaa at position 127 is Ala, Gly, or Pro
  SITE (128)..(128): Xaa at position 128 is Val, Ala, Gly, Leu, or Ile
  SITE (130)..(130): Xaa at position 130 is Val, Ala, Gly, Leu, or Ile
  SITE (133)..(133): Xaa at position 133 is Val, Ala, Gly, Leu, or Ile
  SITE (139)..(139): Xaa at position 139 is Leu, Ala, Val, Gly, or Ile
  SITE (143)..(143): Xaa at position 143 is Ala, Gly, or Pro
  SITE (147)..(147): Xaa at position 147 is Val, Ala, Gly, Leu, or Ile
  SITE (148)..(148): Xaa at position 148 is Ala, Gly, or Pro
  SITE (152)..(152): Xaa at position 152 is Phe, Tyr, Met, His, Ile, Leu, Val Ala, or Gly
  SITE (153)..(153): Xaa at position 153 is Leu, Ala, Val, Gly, or Ile
  SITE (167)..(167): Xaa at position 167 is Ala, Gly, or Pro
  SITE (170)..(170): Xaa at position 170 is Cys, Ala, Val, Gly, Ser, or Thr
  SITE (173)..(173): Xaa at position 173 is Ala, Gly, or Pro
  SITE (211)..(211): Xaa at position 211 is Val, Ala, Gly, Leu, or Ile
  SITE (222)..(222): Xaa at position 222 is Ile, Ala, Val, Leu, or Gly
  SITE (243)..(243): Xaa at position 243 is Cys, Ala, Val, Gly, Ser, or Thr
  SITE (246)..(246): Xaa at position 246 is Val, Ala, Gly, Leu, or Ile
  SITE (255)..(255): Xaa at position 255 is Leu, Ala, Val, Gly, or Ile
  SITE (263)..(263): Xaa at position 263 is Leu, Ala, Val, Gly, or Ile
  SITE (266)..(266): Xaa at position 266 is Ala, Gly, or Pro
  SITE (278)..(278): Xaa at position 278 is Ala, Gly, or Pro
  SITE (280)..(280): Xaa at position 280 is His, Phe, Tyr, Lys, Arg, Gly, Ser Thr, Ala, Val, Leu, Ile, Asn, Met, or Gln
  SITE (281)..(281): Xaa at position 281 is Val, Ala, Gly, Leu, or Ile
  SITE (291)..(291): Xaa at position 291 is Ala, Gly, or Pro
  SITE (292)..(292): Xaa at position 292 is Ala, Gly, or Pro
  SITE (294)..(294): Xaa at position 294 is Ala, Gly, or Pro
  SITE (318)..(318): Xaa at position 318 is Tyr, Phe, Met, His, Ile, Leu, Val Ala, or Gly
  SITE (322)..(322): Xaa at position 322 is Cys, Ala, Val, Gly, Ser, or Thr
  SITE (328)..(328): Xaa at position 328 is Leu, Ala, Val, Gly, or Ile
  SITE (329)..(329): Xaa at position 329 is Val, Ala, Gly, Leu, or Ile
  SITE (332)..(332): Xaa at position 332 is Ala, Gly, or Pro
  SITE (351)..(351): Xaa at position 351 is Cys, Ala, Val, Gly, Ser, or Thr
  SITE (356)..(356): Xaa at position 356 is Leu, Ala, Val, Gly, or Ile
MAALRQPQVAELLAEXRRAFREEFGAEPELAXSXPGRVNLIGEHTDYNQGLVXPMALELMTVLXGSPRKDGLXSLLTTSEGADEPQRLQFPLPTAQRSLEPGTPRWXNYXKGXIQYYPAXPLPGFSXXVXSSXPLGGGXSSSXSLEXXTYTXXQQLCPDSGTIAARXQVXQQXEHSFAGMPCGIMDQFISLMGQKGHALLIDCRSLETSLXPLSDPKLAVLXTNSNVRHSLASSEYPVRRRQXEEXARALGKESXREVQLEEXEAXRDLVSKEGFRRXRXXVGEIRRTAQXXAXLRRGDYRAFGRLMVESHRSLRDDXEVSXPELDQXXEAXLAVPGVYGSRMTGGGFGGXTVTLXEASAAPHAMRHIQEHYGGTATFYLSQAADGAKVLCL

SEQ ID NO: 552 - protein, 486 aa, Homo sapiens
  SITE (124)..(124): Xaa at position 124 is Leu, Ala, Val, Gly, or Ile
  SITE (132)..(132): Xaa at position 132 is Phe, Tyr, Met, His, Ile, Leu, Val Ala, or Gly
  SITE (138)..(138): Xaa at position 138 is Leu, Ala, Val, Gly, or Ile
  SITE (142)..(142): Xaa at position 142 is Phe, Tyr, Met, His, Ile, Leu, Val Ala, or Gly
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYXINPQGKAXRSKVEXIAYXEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 553 - protein, 485 aa, Homo sapiens
  SITE (8)..(8): Xaa at position 8 is Val, Ala, Gly, Leu, or Ile
  SITE (27)..(27): Xaa at position 27 is Leu, Ala, Val, Gly, or Ile
  SITE (29)..(29): Xaa at position 29 is Ala, Gly, or Pro
  SITE (30)..(30): Xaa at position 30 is Leu, Ala, Val, Gly, or Ile
  SITE (33)..(33): Xaa at position 33 is Met, Ile, Leu, Val, Ala, or Gly
  SITE (34)..(34): Xaa at position 34 is Val, Ala, Gly, Leu, or Ile
  SITE (41)..(41): Xaa at position 41 is Ile, Ala, Val, Leu, or Gly
  SITE (45)..(45): Xaa at position 45 is Ile, Ala, Val, Leu, or Gly
  SITE (49)..(49): Xaa at position 49 is Leu, Ala, Val, Gly, or Ile
  SITE (56)..(56): Xaa at position 56 is Val, Ala, Gly, Leu, or Ile
  SITE (61)..(61): Xaa at position 61 is Val, Ala, Gly, Leu, or Ile
  SITE (64)..(64): Xaa at position 64 is Val, Ala, Gly, Leu, or Ile
  SITE (68)..(68): Xaa at position 68 is Ile, Ala, Val, Leu, or Gly
  SITE (71)..(71): Xaa at position 71 is Met, Ile, Leu, Val, Ala, or Gly
  SITE (75)..(75): Xaa at position 75 is Leu, Ala, Val, Gly, or Ile
  SITE (104)..(104): Xaa at position 104 is Val, Ala, Gly, Leu, or Ile
  SITE (105)..(105): Xaa at position 105 is Val, Ala, Gly, Leu, or Ile
  SITE (106)..(106): Xaa at position 106 is Leu, Ala, Val, Gly, or Ile
  SITE (107)..(107): Xaa at position 107 is Ile, Ala, Val, Leu, or Gly
  SITE (115)..(115): Xaa at position 115 is Phe, Tyr, Met, His, Ile, Leu, Val Ala, or Gly
  SITE (117)..(117): Xaa at position 117 is Leu, Ala, Val, Gly, or Ile
  SITE (119)..(119): Xaa at position 119 is Ile, Ala, Val, Leu, or Gly
  SITE (122)..(122): Xaa at position 122 is Leu, Ala, Val, Gly, or Ile
  SITE (123)..(123): Xaa at position 123 is Ile, Ala, Val, Leu, or Gly
  SITE (125)..(125): Xaa at position 125 is Ala, Gly, or Pro
  SITE (126)..(126): Xaa at position 126 is Ile, Ala, Val, Leu, or Gly
  SITE (127)..(127): Xaa at position 127 is Ala, Gly, or Pro
  SITE (128)..(128): Xaa at position 128 is Ala, Gly, or Pro
  SITE (131)..(131): Xaa at position 131 is Ala, Gly, or Pro
  SITE (132)..(132): Xaa at position 132 is Val, Ala, Gly, Leu, or Ile
  SITE (133)..(133): Xaa at position 133 is Ile, Ala, Val, Leu, or Gly
  SITE (134)..(134): Xaa at position 134 is Ile, Ala, Val, Leu, or Gly
  SITE (150)..(150): Xaa at position 150 is Leu, Ala, Val, Gly, or Ile
  SITE (151)..(151): Xaa at position 151 is Leu, Ala, Val, Gly, or Ile
  SITE (159)..(159): Xaa at position 159 is Leu, Ala, Val, Gly, or Ile
  SITE (160)..(160): Xaa at position 160 is Tyr, Phe, Met, His, Ile, Leu, Val Ala, or Gly
  SITE (173)..(173): Xaa at position 173 is Leu, Ala, Val, Gly, or Ile
  SITE (182)..(182): Xaa at position 182 is Phe, Tyr, Met, His, Ile, Leu, Val Ala, or Gly
  SITE (193)..(193): Xaa at position 193 is Val, Ala, Gly, Leu, or Ile
  SITE (196)..(196): Xaa at position 196 is Ala, Gly, or Pro
  SITE (197)..(197): Xaa at position 197 is Ala, Gly, or Pro
  SITE (214)..(214): Xaa at position 214 is Cys, Ala, Val, Gly, Ser, or Thr
  SITE (216)..(216): Xaa at position 216 is Ile, Ala, Val, Leu, or Gly
  SITE (225)..(225): Xaa at position 225 is Val, Ala, Gly, Leu, or Ile
  SITE (226)..(226): Xaa at position 226 is Cys, Ala, Val, Gly, Ser, or Thr
  SITE (229)..(229): Xaa at position 229 is Ile, Ala, Val, Leu, or Gly
  SITE (234)..(234): Xaa at position 234 is Tyr, Phe, Met, His, Ile, Leu, Val Ala, or Gly
  SITE (237)..(237): Xaa at position 237 is Cys, Ala, Val, Gly, Ser, or Thr
  SITE (247)..(247): Xaa at position 247 is Ile, Ala, Val, Leu, or Gly
  SITE (248)..(248): Xaa at position 248 is Leu, Ala, Val, Gly, or Ile
  SITE (249)..(249): Xaa at position 249 is Cys, Ala, Val, Gly, Ser, or Thr
  SITE (257)..(257): Xaa at position 257 is Ile, Ala, Val, Leu, or Gly
  SITE (261)..(261): Xaa at position 261 is Ile, Ala, Val, Leu, or Gly
  SITE (282)..(282): Xaa at position 282 is Ile, Ala, Val, Leu, or Gly
  SITE (288)..(288): Xaa at position 288 is Phe, Tyr, Met, His, Ile, Leu, Val Ala, or Gly
  SITE (291)..(291): Xaa at position 291 is Ile, Ala, Val, Leu, or Gly
  SITE (294)..(294): Xaa at position 294 is Leu, Ala, Val, Gly, or Ile
  SITE (313)..(313): Xaa at position 313 is Ile, Ala, Val, Leu, or Gly
  SITE (314)..(314): Xaa at position 314 is Ala, Gly, or Pro
  SITE (317)..(317): Xaa at position 317 is Val, Ala, Gly, Leu, or Ile
  SITE (318)..(318): Xaa at position 318 is Leu, Ala, Val, Gly, or Ile
  SITE (327)..(327): Xaa at position 327 is Val, Ala, Gly, Leu, or Ile
  SITE (328)..(328): Xaa at position 328 is Met, Ile, Leu, Val, Ala, or Gly
  SITE (332)..(332): Xaa at position 332 is Ile, Ala, Val, Leu, or Gly
  SITE (336)..(336): Xaa at position 336 is Ile, Ala, Val, Leu, or Gly
  SITE (337)..(337): Xaa at position 337 is Leu, Ala, Val, Gly, or Ile
  SITE (339)..(339): Xaa at position 339 is Ile, Ala, Val, Leu, or Gly
  SITE (348)..(348): Xaa at position 348 is Ala, Gly, or Pro
  SITE (359)..(359): Xaa at position 359 is Leu, Ala, Val, Gly, or Ile
  SITE (360)..(360): Xaa at position 360 is Ala, Gly, or Pro
  SITE (361)..(361): Xaa at position 361 is Leu, Ala, Val, Gly, or Ile
  SITE (362)..(362): Xaa at position 362 is Tyr, Phe, Met, His, Ile, Leu, Val Ala, or Gly
  SITE (363)..(363): Xaa at position 363 is Val, Ala, Gly, Leu, or Ile
  SITE (364)..(364): Xaa at position 364 is Phe, Tyr, Met, His, Ile, Leu, Val Ala, or Gly
  SITE (374)..(374): Xaa at position 374 is Met, Ile, Leu, Val, Ala, or Gly
  SITE (388)..(388): Xaa at position 388 is Val, Ala, Gly, Leu, or Ile
  SITE (410)..(410): Xaa at position 410 is Tyr, Phe, Met, His, Ile, Leu, Val Ala, or Gly
  SITE (419)..(419): Xaa at position 419 is Phe, Tyr, Met, His, Ile, Leu, Val Ala, or Gly
MELEVRRXRQAFLSGRSRPLRFRLQQXEXXRRXXQEREKDXLTAXAADXCKSEFNXYSQEXITXLGEXDFXLENXPEWVTAKPVKKNVLTMLDEAYIQPQPLGXXXXIGAWNYPXVXTXQPXXGXXXXGNXXXXKPSELSENTAKILAKXXPQYLDQDXXIVINGGVEETTEXLKQRFDHIXYTGNTAVGKIXMEXXAKHLTPVTLELGGKSPXYXDKDCDLDIXXRRXTWGKXMNXGQTCIAPDYXXXEASLQNQXVWKXKETVKEFYGENIKESPDYERXINLRHXKRXLSXLEGQKIAFGGETDEATRYXXPTXXTDVDPKTKXXQEEXFGPXXPXVPVKNVDEXINFINEREKPXXXXXXSHNHKLIKRXIDETSSGGVTGNDXIMHFTLNSFPFGGVGSSGMGAXHGKHSFDTXSHQRPCLLKSLKREGANKLRYPPNSQSKVDWGKFFLLKRFNKEKLGLLLLTFLGIVAAVLVKAEYY

SEQ ID NO: 554 - protein, 352 aa, Homo sapiens
  SITE (187)..(187): Xaa at position 187 is Tyr, Phe, Met, His, Ile, Leu, Val Ala, or Gly
MDYQVSSPIYDINYYTSEPCQKINVKQIAARLLPPLYSLVFIFGFVGNMLVILILINCKRLKSMTDIYLLNLAISDLFFLLTVPFWAHYAAAQWDFGNTMCQLLTGLYFIGFFSGIFFIILLTIDRYLAVVHAVFALKARTVTFGVVTSVITWVVAVFASLPGIIFTRSQKEGLHYTCSSHFPYSQXQFWKNFQTLKIVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 555 - protein, 502 aa, Homo sapiens
  SITE (25)..(25): Xaa at position 25 is Ala, Gly, or Pro
  SITE (26)..(26): Xaa at position 26 is Leu, Ala, Val, Gly, or Ile
  SITE (27)..(27): Xaa at position 27 is Leu, Ala, Val, Gly, or Ile
  SITE (28)..(28): Xaa at position 28 is Leu, Ala, Val, Gly, or Ile
  SITE (29)..(29): Xaa at position 29 is Leu, Ala, Val, Gly, or Ile
  SITE (30)..(30): Xaa at position 30 is Ala, Gly, or Pro
  SITE (58)..(58): Xaa at position 58 is Leu, Ala, Val, Gly, or Ile
  SITE (60)..(60): Xaa at position 60 is Phe, Tyr, Met, His, Ile, Leu, Val Ala, or Gly
  SITE (63)..(63): Xaa at position 63 is Ala, Gly, or Pro
  SITE (64)..(64): Xaa at position 64 is Phe, Tyr, Met, His, Ile, Leu, Val Ala, or Gly
  SITE (67)..(67): Xaa at position 67 is Val, Ala, Gly, Leu, or Ile
  SITE (75)..(75): Xaa at position 75 is Ala, Gly, or Pro
  SITE (77)..(77): Xaa at position 77 is Leu, Ala, Val, Gly, or Ile
  SITE (81)..(81): Xaa at position 81 is Leu, Ala, Val, Gly, or Ile
  SITE (88)..(88): Xaa at position 88 is Met, Ile, Leu, Val, Ala, or Gly
  SITE (107)..(107): Xaa at position 107 is Leu, Ala, Val, Gly, or Ile
  SITE (111)..(111): Xaa at position 111 is Leu, Ala, Val, Gly, or Ile
  SITE (120)..(120): Xaa at position 120 is Ile, Ala, Val, Leu, or Gly
  SITE (121)..(121): Xaa at position 121 is Ile, Ala, Val, Leu, or Gly
  SITE (126)..(126): Xaa at position 126 is Val, Ala, Gly, Leu, or Ile
  SITE (131)..(131): Xaa at position 131 is Val, Ala, Gly, Leu, or Ile
  SITE (132)..(132): Xaa at position 132 is Tyr, Phe, Met, His, Ile, Leu, Val Ala, or Gly
  SITE (152)..(152): Xaa at position 152 is Ile, Ala, Val, Leu, or Gly
  SITE (155)..(155): Xaa at position 155 is Ile, Ala, Val, Leu, or Gly
  SITE (159)..(159): Xaa at position 159 is Val, Ala, Gly, Leu, or Ile
  SITE (162)..(162): Xaa at position 162 is Phe, Tyr, Met, His, Ile, Leu, Val Ala, or Gly
  SITE (171)..(171): Xaa at position 171 is Phe, Tyr, Met, His, Ile, Leu, Val Ala, or Gly
  SITE (172)..(172): Xaa at position 172 is Phe, Tyr, Met, His, Ile, Leu, Val Ala, or Gly
  SITE (173)..(173): Xaa at position 173 is Leu, Ala, Val, Gly, or Ile
  SITE (174)..(174): Xaa at position 174 is Tyr, Phe, Met, His, Ile, Leu, Val Ala, or Gly
  SITE (175)..(175): Xaa at position 175 is Val, Ala, Gly, Leu, or Ile
  SITE (176)..(176): Xaa at position 176 is Ala, Gly, or Pro
  SITE (177)..(177): Xaa at position 177 is Phe, Tyr, Met, His, Ile, Leu, Val Ala, or Gly
  SITE (193)..(193): Xaa at position 193 is Phe, Tyr, Met, His, Ile, Leu, Val Ala, or Gly
  SITE (194)..(194): Xaa at position 194 is Cys, Ala, Val, Gly, Ser, or Thr
  SITE (207)..(207): Xaa at position 207 is Ile, Ala, Val, Leu, or Gly
  SITE (232)..(232): Xaa at position 232 is Ala, Gly, or Pro
  SITE (236)..(236): Xaa at position 236 is Leu, Ala, Val, Gly, or Ile
  SITE (240)..(240): Xaa at position 240 is Tyr, Phe, Met, His, Ile, Leu, Val Ala, or Gly
  SITE (250)..(250): Xaa at position 250 is Val, Ala, Gly, Leu, or Ile
  SITE (253)..(253): Xaa at position 253 is Val, Ala, Gly, Leu, or Ile
  SITE (257)..(257): Xaa at position 257 is Leu, Ala, Val, Gly, or Ile
  SITE (267)..(267): Xaa at position 267 is Leu, Ala, Val, Gly, or Ile
  SITE (276)..(276): Xaa at position 276 is Ile, Ala, Val, Leu, or Gly
  SITE (278)..(278): Xaa at position 278 is Phe, Tyr, Met, His, Ile, Leu, Val Ala, or Gly
  SITE (285)..(285): Xaa at position 285 is Leu, Ala, Val, Gly, or Ile
  SITE (296)..(296): Xaa at position 296 is Val, Ala, Gly, Leu, or Ile
  SITE (311)..(311): Xaa at position 311 is Ala, Gly, or Pro
  SITE (313)..(313): Xaa at position 313 is Val, Ala, Gly, Leu, or Ile
  SITE (318)..(318): Xaa at position 318 is Leu, Ala, Val, Gly, or Ile
  SITE (322)..(322): Xaa at position 322 is Ile, Ala, Val, Leu, or Gly
  SITE (323)..(323): Xaa at position 323 is Leu, Ala, Val, Gly, or Ile
  SITE (348)..(348): Xaa at position 348 is Leu, Ala, Val, Gly, or Ile
  SITE (351)..(351): Xaa at position 351 is Ala, Gly, or Pro
  SITE (376)..(376): Xaa at position 376 is Met, Ile, Leu, Val, Ala, or Gly
  SITE (379)..(379): Xaa at position 379 is Val, Ala, Gly, Leu, or Ile
  SITE (386)..(386): Xaa at position 386 is Leu, Ala, Val, Gly, or Ile
  SITE (408)..(408): Xaa at position 408 is Phe, Tyr, Met, His, Ile, Leu, Val Ala, or Gly
  SITE (411)..(411): Xaa at position 411 is Leu, Ala, Val, Gly, or Ile
  SITE (438)..(438): Xaa at position 438 is Leu, Ala, Val, Gly, or Ile
  SITE (464)..(464): Xaa at position 464 is Leu, Ala, Val, Gly, or Ile
MSCPVPACCALLLVLGLCRARPRNXXXXXXDDGGFESGAYNNSAIATPHLDALARRSXLXRNXXTSXSSCSPSRXSXLTGXPQHQNGXYGLHQDVHHFNSFDKVRSXPLLXSQAGVRTGXXGKKHXGPETXXPFDFAYTEENGSVLQVGRNXTRXKLLXRKXLQTQDDRPXXXXXXXHDPHRCGHSQPQYGTXXEKFGNGESGMGRXPDWTPQAYDPLDVLVPYFVPNTPAXRADXAAQXTTVGRMDQGXGLXLQEXRDAGVLNDTXVIFTSDNGXPXPSGRTNXYWPGTAEPLLXSSPEHPKRWGQVSEXYXSLLDXTPTXXDWFSIPYPSYAIFGSKTIHLTGRSXLPXLEAEPLWATVFGSQSHHEVTMSYPXRSXQHRHFRXVHNLNFKMPFPIDQDFYVSPTXQDXLNRTTAGQPTGWYKDLRHYYYRARWEXYDRSRDPHETQNLATDPRFAQLLEMXRDQLAKWQWETHDPWVCAPDGVLEEKLSPQCQPLHNEL

SEQ ID NO: 556 - protein, 589 aa, Homo sapiens
  SITE (61)..(61): Xaa at position 61 is Met, Ile, Leu, Val, Ala, or Gly
  SITE (163)..(163): Xaa at position 163 is Leu, Ala, Val, Gly, or Ile
  SITE (292)..(292): Xaa at position 292 is Leu, Ala, Val, Gly, or Ile
MLHLHHSCLCFRSWLPAMLAVLLSLAPSASSDISASRPNILLLMADDLGIGDIGCYGNNTXRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPXHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFXLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 557 - protein, 650 aa, Homo sapiens
  SITE (395)..(395): Xaa at position 395 is Phe, Tyr, Met, His, Ile, Leu, Val Ala, or Gly
  SITE (398)..(398): Xaa at position 398 is Ala, Gly, or Pro
  SITE (409)..(409): Xaa at position 409 is Val, Ala, Gly, Leu, or Ile
  SITE (413)..(413): Xaa at position 413 is Leu, Ala, Val, Gly, or Ile
  SITE (467)..(467): Xaa at position 467 is Leu, Ala, Val, Gly, or Ile
  SITE (477)..(477): Xaa at position 477 is Leu, Ala, Val, Gly, or Ile
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGXLAXLQADPPQAERXLLAXRRYLRAEQKEQRHTLRHYQHVAAVDPEKAQQMRFQVHTHLQVIEERVNQSLGLXDQNPHLAQEXRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 558 - protein, 676 aa, Homo sapiens
  SITE (379)..(379): Xaa at position 379 is Trp, Tyr, Phe, Met, His, Ile, Leu Val, Ala, or Gly
  SITE (392)..(392): Xaa at position 392 is Trp, Tyr, Phe, Met, His, Ile, Leu Val, Ala, or Gly
  SITE (394)..(394): Xaa at position 394 is Ile, Ala, Val, Leu, or Gly
  SITE (396)..(396): Xaa at position 396 is Ile, Ala, Val, Leu, or Gly
MAAASSPPRAERKRWGWGRLPGARRGSAGLAKKCPFSLELAEGGPAGGALYAPIAPGAPGPAPPASPAAPAAPPVASDLGPRPPVSLDPRVSIYSTRRPVLARTHVQGRVYNFLERPTGWKCFVYHFAVFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAXRCYAAENPDSSTXKXYXRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 559 - protein, 687 aa, Homo sapiens
  SITE (547)..(547): Xaa at position 547 is Val, Ala, Gly, Leu, or Ile
  SITE (558)..(558): Xaa at position 558 is Leu, Ala, Val, Gly, or Ile
  SITE (559)..(559): Xaa at position 559 is Ala, Gly, or Pro
  SITE (567)..(567): Xaa at position 567 is Val, Ala, Gly, Leu, or Ile
  SITE (579)..(579): Xaa at position 579 is Tyr, Phe, Met, His, Ile, Leu, Val Ala, or Gly
  SITE (582)..(582): Xaa at position 582 is Val, Ala, Gly, Leu, or Ile
  SITE (594)..(594): Xaa at position 594 is Val, Ala, Gly, Leu, or Ile
  SITE (599)..(599): Xaa at position 599 is Leu, Ala, Val, Gly, or Ile
  SITE (618)..(618): Xaa at position 618 is Leu, Ala, Val, Gly, or Ile
  SITE (635)..(635): Xaa at position 635 is Leu, Ala, Val, Gly, or Ile
  SITE (641)..(641): Xaa at position 641 is Leu, Ala, Val, Gly, or Ile
  SITE (644)..(644): Xaa at position 644 is Ala, Gly, or Pro
  SITE (648)..(648): Xaa at position 648 is Phe, Tyr, Met, His, Ile, Leu, Val Ala, or Gly
  SITE (658)..(658): Xaa at position 658 is Val, Ala, Gly, Leu, or Ile
  SITE (668)..(668): Xaa at position 668 is Val, Ala, Gly, Leu, or Ile
  SITE (673)..(673): Xaa at position 673 is Met, Ile, Leu, Val, Ala, or Gly
  SITE (676)..(676): Xaa at position 676 is Ala, Gly, or Pro
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRXEHFMNHSITTXXKDTPLEEXVKVVTSTDVTEXPLXESTESQILVGIXQRAQXVQALQAEPPSRAPGHQQCXQDILARGCPTEPVTLTXFSETTXHQXQNLXKLLNLQSLFXTSRGRAVGCXSWVEXKKXISNLTNPPAPK

SEQ ID NO: 560 - protein, 740 aa, Homo sapiens
  SITE (85)..(85): Xaa at position 85 is Val, Ala, Gly, Leu, or Ile
  SITE (93)..(93): Xaa at position 93 is Ala, Gly, or Pro
  SITE (98)..(98): Xaa at position 98 is Ala, Gly, or Pro
  SITE (121)..(121): Xaa at position 121 is Ile, Ala, Val, Leu, or Gly
  SITE (129)..(129): Xaa at position 129 is Phe, Tyr, Met, His, Ile, Leu, Val Ala, or Gly
  SITE (131)..(131): Xaa at position 131 is Val, Ala, Gly, Leu, or Ile
  SITE (146)..(146): Xaa at position 146 is Ile, Ala, Val, Leu, or Gly
  SITE (155)..(155): Xaa at position 155 is Leu, Ala, Val, Gly, or Ile
  SITE (165)..(165): Xaa at position 165 is Phe, Tyr, Met, His, Ile, Leu, Val Ala, or Gly
  SITE (170)..(170): Xaa at position 170 is Val, Ala, Gly, Leu, or Ile
  SITE (173)..(173): Xaa at position 173 is Tyr, Phe, Met, His, Ile, Leu, Val Ala, or Gly
  SITE (174)..(174): Xaa at position 174 is Leu, Ala, Val, Gly, or Ile
  SITE (175)..(175): Xaa at position 175 is Ala, Gly, or Pro
  SITE (177)..(177): Xaa at position 177 is Leu, Ala, Val, Gly, or Ile
  SITE (178)..(178): Xaa at position 178 is Ala, Gly, or Pro
  SITE (180)..(180): Xaa at position 180 is Ala, Gly, or Pro
  SITE (181)..(181): Xaa at position 181 is Leu, Ala, Val, Gly, or Ile
  SITE (184)..(184): Xaa at position 184 is Leu, Ala, Val, Gly, or Ile
  SITE (187)..(187): Xaa at position 187 is Leu, Ala, Val, Gly, or Ile
  SITE (189)..(189): Xaa at position 189 is Ile, Ala, Val, Leu, or Gly
  SITE (190)..(190): Xaa at position 190 is Ile, Ala, Val, Leu, or Gly
  SITE (191)..(191): Xaa at position 191 is Tyr, Phe, Met, His, Ile, Leu, Val Ala, or Gly
  SITE (194)..(194): Xaa at position 194 is Leu, Ala, Val, Gly, or Ile
  SITE (199)..(199): Xaa at position 199 is Ile, Ala, Val, Leu, or Gly
  SITE (201)..(201): Xaa at position 201 is Leu, Ala, Val, Gly, or Ile
  SITE (206)..(206): Xaa at position 206 is His, Phe, Tyr, Lys, Arg, Gly, Ser Thr, Ala, Val, Leu, Ile, Asn, Met, or Gln
  SITE (207)..(207): Xaa at position 207 is Ile, Ala, Val, Leu, or Gly
  SITE (209)..(209): Xaa at position 209 is Leu, Ala, Val, Gly, or Ile
  SITE (212)..(212): Xaa at position 212 is Phe, Tyr, Met, His, Ile, Leu, Val Ala, or Gly
  SITE (225)..(225): Xaa at position 225 is Ala, Gly, or Pro
  SITE (236)..(236): Xaa at position 236 is Ala, Gly, or Pro
  SITE (245)..(245): Xaa at position 245 is His, Phe, Tyr, Lys, Arg, Gly, Ser Thr, Ala, Val, Leu, Ile, Asn, Met, or Gln
  SITE (249)..(249): Xaa at position 249 is Ala, Gly, or Pro
  SITE (251)..(251): Xaa at position 251 is Trp, Tyr, Phe, Met, His, Ile, Leu Val, Ala, or Gly
  SITE (252)..(252): Xaa at position 252 is Trp, Tyr, Phe, Met, His, Ile, Leu Val, Ala, or Gly
  SITE (254)..(254): Xaa at position 254 is Phe, Tyr, Met, His, Ile, Leu, Val Ala, or Gly
  SITE (256)..(256): Xaa at position 256 is Val, Ala, Gly, Leu, or Ile
  SITE (257)..(257): Xaa at position 257 is Leu, Ala, Val, Gly, or Ile
  SITE (258)..(258): Xaa at position 258 is Met, Ile, Leu, Val, Ala, or Gly
  SITE (261)..(261): Xaa at position 261 is Met, Ile, Leu, Val, Ala, or Gly
  SITE (268)..(268): Xaa at position 268 is Phe, Tyr, Met, His, Ile, Leu, Val Ala, or Gly
  SITE (280)..(280): Xaa at position 280 is Ile, Ala, Val, Leu, or Gly
  SITE (281)..(281): Xaa at position 281 is Leu, Ala, Val, Gly, or Ile
  SITE (285)..(285): Xaa at position 285 is Leu, Ala, Val, Gly, or Ile
  SITE (290)..(290): Xaa at position 290 is Phe, Tyr, Met, His, Ile, Leu, Val Ala, or Gly
  SITE (295)..(295): Xaa at position 295 is Ala, Gly, or Pro
  SITE (298)..(298): Xaa at position 298 is Leu, Ala, Val, Gly, or Ile
  SITE (299)..(299): Xaa at position 299 is Leu, Ala, Val, Gly, or Ile
  SITE (302)..(302): Xaa at position 302 is Leu, Ala, Val, Gly, or Ile
  SITE (308)..(308): Xaa at position 308 is Ala, Gly, or Pro
  SITE (318)..(318): Xaa at position 318 is Val, Ala, Gly, Leu, or Ile
  SITE (321)..(321): Xaa at position 321 is Ile, Ala, Val, Leu, or Gly
  SITE (327)..(327): Xaa at position 327 is Phe, Tyr, Met, His, Ile, Leu, Val Ala, or Gly
  SITE (335)..(335): Xaa at position 335 is Leu, Ala, Val, Gly, or Ile
  SITE (347)..(347): Xaa at position 347 is Ala, Gly, or Pro
  SITE (439)..(439): Xaa at position 439 is Cys, Ala, Val, Gly, Ser, or Thr
  SITE (450)..(450): Xaa at position 450 is Val, Ala, Gly, Leu, or Ile
  SITE (453)..(453): Xaa at position 453 is Ile, Ala, Val, Leu, or Gly
  SITE (464)..(464): Xaa at position 464 is Ile, Ala, Val, Leu, or Gly
  SITE (466)..(466): Xaa at position 466 is Ile, Ala, Val, Leu, or Gly
  SITE (467)..(467): Xaa at position 467 is Leu, Ala, Val, Gly, or Ile
  SITE (470)..(470): Xaa at position 470 is Tyr, Phe, Met, His, Ile, Leu, Val Ala, or Gly
  SITE (476)..(476): Xaa at position 476 is Ile, Ala, Val, Leu, or Gly
  SITE (491)..(491): Xaa at position 491 is Val, Ala, Gly, Leu, or Ile
  SITE (492)..(492): Xaa at position 492 is Val, Ala, Gly, Leu, or Ile
  SITE (501)..(501): Xaa at position 501 is Leu, Ala, Val, Gly, or Ile
  SITE (502)..(502): Xaa at position 502 is Leu, Ala, Val, Gly, or Ile
  SITE (505)..(505): Xaa at position 505 is Ile, Ala, Val, Leu, or Gly
  SITE (506)..(506): Xaa at position 506 is Leu, Ala, Val, Gly, or Ile
  SITE (516)..(516): Xaa at position 516 is Ala, Gly, or Pro
  SITE (520)..(520): Xaa at position 520 is Leu, Ala, Val, Gly, or Ile
  SITE (523)..(523): Xaa at position 523 is Ile, Ala, Val, Leu, or Gly
  SITE (527)..(527): Xaa at position 527 is Val, Ala, Gly, Leu, or Ile
  SITE (530)..(530): Xaa at position 530 is Leu, Ala, Val, Gly, or Ile
  SITE (535)..(535): Xaa at position 535 is Val, Ala, Gly, Leu, or Ile
  SITE (536)..(536): Xaa at position 536 is Val, Ala, Gly, Leu, or Ile
  SITE (537)..(537): Xaa at position 537 is His, Phe, Tyr, Lys, Arg, Gly, Ser Thr, Ala, Val, Leu, Ile, Asn, Met, or Gln
  SITE (540)..(540): Xaa at position 540 is Leu, Ala, Val, Gly, or Ile
  SITE (545)..(545): Xaa at position 545 is Ile, Ala, Val, Leu, or Gly
  SITE (557)..(557): Xaa at position 557 is Ile, Ala, Val, Leu, or Gly
  SITE (559)..(559): Xaa at position 559 is Ile, Ala, Val, Leu, or Gly
  SITE (562)..(562): Xaa at position 562 is Phe, Tyr, Met, His, Ile, Leu, Val Ala, or Gly
  SITE (576)..(576): Xaa at position 576 is Met, Ile, Leu, Val, Ala, or Gly
  SITE (601)..(601): Xaa at position 601 is Ile, Ala, Val, Leu, or Gly
  SITE (604)..(604): Xaa at position 604 is Leu, Ala, Val, Gly, or Ile
  SITE (606)..(606): Xaa at position 606 is Val, Ala, Gly, Leu, or Ile
  SITE (607)..(607): Xaa at position 607 is Leu, Ala, Val, Gly, or Ile
  SITE (608)..(608): Xaa at position 608 is Leu, Ala, Val, Gly, or Ile
  SITE (609)..(609): Xaa at position 609 is Tyr, Phe, Met, His, Ile, Leu, Val Ala, or Gly
  SITE (611)..(611): Xaa at position 611 is Met, Ile, Leu, Val, Ala, or Gly
  SITE (612)..(612): Xaa at position 612 is Leu, Ala, Val, Gly, or Ile
  SITE (618)..(618): Xaa at position 618 is Phe, Tyr, Met, His, Ile, Leu, Val Ala, or Gly
  SITE (619)..(619): Xaa at position 619 is Ala, Gly, or Pro
  SITE (629)..(629): Xaa at position 629 is Ile, Ala, Val, Leu, or Gly
  SITE (645)..(645): Xaa at position 645 is Trp, Tyr, Phe, Met, His, Ile, Leu Val, Ala, or Gly
  SITE (652)..(652): Xaa at position 652 is Ala, Gly, or Pro
  SITE (655)..(655): Xaa at position 655 is Leu, Ala, Val, Gly, or Ile
  SITE (656)..(656): Xaa at position 656 is Val, Ala, Gly, Leu, or Ile
  SITE (659)..(659): Xaa at position 659 is Met, Ile, Leu, Val, Ala, or Gly
  SITE (660)..(660): Xaa at position 660 is Leu, Ala, Val, Gly, or Ile
  SITE (670)..(670): Xaa at position 670 is Ala, Gly, or Pro
  SITE (673)..(673): Xaa at position 673 is Val, Ala, Gly, Leu, or Ile
  SITE (678)..(678): Xaa at position 678 is Trp, Tyr, Phe, Met, His, Ile, Leu Val, Ala, or Gly
  SITE (699)..(699): Xaa at position 699 is Val, Ala, Gly, Leu, or Ile
  SITE (702)..(702): Xaa at position 702 is Ala, Gly, or Pro
MPLAQLADPWQKMAVESPSDSAENGQQIMDEPMGEEEINPQTEEVSIKEIAITHHVKEGHEKADPSQFELLKVLGQGSFGKVFLXKKISGSDXRQLYXMKVLKKATLKVRDRVRTKMERDXLVEVNHPXIXKLHYAFQTEGKLYLXLDFLRGGDXFTRLSKEVMXTEEDXKFXXXEXXLXXDHXHSXGXXXRDXKPENXLXDEEGXXKXTDXGLSKESIDHEKKXYSFCGTVEYMXPEVVNRRGXTQSXDXXSXGXXXFEXLTGTLPXQGKDRKETMTMXXKAKXGMPQXLSPEXQSXXRMXFKRNPXNRLGAGPDGXEEXKRHSFXSTIDWNKXYRREIHPPFKPXTGRPEDTFYFDPEFTAKTPKDSPGIPPSANAHQLFRGFSFVAITSDDESQAMQTVGVHSIVQQLHRNSIQFTDGYEVKEDIGVGSYSVCKRXIHKATNMEFAXKIXDKSKRDPTEEXEXXLRXGQHPNXITLKDVYDDGKYVYXXTELMKGGEXXDKXXRQKFFSEREXSAVXFTXTKTXEYXHAQGXXXRDXKPSNXLYVDESGNPESXRXCDXGFAKQLRAENGLLXTPCYTANFVAPEVLKRQGYDAACDXWSXGXXXXTXXTGYTPXXNGPDDTPEEXLARIGSGKFSLSGGYXNSVSDTXKDXXSKXXHVDPHQRLTXALXLRHPXIVHWDQLPQYQLNRQDAPHLXKGXMAATYSALNRNQSPVLEPVGRSTLAQRRGIKKITSTAL

SEQ ID NO: 561 - protein, 675 aa, Homo sapiens
  SITE (442)..(442): Xaa at position 442 is Val, Ala, Gly, Leu, or Ile
  SITE (444)..(444): Xaa at position 444 is Val, Ala, Gly, Leu, or Ile
  SITE (461)..(461): Xaa at position 461 is Ala, Gly, or Pro
  SITE (467)..(467): Xaa at position 467 is Leu, Ala, Val, Gly, or Ile
  SITE (472)..(472): Xaa at position 472 is Leu, Ala, Val, Gly, or Ile
  SITE (478)..(478): Xaa at position 478 is Val, Ala, Gly, Leu, or Ile
  SITE (479)..(479): Xaa at position 479 is Cys, Ala, Val, Gly, Ser, or Thr
  SITE (488)..(488): Xaa at position 488 is Val, Ala, Gly, Leu, or Ile
  SITE (497)..(497): Xaa at position 497 is Leu, Ala, Val, Gly, or Ile
  SITE (513)..(513): Xaa at position 513 is Leu, Ala, Val, Gly, or Ile
  SITE (516)..(516): Xaa at position 516 is Met, Ile, Leu, Val, Ala, or Gly
  SITE (517)..(517): Xaa at position 517 is Cys, Ala, Val, Gly, Ser, or Thr
  SITE (520)..(520): Xaa at position 520 is Val, Ala, Gly, Leu, or Ile
  SITE (521)..(521): Xaa at position 521 is Cys, Ala, Val, Gly, Ser, or Thr
  SITE (524)..(524): Xaa at position 524 is Met, Ile, Leu, Val, Ala, or Gly
  SITE (527)..(527): Xaa at position 527 is Leu, Ala, Val, Gly, or Ile
  SITE (537)..(537): Xaa at position 537 is Leu, Ala, Val, Gly, or Ile
  SITE (538)..(538): Xaa at position 538 is Ala, Gly, or Pro
  SITE (539)..(539): Xaa at position 539 is Ala, Gly, or Pro
  SITE (542)..(542): Xaa at position 542 is Cys, Ala, Val, Gly, Ser, or Thr
  SITE (544)..(544): Xaa at position 544 is Val, Ala, Gly, Leu, or Ile
  SITE (550)..(550): Xaa at position 550 is Val, Ala, Gly, Leu, or Ile
  SITE (552)..(552): Xaa at position 552 is Val, Ala, Gly, Leu, or Ile
  SITE (561)..(561): Xaa at position 561 is Val, Ala, Gly, Leu, or Ile
  SITE (580)..(580): Xaa at position 580 is Ala, Gly, or Pro
  SITE (595)..(595): Xaa at position 595 is Val, Ala, Gly, Leu, or Ile
  SITE (596)..(596): Xaa at position 596 is Trp, Tyr, Phe, Met, His, Ile, Leu Val, Ala, or Gly
  SITE (598)..(598): Xaa at position 598 is Phe, Tyr, Met, His, Ile, Leu, Val Ala, or Gly
  SITE (600)..(600): Xaa at position 600 is Ile, Ala, Val, Leu, or Gly
  SITE (601)..(601): Xaa at position 601 is Leu, Ala, Val, Gly, or Ile
  SITE (602)..(602): Xaa at position 602 is Met, Ile, Leu, Val, Ala, or Gly
  SITE (605)..(605): Xaa at position 605 is Val, Ala, Gly, Leu, or Ile
  SITE (606)..(606): Xaa at position 606 is Phe, Tyr, Met, His, Ile, Leu, Val Ala, or Gly
  SITE (621)..(621): Xaa at position 621 is Val, Ala, Gly, Leu, or Ile
  SITE (637)..(637): Xaa at position 637 is Ala, Gly, or Pro
  SITE (645)..(645): Xaa at position 645 is Met, Ile, Leu, Val, Ala, or Gly
  SITE (648)..(648): Xaa at position 648 is Cys, Ala, Val, Gly, Ser, or Thr
  SITE (659)..(659): Xaa at position 659 is Phe, Tyr, Met, His, Ile, Leu, Val Ala, or Gly
  SITE (666)..(666): Xaa at position 666 is Ile, Ala, Val, Leu, or Gly
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDXAXKMIKEGSMSEDEFFQEXQTMMKXSHPKXVKFYGXXSKEYPIYIXTEYISNGCXLNYLRSHGKGLEPSQXLEXXYDXXEGXAFXESHQFIHRDXXXRNXLXDRDLCXKXSDFGMTRYXLDDQYVSSVGTKFPVKWSXPEVFHYFKYSSKSDXXAXGXXXWEXXSLGKQPYDLYDNSQXVLKVSQGHRLYRPHLXSDTIYQIXYSXWHELPEKRPTXQQLLSSXEPLREKDKH

SEQ ID NO: 562 - protein, 366 aa, Homo sapiens
  SITE (9)..(9): Xaa at position 9 is Leu, Ala, Val, Gly, or Ile
  SITE (11)..(11): Xaa at position 11 is Phe, Tyr, Met, His, Ile, Leu, Val Ala, or Gly
  SITE (13)..(13): Xaa at position 13 is Leu, Ala, Val, Gly, or Ile
  SITE (26)..(26): Xaa at position 26 is Leu, Ala, Val, Gly, or Ile
  SITE (30)..(30): Xaa at position 30 is Phe, Tyr, Met, His, Ile, Leu, Val Ala, or Gly
  SITE (36)..(36): Xaa at position 36 is Ala, Gly, or Pro
  SITE (48)..(48): Xaa at position 48 is Leu, Ala, Val, Gly, or Ile
  SITE (49)..(49): Xaa at position 49 is Ala, Gly, or Pro
  SITE (51)..(51): Xaa at position 51 is Tyr, Phe, Met, His, Ile, Leu, Val Ala, or Gly
  SITE (59)..(59): Xaa at position 59 is Ala, Gly, or Pro
  SITE (61)..(61): Xaa at position 61 is Leu, Ala, Val, Gly, or Ile
  SITE (63)..(63): Xaa at position 63 is Ile, Ala, Val, Leu, or Gly
  SITE (69)..(69): Xaa at position 69 is Val, Ala, Gly, Leu, or Ile
  SITE (71)..(71): Xaa at position 71 is Leu, Ala, Val, Gly, or Ile
  SITE (73)..(73): Xaa at position 73 is Leu, Ala, Val, Gly, or Ile
  SITE (89)..(89): Xaa at position 89 is Ile, Ala, Val, Leu, or Gly
  SITE (93)..(93): Xaa at position 93 is Val, Ala, Gly, Leu, or Ile
  SITE (134)..(134): Xaa at position 134 is Tyr, Phe, Met, His, Ile, Leu, Val Ala, or Gly
  SITE (150)..(150): Xaa at position 150 is Ile, Ala, Val, Leu, or Gly
  SITE (152)..(152): Xaa at position 152 is Ile, Ala, Val, Leu, or Gly
  SITE (161)..(161): Xaa at position 161 is Ile, Ala, Val, Leu, or Gly
  SITE (163)..(163): Xaa at position 163 is Ile, Ala, Val, Leu, or Gly
  SITE (181)..(181): Xaa at position 181 is Ile, Ala, Val, Leu, or Gly
  SITE (194)..(194): Xaa at position 194 is Val, Ala, Gly, Leu, or Ile
  SITE (195)..(195): Xaa at position 195 is Leu, Ala, Val, Gly, or Ile
  SITE (196)..(196): Xaa at position 196 is Ile, Ala, Val, Leu, or Gly
  SITE (197)..(197): Xaa at position 197 is Leu, Ala, Val, Gly, or Ile
  SITE (204)..(204): Xaa at position 204 is Ile, Ala, Val, Leu, or Gly
  SITE (205)..(205): Xaa at position 205 is Leu, Ala, Val, Gly, or Ile
  SITE (208)..(208): Xaa at position 208 is Ile, Ala, Val, Leu, or Gly
  SITE (216)..(216): Xaa at position 216 is Val, Ala, Gly, Leu, or Ile
  SITE (218)..(218): Xaa at position 218 is Met, Ile, Leu, Val, Ala, or Gly
  SITE (219)..(219): Xaa at position 219 is Val, Ala, Gly, Leu, or Ile
  SITE (229)..(229): Xaa at position 229 is Cys, Ala, Val, Gly, Ser, or Thr
  SITE (259)..(259): Xaa at position 259 is Val, Ala, Gly, Leu, or Ile
  SITE (260)..(260): Xaa at position 260 is Leu, Ala, Val, Gly, or Ile
  SITE (263)..(263): Xaa at position 263 is Tyr, Phe, Met, His, Ile, Leu, Val Ala, or Gly
  SITE (273)..(273): Xaa at position 273 is Val, Ala, Gly, Leu, or Ile
  SITE (274)..(274): Xaa at position 274 is Ile, Ala, Val, Leu, or Gly
  SITE (298)..(298): Xaa at position 298 is Ile, Ala, Val, Leu, or Gly
  SITE (299)..(299): Xaa at position 299 is Leu, Ala, Val, Gly, or Ile
  SITE (303)..(303): Xaa at position 303 is Met, Ile, Leu, Val, Ala, or Gly
  SITE (305)..(305): Xaa at position 305 is Val, Ala, Gly, Leu, or Ile
  SITE (306)..(306): Xaa at position 306 is Leu, Ala, Val, Gly, or Ile
  SITE (313)..(313): Xaa at position 313 is Phe, Tyr, Met, His, Ile, Leu, Val Ala, or Gly
  SITE (348)..(348): Xaa at position 348 is Val, Ala, Gly, Leu, or Ile
  SITE (358)..(358): Xaa at position 358 is Tyr, Phe, Met, His, Ile, Leu, Val Ala, or Gly
  SITE (360)..(360): Xaa at position 360 is Val, Ala, Gly, Leu, or Ile
MAAARHSTXDXMXGAKADGETILKGXQSIXQEQGMXESVHTWQDHGYXXTXTNKNGSFXNXRXYPHGLXLXDXQSYDGDAQGKEEIDSXLNKXEERMKELSQDSTGRVKRLPPIVRGGAIDRYWPTADGRLVEXDIDEVVYDEDSPYQNXKXLHSKQFGNXLXLSGDVNLAESDLAYTRAXMGSGKEDYTGKDXXXXGGGDGGXXCEXVKLKPKMXTXXEIDQMVIDGXKKYMRKTCGDVLDNLKGDCYQVLIEDCIPXXKRXAKEGREFDYXXNDLTAVPISTSPEEDSTWEFLRLXXDLSXKXXKQDGKYXTQGNCVNLTEALSLYEEQLGRLYCPVEFSKEIVCXPSYLELWVFXTXWKKAKP

SEQ ID NO: 563 - protein, 228 aa, Homo sapiens
  SITE (34)..(34): Xaa at position 34 is Val, Ala, Gly, Leu, or Ile
  SITE (36)..(36): Xaa at position 36 is Trp, Tyr, Phe, Met, His, Ile, Leu Val, Ala, or Gly
  SITE (50)..(50): Xaa at position 50 is Ile, Ala, Val, Leu, or Gly
  SITE (52)..(52): Xaa at position 52 is Val, Ala, Gly, Leu, or Ile
  SITE (58)..(58): Xaa at position 58 is Leu, Ala, Val, Gly, or Ile
  SITE (60)..(60): Xaa at position 60 is Val, Ala, Gly, Leu, or Ile
  SITE (77)..(77): Xaa at position 77 is Tyr, Phe, Met, His, Ile, Leu, Val Ala, or Gly
  SITE (79)..(79): Xaa at position 79 is Leu, Ala, Val, Gly, or Ile
  SITE (102)..(102): Xaa at position 102 is Cys, Ala, Val, Gly, Ser, or Thr
  SITE (118)..(118): Xaa at position 118 is Phe, Tyr, Met, His, Ile, Leu, Val Ala, or Gly
  SITE (130)..(130): Xaa at position 130 is Phe, Tyr, Met, His, Ile, Leu, Val Ala, or Gly
  SITE (138)..(138): Xaa at position 138 is Tyr, Phe, Met, His, Ile, Leu, Val Ala, or Gly
  SITE (139)..(139): Xaa at position 139 is Ile, Ala, Val, Leu, or Gly
  SITE (154)..(154): Xaa at position 154 is Leu, Ala, Val, Gly, or Ile
  SITE (156)..(156): Xaa at position 156 is Val, Ala, Gly, Leu, or Ile
  SITE (158)..(158): Xaa at position 158 is Val, Ala, Gly, Leu, or Ile
MLHVEMLTLVFLVLWMCVFSQDPGSKAVADRYAXYXNSSNPRFQRGDYHXDXCINDYXDXFCPHYEDSVPEDKTERXVXYMVNFDGYSACDHTSKGFKRWEXNRPHSPNGPLKFSEKXQLFTPFSLGFEXRPGREYFXXSSAIPDNGRRSCLKXKXFXRPTNSCMKTIGVHDRVFDVNDKVENSLEPADDTVHESAEPSRGENAAQTPRIPSRLLAILLFLLAMLLTL

(The sequence listing continues in the following parts.)

The invention claimed is:

1. A method of generating an immune response in an animal wherein said method comprises:

a. introducing a mixture of at least two different peptidogenic proteins derived from a starting protein, wherein each of the peptidogenic proteins has altered conformational dynamics as compared to the starting protein, wherein each of the peptidogenic proteins is similar in conformation to the starting protein, and wherein each of the peptidogenic proteins comprises replacement of at least one non-surface amino acid residue in the starting protein with a different amino acid residue to an animal; and b. generating an immune response in the animal.

2. The method of claim 1, wherein the conformational dynamics are altered by:

a. examining the 3-D structure of the starting protein, identifying non-surface amino acid residues of the starting protein and replacing at least one non-surface amino acid residue in the starting protein to generate the peptidogenic proteins; or b. examining a model of the 3-D structure of the starting protein, identifying non-surface amino acid residues of the starting protein and replacing at least one non-surface amino acid residue in the starting protein to generate the peptidogenic proteins; or c. comparing the pattern of conserved amino acid homology across proteins orthologous to the starting protein from different species to identify non-surface amino acid residues of the starting protein and replacing at least one non-surface amino acid residue in the starting protein to generate the peptidogenic proteins; or d. replacing at least one non-surface amino acid residue of the starting protein to generate the peptidogenic proteins; or e. replacing at least one non-surface amino acid residue with a smaller amino acid residue; or f. replacing at least one non-surface amino acid residue with an alanine or glycine; or g. eliminating at least one disulfide bond in the starting protein.

3. The method of claim 1, wherein at least 1, 2, 3, 4, 5, 6, 7, 8, 9, 10, 11, 12, 13, 14, 15, 16, 17, 18, 19, or 20 amino acids are replaced in the starting protein.

4. The method of claim 1, wherein the conformational dynamics of the starting protein are altered by replacing:

a. at least one non-surface threonine with a valine, alanine, glycine or serine; or b. at least one non-surface cysteine with alanine, valine, glycine, serine or threonine; or c. at least one non-surface valine with alanine, glycine, leucine or isoleucine; or d. at least one non-surface leucine with alanine, valine, glycine, or isoleucine; or e. at least one non-surface isoleucine with alanine, valine, leucine, or glycine; or f. at least one non-surface proline with methionine, alanine, valine, leucine, isoleucine, or glycine; or g. at least one non-surface methionine with alanine, valine, leucine, isoleucine, or glycine; or h. at least one non-surface phenylalanine with tyrosine, methionine, histidine, alanine, valine, leucine, isoleucine, or glycine; or i. at least one non-surface tyrosine with phenylalanine, methionine, histidine, alanine, valine, leucine, isoleucine, or glycine; or j. at least one non-surface tryptophan with tyrosine, phenylalanine, methionine, histidine, alanine, valine, leucine, isoleucine, or glycine; or k. at least one non-surface aspartic acid with glutamic acid, glutamine, asparagine, glycine, serine, threonine, alanine, valine, leucine, or isoleucine; or l. at least one non-surface asparagine with glycine, serine, threonine, alanine, valine, leucine, isoleucine, glutamine, glutamic acid, or aspartic acid; or m. at least one non-surface glutamic acid with aspartic acid, asparagine, glutamine, glycine, serine, threonine, alanine, valine, leucine, or isoleucine; or n. at least one non-surface glutamine with glutamic acid, aspartic acid, asparagine, glutamine, glycine, serine, threonine, alanine, valine, leucine, or isoleucine; or o. at least one non-surface lysine with arginine, histidine, glycine, serine, threonine, alanine, valine, methionine, leucine, or isoleucine; or p. at least one non-surface arginine with lysine, histidine, glycine, serine, threonine, alanine, valine, methionine, leucine, or isoleucine; or q. at least one non-surface histidine with phenylalanine, tyrosine, lysine, arginine, glycine, serine, threonine, alanine, valine, glutamine, asparagine, leucine, methionine or isoleucine; or r. at least one non-surface alanine with a glycine or proline; or s. at least one non-surface glycine with an alanine or proline; or t. at least one non-surface serine with an alanine or glycine; or u. at least one non-surface residue with a non-natural amino acid; or v. a combination of any of the above replacements.

5. The method of claim 1, wherein the altered conformational dynamics of the peptidogenic proteins is measured by:

a. a change in melting temperature as compared to the starting protein; or b. a change in Gibbs free energy of stabilization or proteolytic sensitivity assay; or c. a change in Gibbs free energy, wherein the change in Gibbs free energy of stabilization is measured by denaturant modulated equilibrium unfolding, wherein the denaturant is urea or guanidinium hydrochloride.

6. The method of claim 1, wherein similarity in conformation to the starting protein is measured by:

binding of a cross-reacting antibody to both the peptidogenic proteins and the starting protein; optionally wherein (a) binding of the cross-reactive antibody is measured by an immunoprecipitation assay, surface plasmon resonance, isothermal titration calorimetry, oblique-incidence reflective difference (OI-RD), western blots, radioimmunoassays, ELISA (enzyme linked immunosorbent assay), "sandwich" immunoassays, gel diffusion precipitin reactions, immunodiffusion assays, agglutination assays, complement-fixation assays, immunoradiometric assays, fluorescent immunoassays, and/or protein A immunoassays; and/or (b) the cross-reacting antibody has a dissociation constant (KD) to the starting protein and the peptidogenic proteins of less than or equal to $10^{-9}$M; and/or (c) the cross-reacting antibody has a dissociation constant (KD) to the starting protein and the peptidogenic proteins of less than or equal to $10^{-8}$M, less than or equal to $10^{-7}$M, or less than or equal to $10^{-6}$M.

7. The method of claim 1, wherein the starting protein is selected from:

a. an envelope glycoprotein of the human immunodeficiency virus (HIV), HIV gp120, HIV gp41, HIV gp160, an ebola antigen, a viral antigen, a bacterial antigen, a parasite antigen, an allergen, a venom, a toxin, a tumor-associated antigen, a transmembrane domain protein, a G-protein coupled receptor, an ion channel, a hepatitis C virus antigen, a hepatitis B virus antigen, a MERS-CoV antigen, a Zika virus antigen, an influenza virus antigen, a malaria antigen; and/or b. any one of the malaria antigens selected from MAL13P1.225, PF13 0203, PF11 0164, PFLO375W, PFI1270W, PF10 0104, PF13 0128, PF11 0058, PFA0490W, PF07 0087, PFB0570W, PF13 0180, PF11 0065, PF14 0678, PF13 0125, PF13 0141, PF14 0117, PF11 0098, PF14 0660, PFD0240C, PFE0080C, PFA0660W, PF11 0352, PF11 0055, PFB0475C, PF11 0302, PFA0210C, PF07 0089, PF14 0060, MAL8P1.17, MAL7P1.77, PF11 0099, PF07 0068, PF13 0201, PF07 0094, PF07 0006, PFLO770W, PFI1645C, PF14 0166, PFE0815W, PF11 0174, PFE0475W, PF11 0074, PFL1385C, PF14 0102, PF11 0212, PF07 0129, PFL2570W, PFL1070C, PFB0695C, PF11 0175, MAL13P1.22, PFLO035C, PFI0685W, PFD0425W, PF14 0293, PF14 0344, PFLO560C, PF07 0035, PFL1675C, PFC0435W, PFI1445W, PF13 0354, PFC0110W, PFC0120W, PF08 0078, PF14 0614, PF14 0051, PF11 0076, MAL13P1.262, PFC0640W, PFL2520W, PFCO282W, PF08 0004, PF11 0224, PF13 0272, MAL13P1.171, PFE1340W, PF14 0369, PF14 0178, PFLO870W, PFCO210C, PFI0500W, PF11 0069, PFD0355C, PFI0880C, PF11 0251, PFC0065C, PFC0925W, MAL13P1.121, PF13 0133, PFL2015W, PFD0440W, PFC0330W, PFD0430C, PF14 0462, PF07 0100, MAL7P1.23, PFL1835W, PF07 0047, PF14 0250, PFE0905W, PFA0180W, PFL1210W, PF14 0363, PFB0400W, PFI0920C, PF14 0094, PFA0125C, PF10 0372, PFL2315C, MAL13P1.271, MAL7P1.31, PF10 0317, PF07 0070, MAL7P1.64, PFI0935W, PFA0160C, PFB0465C, PF10 0208, PFB0760W, MAL13P1.206, PF14 0541, PFLO790W, PFL2410W, PF14 0440, PF11 0333, PF10 0242, PFC0590C, PF14 0342, MAL7P1.92, PF14 0593, MAL13P1.49, MAL13P1.172, PF08 0006, PFD1035W, PF11 0052, MAL13P1.79, PF10 0295, PFL1745C, PF14 0677, PFLO600W, PF08 0108, PF08 0081, PF14 0620, PFE0710W, PF11 0270, MAL7P1.149, PFC0810C, PF14 0249, PF13 0116, MAL13P1.60, PF11 0246, PFL2505C, PFB0405W, PF11 0256, PF08 0047, PFC0835C, PFI0605C, PF10 0127, PF11 0344, PF10 0130, PFL2395C, PF08 0008, PF14 0201, PFI1475W, PF13 0182, PF14 0495, or PF13 0277; and/or c. any one of the Targets selected from A4GCL9, A8T655, B2R7F8, B4DEZ9, B4DTR1, D4HNR6, D5RWT1, F8WCM5, G8EJ09, I6YE93, K9N5Q8, 000141, 000189, 000206, 000220, 000253, 000294, 000300, 000522, 000585, 000754, 014522, 014763, 014773, 014788, 014793, 014807, 014836, 014896, 014931, 014936, 014976, 014994, 015020, 015118, 015230, 015305, 015357, 015372, 015394, 015455, 015520, 043155, 043291, 043323, 043424, 043557, 043570, 043707, 043854, 043897, 043933, 060229, 060494, 060565, 060602, 060706, 060840, 060882, 075197, 075367, 075369, 075436, 075581, 075665, 075695, 075712, 075874, 075888, 075923, 075970, 076041, 076090, 094804, 095150, 095256, 095342, 095407, 095445, 095452, 095633, 095760, 095967, P00167, P00338, P00387, P00403, P00439, P00441, P00451, P00488, P00492, P00519, P00533, P00568, P00734, P00740, P00742, P00746, P00747, P00748, P00751, P00797, P00918, P00966, P00995, P01008, P01009, P01019, P01024, P01031, P01032, P01034, P01111, P01127, P01130, P01137, P01138, P01185, P01241, P01308, P01344, P01374, P01375, P01579, P01583, P01584, P01588, P01589, P01730, P01854, P01889, P01903, P01906, P01909, P01911, P01912, P01920, P02452, P02458, P02461, P02462, P02489, P02647, P02649, P02671, P02675, P02679, P02708, P02730, P02760, P02766, P02768, P02792, P03147, P03372, P03420, P03441, P03446, P03448, P03456, P03457, P03471, P03472, P03474, P03476, P03477, P03478, P03886, P03950, P03951, P04040, P04049, P04062, P04070, P04080, P04155, P04156, P04179, P04180, P04233, P04234, P04275, P04424, P04440, P04578, P04626, P04629, P04661, P04792, P04839, P05019, P05062, P05067, P05089, P05091, P05106, P05107, P05112, P05113, P05121, P05129, P05155, P05156, P05186, P05231, P05386, P05540, P05556, P05961, P05997, P06127, P06213, P06239, P06280, P06340, P06396, P06681, P06684, P06737, P06744, P06804, P06865, P07204, P07225, P07288, P07339, P07477, P07585, P07602, P07686, P07911, P07949, P07954, P08034, P08100, P08118, P08133, P08183, P08235, P08236, P08237, P08246, P08253, P08326, P08473, P08514, P08519, P08567, P08572, P08575, P08581, P08603, P08617, P08708, P08709, P08887, P09417, P09467, P09603, P09619, P09668, P09936, P09960, POCOL4, POCOLS, PODJI8, PODJI9, P10071, P10321, P10448, P10619, P10721, P10809, P10828, P10912, P11021, P11132, P11166, P11168, P11177, P11215, P11217, P11224, P11230, P11233, P11310, P11362, P11413, P11532, P11586, P11597, P11836, P12023, P12111, P12259, P12318, P12643, P12644, P12821, P12830, P12955, P13103, P13224, P13500, P13569, P13612, P13637, P13716, P13726, P13747, P13765, P13804, P13807, P14138, P14174, P14207, P14210, P14222, P14416, P14672, P14770, P14778, P14780, P14784, P14867, P14921, P14923, P15018, P15259, P15260, P15289, P15291, P15313, P15328, P15391, P15509, P15529, P15692, P15814, P15848, P15907, P15924, P15941, P16109, P16144, P16154, P16278, P16401, P16410, P16422, P16442, P16473, P16871, P16930, P17050, P17174, P17693, P17787, P17858, P17900, P17927, P17948, P18074, P18177, P18206, P18510, P19079, P19235, P19256, P19320, P19438, P19694, P19838, P19876, P20023, P20036, P20138, P20151, P20273, P20701, P20702, P20749, P20807, P20849, P20929, P20933, P21333, P21359, P21439, P21580, P21583, P21709, P21781, P21802, P21817, P21860, P21912, P22105, P22223, P22301, P22362, P22413, P22460, P22735, P22748, P23284, P23415, P23468, P23510, P23560, P23945, P23975, P24723, P24855, P25024, P25025, P25054, P25189, P25445, P26010, P26136, P26927, P27169, P27487, P27909, P27930, P27958, P28062, P28068, P28472, P28482, P28799, P28907, P28908, P29033, P29120, P29216, P29320, P29323, P29400, P29459, P29460, P29590, P29597, P29965, P30044, P30203, P30301, P30460, P30530, P30556, P31371, P31785, P31994, P31995, P31997, P32297, P32754, P33681, P33795, P34059, P34130, P35221, P35222, P35225, P35442, P35462, P35475, P35555, P35579, P35609, P35625, P35670, P35749, P35754, P35968, P35991, P36222, P36871, P36888, P36894, P36896, P36897, P36915, P36941, P36955, P37023, P37173, P38117, P39019, P39023, P39060, P39905, P40225, P40238, P40259, P40394, P41159, P41180, P41181, P41250, P42081, P42261, P42263, P42336, P42568, P42658, P42702, P42768, P43026, P43034, P43235, P43258, P43259, P43260, P43681, P44815, P45381, P45954, P46094, P46379, P46459, P46531, P46783, P46934, P46952, P47756, P48023, P48061, P48167, P48436, P48544, P48643, P49257, P49419, P49588, P49683, P49747, P49768, P49789, P49810, P50440, P50454, P50570, P50897, P50993, P51149, P51159, P51532, P51570, P51608, P51648, P51681, P51688, P51690, P51693, P51787, P51800, P51812, P51813, P52788, P52803, P53004, P53420, P53634, P54098, P54577, P54764, P54802, P54803, P54819, P55008, P55072, P55075, P55268, P55286, P55291, P55789, P56537, P57075, P57735, P58335, P59594, P60033, P60484, P60568, P60900, P60953, P61457, P61626, P61769, P61812, P61916, P62070, P62081, P62736, P62854, P62913, P63092, P63252, P67870, P68032, P68036, P68133, P68871, P69905, P78324, P78363, P78380, P78504, P78509, P78545, P80098, P82279, P84022, P98082, P98160, P98161, Q00653, Q00973, Q01484, Q01955, Q01968, Q02223, Q02297, Q02388, Q02413, Q02487, Q03154, Q03403, Q03426, Q03591, Q04446, Q04609, Q04656, Q04721, Q04771, Q04844, Q05397, Q05495, Q05586, Q06124, Q06187, Q07001, Q07108, Q07599, Q07954, Q07FI5, Q08048, Q08334, Q08345, Q08881, Q09428, Q09470, Q0A2R1, Q0A448, Q0ED31, Q0Z7S6, Q0ZME7, Q0ZNA6, Q12791, Q12809, Q12879, Q12965, Q13002, Q13009, Q13018, Q13093, Q13126, Q13224, Q13231, Q13253, Q13410, Q13421, Q13424, Q13478, Q13496, Q13501, Q13563, Q13614, Q13620, Q13651, Q13698, Q13753, Q13822, Q13835, Q13873, Q13936, Q14019, Q14103, Q14108, Q14114, Q14117, Q14126, Q14204, Q14315, Q14376, Q14563, Q14571, Q14573, Q14654, Q14833, Q14956, Q14974, Q15027, Q15046, Q15109, Q15116, Q15149, Q15223, Q15262, Q15303, Q15465, Q15582, Q15746, Q15822, Q15831, Q15833, Q15848, Q16288, Q16348, Q16515, Q16552, Q16566, Q16787, Q16827, Q189K3, Q189K5, Q18PE1, Q1HLC5, Q1HP67, Q1PHM6, Q28090, Q289M7, Q29974, Q29980, Q29983, Q2M1P5, Q2N0S5, Q2N0S6, Q30154, Q30201, Q32ZE1, Q3T906, Q3UV74, Q3ZC95, Q3ZLH8, Q46342, Q49DS8, Q4KMG0, Q53SF7, Q59FL8, Q59H50, Q5D862, Q5JWF2, Q5T2T1, Q5VV43, Q5VWQ8, Q5VYX0, Q67333, Q69994, Q6DQ33, Q6IQ55, Q6KF10, Q6PHW0, Q6Q1S2, Q6TXC0, Q6VMK1, Q6XV28, Q71U36, Q75760, Q7L0Q8, Q7LG56, Q7Z6G8, Q7Z6Z7, Q82559, Q84850, Q86UR5, Q86UX7, Q8IU80, Q8IWT1, Q8IZI9, Q8IZJ0, Q8IZP0, Q8IZU9, Q8J581, Q8JDI3, Q8N0W4, Q8N157, Q8N1C3, Q8N5C8, Q8N608, Q8NBP7, Q8NCM8, Q8NFY4, Q8NG31, Q8Q7Z9, Q8TDA6, Q8TDX5, Q8TEW8, Q8TF72, Q8WWA0, Q8WX93, Q8WXD0, Q8WXH0, Q8WXI7, Q91MA7, Q92185, Q92542, Q92597, Q92692, Q92736, Q92743, Q92765, Q92766, Q92796, Q92834, Q92838, Q92887, Q92956, Q93052, Q93099, Q969J5, Q96B97, Q96F46, Q96FE5, Q96HC4, Q96J02, Q96J92, Q96MS0, Q96P20, Q96PD4, Q96PX8, Q96QZ7, Q993A8, Q99466, Q99497, Q99877, Q99972, Q99985, Q9BQB4, Q9BUL8, Q9BWV1, Q9BXJ0, Q9BXM0, Q9BXR6, Q9BZ11, Q9C000, Q9D1H1, Q9DBR4, Q9EQF4, Q9GZV9, Q9H0F7, Q9H0U3, Q9H221, Q9H222, Q9H251, Q9H3Z4, Q9H4F8, Q9H6X2, Q9HB21, Q9HBA0, Q9HBE4, Q9HCE7, Q9HCK4, Q9HD26, Q9HDB5, Q9IGQ6, Q9J3E7, Q9NPF7, Q9NQ25, Q9NQ38, Q9NQC7, Q9NS40, Q9NVA2, Q9NVD7, Q9NY72, Q9NZ08, Q9NZN1, Q9NZQ7, Q9NZV8, Q9P1W8, Q9UBP0, Q9UBQ7, Q9UBV7, Q9UBX5, Q9UGJ0, Q9UGM3, Q9UHF4, Q9UHG0, Q9UHN1, Q9UHP7, Q9UIR5, Q9UKL4, Q9UKM7, Q9UKQ2, Q9ULV1, Q9ULV5, Q9UM47, Q9UM54, Q9UNA1, Q9UNG2, Q9UPW8, Q9W7Y7, Q9WFX3, Q9WMX2, Q9Y275, Q9Y281, Q9Y2Q5, Q9Y496, Q9Y4CO, Q9Y4J8, Q9Y5K2, Q9Y5K6, Q9Y6D5, Q9Y6N8, or Q9Y6Q6; and/or d. a tumor associated antigen selected from MAGE-A1, MAGE-A2, MAGE-A3, MAGE-A4, MAGE-A5, MAGE-A6, MAGE-A7, MAGE-A8, MAGE-A9, MAGE-A10, MAGE-A1 1, MAGE-A12, GAGE-I, GAGE-2, GAGE-3, GAGE-4, GAGE-5, GAGE-6, GAGE-7, GAGE-8, BAGE-I, RAGE-1, LB33/MUM-1, PRAME, NAG, MAGE-Xp2 (MAGE-B2), MAGE-Xp3 (MAGE-B3), MAGE-Xp4 (MAGE-B4), MAGE-C1/CT7, MAGE-C2, NY-ESO-I, LAGE-I, SSX-I, SSX-2(HOM-MEL-40), SSX-3, SSX-4, SSX-5, SCP-I and XAGE, melanocyte differentiation antigens, p53, ras, CEA, MUC1, PMSA, PSA, tyrosinase, Melan-A, MART-1, gp100, gp75, alpha-actinin-4, Bcr-Abl fusion protein, Casp-8, beta-catenin, cdc27, cdk4, cdkn2a, coa-1, dek-can fusion protein, EF2, ETV6-AML1 fusion protein, LDLR-fucosyltransferaseAS fusion protein, HLA-A2, HLA-All, hsp70-2, KIAAO205, Mart2, Mum-2, and 3, neo-PAP, myosin class I, OS-9, pml-RAR alpha fusion protein, PTPRK, K-ras, N-ras, Triosephosphate isomerase, GnTV, Herv-K-mel, NA-88, SP17, and TRP2-Int2, (MART-I), E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, alpha-fetoprotein, 13HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB\170K, NY-CO-1, RCAS1, SDCCAG16, TA-90 (Mac-2 binding protein\cyclophilin C-associated protein), TAAL6, TAG72, TLP, TPS, tyrosinase related proteins, TRP-1, TRP-2, or cytomegalovirus phosphoprotein 65 (pp65).

8. The method of claim 1, wherein the mixture of peptidogenic proteins is introduced into the animal by:

a. administering the mixture of peptidogenic proteins to the animal;
b. administering a mixture of polynucleotides encoding the mixture of peptidogenic proteins to the animal; and/or
c. administering to the animal antigen presenting cells transfected with the mixture of polynucleotides and/or placed in contact with the mixture of peptidogenic proteins.

9. The method of claim 1, wherein the peptidogenic proteins are derived:

a. from the same starting protein; or
b. from multiple starting proteins; or
c. from multiple related starting proteins.

10. The method of claim 8, wherein the mixture of peptidogenic proteins is introduced into the animal by administering a mixture of polynucleotides encoding the mixture of peptidogenic proteins to the animal, and wherein the polynucleotides:

a. are synthesized in vitro; or
b. comprise DNA; or
c. comprise in vitro transcribed (IVT) mRNA; or
d. comprise IVT mRNA comprising a poly(A) tail; or
e. comprise IVT mRNA comprising a 5' Cap, optionally wherein the polynucleotides are:
1) not associated with any targeting components; or
2) are associated with a targeting component capable of targeting the polynucleotides to a cell or an organ; or
3) are associated with a targeting component capable of targeting the polynucleotides to a cell or an organ, wherein the targeting component is a vector.

11. The method of claim 1 wherein the animal is a mammal, a human, mouse, rabbit, llama, or a cow.

12. The method of claim 8, wherein the animal is injected with the polynucleotides, wherein the polynucleotides are:

a. injected directly into the muscle of the animal; and/or
b. injected into the animal on multiple occasions.

13. The method of claim 1, wherein the immune response generates antibodies.

14. The method of claim 13, wherein the method further comprises isolating the antibodies.

15. The method of claim 14, wherein the antibodies are fully human antibodies, chimeric antibodies, humanized antibodies, monoclonal antibodies, and/or polyclonal antibodies.

16. The method of claim 13, wherein the method further comprises affinity maturing the antibodies, wherein the affinity maturation occurs by:

a. phage display, yeast display or ribosome display; or
b. a panning technique.

17. The method of claim 1, wherein the mixture of peptidogenic proteins further comprises the starting protein.

18. The method of claim 1, wherein each of the peptidogenic proteins has increased conformational dynamics as compared to the starting protein.

* * * * *

UNITED STATES PATENT AND TRADEMARK OFFICE

CERTIFICATE OF CORRECTION

PATENT NO. : 11,384,138 B2
APPLICATION NO. : 15/753321
DATED : July 12, 2022
INVENTOR(S) : Anderson et al.

It is certified that error appears in the above-identified patent and that said Letters Patent is hereby corrected as shown below:

In the Claims

In Claim 7, Column 187, Line 39 to Column 188, Line 13:
"b. anyone of the malaria antigens selected from MAL13P1.225, PF13 0203, PF11 0164, PFLO375W, PFI1270W, PF10 0104, PF13 0128, PF11 0058, PFA0490W, PF07 0087, PFB0570W, PF13 0180, PF11 0065, PF14 0678, PF13 0125, PF13 0141, PF14 0117, PF11 0098, PF14 0660, PFD0240C, PFE0080C, PFA0660W, PF11 0352, PF11 0055, PFB0475C, PF11 0302, PFA0210C, PF07 0089, PF14 0060, MAL8P1.17, MAL7P1.77, PF11 0099, PF07 0068, PF13 0201, PF07 0094, PF07 0006, PFLO770W, PFI1645C, PF14 0166, PFE0815W, PF11 0174, PFE0475W, PF11 0074, PFL1385C, PF14 0102, PF11 0212, PF07 0129, PFL2570W, PFL1070C, PFB0695C, PF11 0175, MAL13P1.22, PFLO035C, PFI0685W, PFD0425W, PF14 0293, PF14 0344, PFLO560C, PF07 0035, PFL1675C, PFC0435W, PFI1445W, PF13 0354, PFC0110W, PFC0120W, PF08 0078, PF14 0614, PF14 0051, PF11 0076, MALI 3P1.262, PFC0640W, PFL2520W, PFC0282W, PF08 0004, PF11 0224, PF13 0272, MALI 3P1.171, PFE1340W, PF14 0369, PF14 0178, PFLO870W, PFCO210C, PFI0500W, PF11 0069, PFD0355C, PFI0880C, PF11 0251, PFC0065C, PFC0925W, MAL13P1.121, PF13 0133, PFL2015W, PFD0440W, PFC0330W, PFD0430C, PF14 0462, PF07 0100, MAL7P1.23, PFL1835W, PF07 0047, PF14 0250, PFE0905W, PFA0180W, PFL1210W, PF14 0363, PFB0400W, PFI0920C, PF14 0094, PFA0125C, PF10 0372, PFL2315C, MALI 3P1.271, MAL7P1.31, PF10 0317, PF07 0070, MAL7P1.64, PFI0935W, PFA0160C, PFB0465C, PF10 0208, PFB0760W, MALI 3P1.206, PF14 0541, PFLO790W, PFL2410W, PF14 0440, PF11 0333, PF10 0242, PFC0590C, PF14 0342, MAL7P1.92, PF14 0593, MAL13P1.49, MAL13P1.172, PF08 0006, PFD1035W, PF11 0052, MAL13P1.79, PF10 0295, PFL1745C, PF14 0677, PFLO600W, PF08 0108, PF08 0081, PF14 0620, PFE0710W, PF11 0270, MAL7P1.149, PFC0810C, PF14 0249, PF13 0116, MAL13P1.60, PF11 0246, PFL2505C, PFB0405W, PF11 0256, PF08 0047, PFC0835C, PFI0605C, PF10 0127, PF11 0344, PF10 0130, PFL2395C, PF08 0008, PF14 0201, PFI1475W, PF13 0182, PF14 0495, or PF13 0277; and/or" should read
--b. any one of the malaria antigens selected from MAL13P1.225, PF13_0203, PF11_0164, PFL0375W, PFI1270W, PF10_0104, PF13_0128, PF11_0058, PFA0490W, PF07_0087, PFB0570W, PF13_0180, PF11_0065, PF14_0678, PF13_0125, PF13_0141, PF14_0117, PF11_0098, PF14_0660, PFD0240C, PFE0080C, PFA0660W, PF11_0352, PF11_0055, PFB0475C, PF11_0302, PFA0210C, Signed and Sealed this
Twenty-seventh Day of September, 2022

Katherine Kelly Vidal

Katherine Kelly Vidal
*Director of the United States Patent and Trademark Office*

PF07_0089, PF14_0060, MAL8P1.17, MAL7P1.77, PF11_0099, PF07_0068, PF13_0201, PF07_0094, PF07_0006, PFL0770W, PFI1645C, PF14_0166, PFE0815W, PF11_0174, PFE0475W, PF11_0074, PFL1385C, PF14_0102, PF11_0212, PF07_0129, PFL2570W, PFL1070C, PFB0695C, PF11_0175, MAL13P1.22, PFL0035C, PFI0685W, PFD0425W, PF14_0293, PF14_0344, PFL0560C, PF07_0035, PFL1675C, PFC0435W, PFI1445W, PF13_0354, PFC0110W, PFC0120W, PF08_0078, PF14_0614, PF14_0051, PF11_0076, MAL13P1.262, PFC0640W, PFL2520W, PFC0282W, PF08_0004, PF11_0224, PF13_0272, MAL13P1.171, PFE1340W, PF14_0369, PF14_0178, PFL0870W, PFC0210C, PFI0500W, PF11_0069, PFD0355C, PFI0880C, PF11_0251, PFC0065C, PFC0925W, MAL13P1.121, PF13_0133, PFL2015W, PFD0440W, PFC0330W, PFD0430C, PF14_0462, PF07_0100, MAL7P1.23, PFL1835W, PF07_0047, PF14_0250, PFE0905W, PFA0180W, PFL1210W, PF14_0363, PFB0400W, PFI0920C, PF14_0094, PFA0125C, PF10_0372, PFL2315C, MAL13P1.271, MAL7P1.31, PF10_0317, PF07_0070, MAL7P1.64, PFI0935W, PFA0160C, PFB0465C, PF10_0208, PFB0760W, MALI 3P1.206, PF14_0541, PFL0790W, PFL2410W, PF14_0440, PF11_0333, PF10_0242, PFC0590C, PF14_0342, MAL7P1.92, PF14_0593, MAL13P1.49, MALI 3P1.172, PF08_0006, PFD1035W, PF11_0052, MAL13P1.79, PF10_0295, PFL1745C, PF14_0677, PFL0600W, PF08_0108, PF08_0081, PF14_0620, PFE0710W, PF11_0270, MAL7P1.149, PFC0810C, PF14_0249, PF13_0116, MAL13P1.60, PF11_0246, PFL2505C, PFB0405W, PF11_0256, PF08_0047, PFC0835C, PFI0605C, PF10_0127, PF11_0344, PF10_0130, PFL2395C, PF08_0008, PF14_0201, PFI1475W, PF13_0182, PF14_0495, or PF13_0277; and/or--

In Claim 7, Column 188, Lines 16 to 28:
"000141, 000189, 000206, 000220, 000253, 000294, 000300, 000522, 000585, 000754, 014522, 014763, 014773, 014788, 014793, 014807, 014836, 014896, 014931, 014936, 014976, 014994, 015020, 015118, 015230, 015305, 015357, 015372, 015394, 015455, 015520, 043155, 043291, 043323, 043424, 043557, 043570, 043707, 043854, 043897, 043933, 060229, 060494, 060565, 060602, 060706, 060840, 060882, 075197, 075367, 075369, 075436, 075581, 075665, 075695, 075712, 075874, 075888, 075923, 075970, 076041, 076090, 094804, 095150, 095256, 095342, 095407, 095445, 095452, 095633, 095760, 095967," should read
--O00141, O00189, O00206, O00220, O00253, O00294, O00300, O00522, O00585, O00754, O14522, O14763, O14773, O14788, O14793, O14807, O14836, O14896, O14931, O14936, O14976, O14994, O15020, O15118, O15230, O15305, O15357, O15372, O15394, O15455, O15520, O43155, O43291,O43323, O43424, O43557, O43570, O43707, O43854, O43897, O43933, O60229, O60494, O60565, O60602, O60706, O60840, O60882, O75197, O75367, O75369, O75436, O75581, O75665, O75695, O75712, O75874, O75888, O75923, O75970, O76041, O76090, O94804, O95150, O95256, O95342, O95407, O95445, O95452, O95633, O95760, O95967,--

In Claim 7, Column 188, Line 59:
"POCOL4, POCOLS, PODJI8, PODJI9," should read
--P0C0L4, P0C0L5, P0DJI8, P0DJI9,--

In Claim 7, Column 190, Line 44:
"MAGE-A1 1" should read --MAGE-A11--

In Claim 10, Column 191, Line 30:
"in vitro" should read -- *in vitro* --
In Claim 10, Column 191, Line 32:

"in vitro" should read -- *in vitro* --